US011237155B2

(12) United States Patent
McGrane et al.

(10) Patent No.: US 11,237,155 B2
(45) Date of Patent: Feb. 1, 2022

(54) SCREENING METHODS USING OLFACTORY RECEPTORS AND NOVEL COMPOUNDS IDENTIFIED USING THE SAME

(71) Applicant: MARS, INCORPORATED, McLean, VA (US)

(72) Inventors: Scott McGrane, Leicestershire (GB); Matthew Ronald Gibbs, Leicestershire (GB)

(73) Assignee: MARS, INCORPORATED, McLean, VA (US)

( * ) Notice: Subject to any disclaimer, the term of this patent is extended or adjusted under 35 U.S.C. 154(b) by 284 days.

(21) Appl. No.: 16/333,899

(22) PCT Filed: Sep. 29, 2017

(86) PCT No.: PCT/US2017/054620
§ 371 (c)(1),
(2) Date: Mar. 15, 2019

(87) PCT Pub. No.: WO2018/064636
PCT Pub. Date: Apr. 5, 2018

(65) Prior Publication Data
US 2019/0212328 A1 Jul. 11, 2019

Related U.S. Application Data

(60) Provisional application No. 62/402,823, filed on Sep. 30, 2016.

(51) Int. Cl.
*G01N 33/50* (2006.01)
*A23K 50/40* (2016.01)

(52) U.S. Cl.
CPC ......... *G01N 33/5038* (2013.01); *A23K 50/40* (2016.05); *G01N 33/5008* (2013.01); *G01N 2333/726* (2013.01)

(58) Field of Classification Search
CPC ................................................ G01N 33/5038
See application file for complete search history.

(56) References Cited

U.S. PATENT DOCUMENTS

| 7,344,845 | B2 | 3/2008 | Han et al. |
|---|---|---|---|
| 2003/0207337 | A1 | 11/2003 | Han et al. |
| 2006/0134693 | A1 | 6/2006 | Servant et al. |
| 2011/0189335 | A1 | 8/2011 | Mussawir-Key et al. |
| 2013/0209625 | A1 | 8/2013 | Brand et al. |

FOREIGN PATENT DOCUMENTS

| WO | WO 2010/018365 A1 | 2/2010 |
|---|---|---|
| WO | WO 2012/013480 A1 | 2/2012 |
| WO | WO 2012/029922 A1 | 3/2012 |
| WO | 2014191047 A1 | 12/2014 |
| WO | WO 2014/199114 A1 | 12/2014 |
| WO | WO 2016/030378 A1 | 3/2016 |
| WO | WO 2016/094702 A2 | 6/2016 |

OTHER PUBLICATIONS

Jaeger et al., A Mendelian Trait for Olfactory Sensitivity Affects Odor Experience and Food Selection. Current Biology 23 (16): 1601-1605, 2013.*
Santos, et al., "Genomic architecture of MHC-linked odorant receptor gene repertoires among 16 vertebrate species," Immunogenetics, Springer, Berlin, DE, vol. 62, No. 9, Aug. 2010, pp. 569-584, XP019841484.
Altschul, et al., "Basic Local Alignment Search Tool", J. Mol. Biol., Oct. 1990, 215, 403-410.
Altschul, et al., "Gapped BLAST and PSI-BLAST: A New Generation of Protein Database Search Programs", Nucleic Acids Research, Sep. 1997, vol. 25, No. 17, pp. 3389-3402.
Benbernou, et al., "cAMP and IP3 Signaling Pathways in HEK293 Cells Transfected with Canine Olfactory Receptor Genes", Journal of Heredity, vol. 102(S1):S47-S61, Jan. 1, 2011.
Castro, et al., "Categorical Dimensions of Human Odor Descriptor Space Revealed by Non-Negative Matrix Factorization", Plos One, 8(9), e73289, 13 pgs. (Sep. 2013).
Cline, "Perspectives for Gene Therapy: Inserting New Genetic Information into Mammalian Cells by Physical Techniques and Viral Vectors", Pharmac. Ther., vol. 29, pp. 69-92, 1985.
Cotten, et al., "Receptor-Mediated Transport of DNA into Eurkaryotic Cells", Methods in Enzymology, vol. 217 (Mar. 1993), pp. 618-644.
Cunningham, et al., "High-Resolution Epitope Mapping of hGH-Receptor Interactions by Alanine-Scanning Mutagenesis", Science, 1989, 244(4908):1081-1085, Abstract only (2 pgs.).
Dravnieks, "Atlas of Odor Character Profiles, American Society for Testing and Materials", 1985, 7 pgs.
Eswar, et al., "Comparative Protein Structure Modeling Using Modeller", Curr Protoc Bioinformatics, Supplement 15, 5.6.1-5.6.30, 47 pages (Oct. 2006).
Fu, et al., "CD-HIT: accelerated for clustering the next-generation sequencing data", Bioinformatics, 28(23):3150-2, Dec. 2012.
Karlin, et al., "Applications and Statistics for Multiple High-Scoring Segments in Molecular Sequences", Proc. Natl. Acad. Sci. USA vol. 90 pp. 5873-5877, Jun. 1993.
Karlin, et al., "Methods for Assessing the Statistical Significance of Molecular Sequence Features by Using General Scoring Schemes", Proc. Natl. Acad. Sci. USA, vol. 87, pp. 2264-2268, Mar. 1990.
Lee et al., "Structural Insights into Ligand Recognition and Selectivity for Class A, B and C GPCR's", Eur. J. Pharmacol., Sep. 2015, 763:196-205.
Loeffler, et al., "Gene Transfer into Primary and Established Mammalian Cell Lines with Lipopolyamine-Coated DNA", Methods in Enzymology, vol. 217 (Mar. 1993), 599-618.
Myers et al., Optimal Alignments in Linear Space, CABIOS, vol. 4(1), 11-17 (Mar. 1988).

(Continued)

*Primary Examiner* — Ruixiang Li
(74) *Attorney, Agent, or Firm* — Baker Botts L.L.P.

(57) ABSTRACT

The presently disclosed subject matter relates to methods of screening raw materials and pet food products to manufacture a palatable pet food product. The presently disclosed subject matter also relates to methods for identifying compounds that modulate the activity and/or expression of an olfactory receptor.

16 Claims, 97 Drawing Sheets

Specification includes a Sequence Listing.

(56) References Cited

OTHER PUBLICATIONS

Niimura, et al., "Corrigendum: Extreme expansion of the olfactory receptor gene repertoire in African elephants and evolutionary dynamics of orthologous gene groups in 13 placental mammals", Gen Research, 24(9) 19485-1496 (Sep. 2014).
Niimura, et al., "Extensive Gains and Losses of Olfactory Receptor Genes in Mammalian Evolution", Plos One, vol. 2, No. 8, Aug. 1, 2007, p. e708, 8 pgs.
Pearson, et al., "Improved Tools for Biological Sequence Comparison", Proc. Natl. Acad. Sci. USA, 85:2444-8, Apr. 1988.
Rasmussen, et al., "Crystal Structure of the Beta Adrenergic Receptor-Gs Protein Complex", Nature, (Jul. 2011) 477: 549-555.
Rice, et al., "EMBOSS: the European Molecular Biology Open Software Suite," Trends Genet., 16(6), 276-7, Jun. 2000.
Torelli, et al., "ADVANCE and ADAM: two algorithms for the analysis of global similarity between homologous informational sequences", Bioinformatics, vol. 10, Issue 1, Feb. 1994, 3-5.
Yang, et al., "The I-TASSER Suite: Protein Structure and Function Prediction", Nat. Methods vol. 12:7-8 (Jan. 2015).

* cited by examiner

Olfactory Receptor Nucleotide Sequences and Corresponding Amino Acid Sequences

HsOR17.1.11 (hOR3A1) nucleotide sequence (SEQ ID NO:1)

ATGCAGCCAGAATCTGGGGCCAATGGAACAGTCATTGCTGAGTTCATCCTGCTGGGCTTGCTGGAGGC
GCCAGGGCTGCAGCCAGTTGTCTTTGTGCTCTTCCTCTTTGCCTACCTGGTCACGGTCAGGGGCAACC
TCAGCATCCTGGCAGCTGTCTTGGTGGAGCCCAAACTCCACACCCCCATGTACTTCTTCCTGGGGAAC
CTATCAGTGCTGGATGTTGGGTGCATCAGCGTCACTGTTCCATCAATGTTGAGTCGTCTCCTGTCCCG
CAAGCGTGCAGTTCCCTGTGGGGCCTGCCTTACCCAGCTCTTCTTCTTCCATCTGTTCGTTGGAGTGG
ACTGCTTCCTGCTGACCGCCATGGCCTATGACCGATTCCTGGCCATCTGCCGGCCCCTCACCTACAGC
ACCCGCATGAGTCAGACAGTCCAGAGGATGTTGGTGGCTGCGTCCTGGGCTTGTGCTTTCACCAACGC
ACTGACCCACACTGTGGCCATGTCCACGCTCAACTTCTGTGGCCCCAATGTGATCAATCACTTCTACT
GTGACCTCCCACAGCTCTTCCAGCTCTCCTGCTCCAGCACCCAACTCAATGAGCTGCTGCTTTTTGCT
GTGGGTTTTATAATGGCAGGTACCCCCATGGCTCTCATTGTCATCTCCTATATCCACGTGGCAGCTGC
AGTCCTGCGAATTCGCTCTGTAGAGGGCAGGAAGAAAGCCTTCTCCACATGTGGCTCCCACCTCACTG
TGGTTGCCATATTCTATGGTTCAGGTATCTTTAACTATATGCGACTGGGTTCAACCAAGCTTTCAGAC
AAGGATAAAGCTGTTGGAATTTTCAACACTGTCATCAATCCCATGCTGAACCCAATCATCTACAGCTT
CAGAAACCCTGATGTGCAGAGTGCCATCTGGAGGATGCTCACAGGGAGGCGGTCACTGGCTTGA

HsOR17.1.11 (hOR3A1) amino acid sequence (SEQ ID NO:31)

MQPESGANGTVIAEFILLGLLEAPGLQPVVFVLFLFAYLVTVRGNLSILAAVLVEPKLHTPMYFFLGN
LSVLDVGCISVTVPSMLSRLLSRKRAVPCGACLTQLFFFHLFVGVDCFLLTAMAYDRFLAICRPLTYS
TRMSQTVQRMLVAASWACAFTNALTHTVAMSTLNFCGPNVINHFYCDLPQLFQLSCSSTQLNELLLFA
VGFIMAGTPMALIVISYIHVAAAVLRIRSVEGRKKAFSTCGSHLTVVAIFYGSGIFNYMRLGSTKLSD
KDKAVGIFNTVINPMLNPIIYSFRNPDVQSAIWRMLTGRRSLA

FIG. 1

HsOR1.4.8 (hOR6P1) nucleotide sequence (SEQ ID NO:2)

ATGAGAAATTTGAGTGGAGGCCATGTCGAGGAGTTTGTCTTGGTGGGTTTCCCTACCACGCCTCCCCT
CCAGCTGCTCCTCTTTGTCCTTTTTTTGCAATTTACCTTCTGACATTGTTGGAGAATGCACTTATTG
TCTTCACAATATGGCTTGCTCCAAGCCTTCATCGTCCCATGTACTTTTTCCTTGGCCATCTCTCTTTC
CTGGAGCTATGGTACATCAATGTCACCATTCCTCGGCTCTTGGCAGCCTTTCTTACCCAGGATGGTAG
AGTCTCCTACGTAGGTTGCATGACCCAACTGTACTTCTTTATTGCCTTAGCCTGTACTGAATGTGTGC
TGTTGGCAGTTATGGCCTATGATCGCTACCTGGCCATCTGTGGACCCCTCCTTTACCCTAGTCTCATG
CCTTCCAGTCTGGCCACTCGCCTTGCTGCTGCCTCTTGGGGCAGTGGCTTCTTCAGCTCCATGATGAA
GCTTCTTTTTATTTCCCAATTGTCCTACTGTGGACCCAACATTATCAACCACTTTTTCTGTGATATTT
CCCCACTACTCAACCTCACCTGCTCTGACAAGGAGCAAGCAGAGCTAGTAGACTTCCTTCTGGCCCTG
GTGATGATTCTACTCCCTCTATTGGCTGTGGTTTCATCATACACTGCCATCATTGCAGCCATCCTGAG
GATCCCTACGTCCAGGGGACGCCACAAAGCCTTTTCCACTTGTGCCGCTCATCTGGCAGTGGTTGTTA
TCTACTACTCCTCCACTCTCTTCACCTATGCACGGCCCCGGGCCATGTACACCTTCAACCACAACAAG
ATTATCTCTGTGCTCTACACTATCATTGTACCATTCTTCAACCCAGCCATCTACTGCCTGAGGAACAA
GGAGGTGAAGGAGGCCTTCAGGAAGACAGTGATGGGCAGATGTCACTATCCTAGGGATGTTCAGGACT
GA

HsOR1.4.8 (hOR6P1) amino acid sequence (SEQ ID NO:32)

MRNLSGGHVEEFVLVGFPTTPPLQLLLFVLFFAIYLLTLLENALIVFTIWLAPSLHRPMYFFLGHLSF
LELWYINVTIPRLLAAFLTQDGRVSYVGCMTQLYFFIALACTECVLLAVMAYDRYLAICGPLLYPSLM
PSSLATRLAAASWGSGFFSSMMKLLFISQLSYCGPNIINHFFCDISPLLNLTCSDKEQAELVDFLLAL
VMILLPLLAVVSSYTAIIAAILRIPTSRGRHKAFSTCAAHLAVVVIYYSSTLFTYARPRAMYTFNHNK
IISVLYTIIVPFFNPAIYCLRNKEVKEAFRKTVMGRCHYPRDVQD*

FIG. 1 Continued

HsOR11.3.14 (hOR51E1) nucleotide sequence (SEQ ID NO:3)

ATGATGGTGGATCCCAATGGCAATGAATCCAGTGCTACATACTTCATCCTAATAGGCCTCCCTGGTTT
AGAAGAGGCTCAGTTCTGGTTGGCCTTCCCATTGTGCTCCCTCTACCTTATTGCTGTGCTAGGTAACT
TGACAATCATCTACATTGTGCGGACTGAGCACAGCCTGCATGAGCCCATGTATATATTTCTTTGCATG
CTTTCAGGCATTGACATCCTCATCTCCACCTCATCCATGCCCAAAATGCTGGCCATCTTCTGGTTCAA
TTCCACTACCATCCAGTTTGATGCTTGTCTGCTACAGATGTTTGCCATCCACTCCTTATCTGGCATGG
AATCCACAGTGCTGCTGGCCATGGCTTTTGACCGCTATGTGGCCATCTGTCACCCACTGCGCCATGCC
ACAGTACTTACGTTGCCTCGTGTCACCAAAATTGGTGTGGCTGCTGTGGTGCGGGGGGCTGCACTGAT
GGCACCCCTTCCTGTCTTCATCAAGCAGCTGCCCTTCTGCCGCTCCAATATCCTTTCCCATTCCTACT
GCCTACACCAAGATGTCATGAAGCTGGCCTGTGATGATATCCGGGTCAATGTCGTCTATGGCCTTATC
GTCATCATCTCCGCCATTGGCCTGGACTCACTTCTCATCTCCTTCTCATATCTGCTTATTCTTAAGAC
TGTGTTGGGCTTGACACGTGAAGCCCAGGCCAAGGCATTTGGCACTTGCGTCTCTCATGTGTGTGCTG
TGTTCATATTCTATGTACCTTTCATTGGATTGTCCATGGTGCATCGCTTTAGCAAGCGGCGTGACTCT
CCGCTGCCCGTCATCTTGGCCAATATCTATCTGCTGGTTCCTCCTGTGCTCAACCCAATTGTCTATGG
AGTGAAGACAAAGGAGATTCGACAGCGCATCCTTCGACTTTTCCATGTGGCCACACACGCTTCAGAGC
CCTA

HsOR11.3.14 (hOR51E1) amino acid sequence (SEQ ID NO:33)

MMVDPNGNESSATYFILIGLPGLEEAQFWLAFPLCSLYLIAVLGNLTIIYIVRTEHSLHEPMYIFLCM
LSGIDILISTSSMPKMLAIFWFNSTTIQFDACLLQMFAIHSLSGMESTVLLAMAFDRYVAICHPLRHA
TVLTLPRVTKIGVAAVVRGAALMAPLPVFIKQLPFCRSNILSHSYCLHQDVMKLACDDIRVNVVYGLI
VIISAIGLDSLLISFSYLLILKTVLGLTREAQAKAFGTCVSHVCAVFIFYVPFIGLSMVHRFSKRRDS
PLPVILANIYLLVPPVLNPIVYGVKTKEIRQRILRLFHVATHASEP*

FIG. 1 Continued

HsOR11.3.40 (hOR51L1) nucleotide sequence (SEQ ID NO:4)

ATGGGAGACTGGAATAACAGTGATGCTGTGGAGCCCATATTTATCCTGAGGGGTTTTCCTGGACTGGA
GTATGTTCATTCTTGGCTCTCCATCCTCTTCTGTCTTGCATATTTGGTAGCATTTATGGGTAATGTTA
CCATCCTGTCTGTCATTTGGATAGAATCCTCTCTCCATCAGCCCATGTATTACTTTATTTCCATCTTA
GCAGTGAATGACCTGGGGATGTCCCTGTCTACACTTCCCACCATGCTTGCTGTGTTATGGTTGGATGC
TCCAGAGATCCAGGCAAGTGCTTGCTATGCTCAGCTGTTCTTCATCCACACATTCACATTCCTGGAGT
CCTCAGTGTTGCTGGCCATGGCCTTTGACCGTTTTGTTGCTATCTGCCATCCACTGCACTACCCCACC
ATCCTCACCAACAGTGTAATTGGCAAAATTGGTTTGGCCTGTTTGCTACGAAGCTTGGGAGTTGTACT
TCCCACACCTTTGCTACTGAGACACTATCACTACTGCCATGGCAATGCCCTCTCTCACGCCTTCTGTT
TGCACCAGGATGTTCTAAGATTATCCTGTACAGATGCCAGGACCAACAGTATTTATGGGCTTTGTGTA
GTCATTGCCACACTAGGTGTGGATTCAATCTTCATACTTCTTTCTTATGTTCTGATTCTTAATACTGT
GCTGGATATTGCATCTCGTGAAGAGCAGCTAAAGGCACTCAACACATGTGTATCCCATATCTGTGTGG
TGCTTATCTTCTTTGTGCCAGTTATTGGGGTGTCAATGGTCCATCGCTTTGGGAAGCATCTGTCTCCC
ATAGTCCACATCCTCATGGCAGACATCTACCTTCTTCTTCCCCCAGTCCTTAACCCTATTGTCTATAG
TGTCAGAACAAAGCAGATTCGTCTAGGAATTCTCCACAAGTTTGTCCTAAGGAGGAGGTTTTAA

HsOR11.3.40 (hOR51L1) amino acid sequence (SEQ ID NO:34)

MGDWNNSDAVEPIFILRGFPGLEYVHSWLSILFCLAYLVAFMGNVTILSVIWIESSLHQPMYYFISIL
AVNDLGMSLSTLPTMLAVLWLDAPEIQASACYAQLFFIHTFTFLESSVLLAMAFDRFVAICHPLHYPT
ILTNSVIGKIGLACLLRSLGVVLPTPLLLRHYHYCHGNALSHAFCLHQDVLRLSCTDARTNSIYGLCV
VIATLGVDSIFILLSYVLILNTVLDIASREEQLKALNTCVSHICVVLIFFVPVIGVSMVHRFGKHLSP
IVHILMADIYLLLPPVLNPIVYSVRTKQIRLGILHKFVLRRRF*

FIG. 1 Continued

HsOR14.1.27 (hOR11H6) nucleotide sequence (SEQ ID NO:5)

atgttctttattattCATTCTTTGGTTACTTCTGTTTTTCTAACAGCTTTGGGACCCCAGAA
CAGAACAATGCATTTTGTGACTGAGTTTGTCCTCCTGGGTTTCCATGGTCAAAGGGAGATGC
AGAGCTGCTTCTTCTCATTCATCCTGGTTCTCTATCTCCTGACACTGCTAGGGAATGGAGCT
ATTGTCTGTGCAGTGAAATTGGACAGGCGGCTCCACACACCCATGTACATCCTTCTGGGAAA
CTTTGCCTTTCTAGAGATCTGGTACATTTCCTCCACTGTCCCAAACATGCTAGTCAATATCC
TCTCTGAGATTAAAACCATCTCCTTCTCTGGTTGCTTCCTGCAATTCTATTTCTTTTTTTCA
CTGGGTACAACAGAGTGTTTCTTTTTATCAGTTATGGCTTATGATCGGTACCTGGCCATCTG
TCGTCCATTACACTACCCCTCCATCATGACTGGGAAGTTCTGTATAATTCTGGTCTGTGTAT
GCTGGGTAGGCGGATTTCTCTGCTATCCAGTCCCTATTGTTCTTATCTCCCAACTTCCCTTC
TGTGGGCCCAACATCATTGACCACTTGGTGTGTGACCCAGGCCCATTGTTTGCACTGGCCTG
CATCTCTGCTCCTTCCACTGAGCTTATCTGTTACACCTTCAACTCGATGATTATCTTTGGGC
CCTTCCTCTCCATCTTGGGATCTTACACTCTGGTCATCAGAGCTGTGCTTTGTATTCCCTCT
GGTGCTGGTCGAACTAAAGCTTTCTCCACATGTGGGTCCCACCTAATGGTGGTGTCTCTATT
CTATGGAACCCTTATGGTGATGTATGTGAGCCCAACATCAGGGAACCCAGCAGGAATGCAGA
AGATCATCACTCTGGTATACACAGCAATGACTCCATTCTTAAATCCCCTTATCTATAGTCTT
CGAAACAAAGACATGAAAGATGCTCTAAAGAGAGTCCTGGGGTTAACAGTTAGCCAAAACTG
A HsOR14.1.27 (hOR11H6) amino acid sequence (SEQ ID NO:35)

MFFIIHSLVTSVFLTALGPQNRTMHFVTEFVLLGFHGQREMQSCFFSFILVLYLLTLLGNGA
IVCAVKLDRRLHTPMYILLGNFAFLEIWYISSTVPNMLVNILSEIKTISFSGCFLQFYFFFS
LGTTECFFLSVMAYDRYLAICRPLHYPSIMTGKFCIILVCVCWVGGFLCYPVPIVLISQLPF
CGPNIIDHLVCDPGPLFALACISAPSTELICYTFNSMIIFGPFLSILGSYTLVIRAVLCIPS
GAGRTKAFSTCGSHLMVVSLFYGTLMVMYVSPTSGNPAGMQKIITLVYTAMTPFLNPLIYSL
RNKDMKDALKRVLGLTVSQN*

FIG. 1 Continued

HsOR11.13.7 (hOR4D6) nucleotide sequence (SEQ ID NO:6)

ATGGACCAGATCAACCACACTAATGTGAAGGAGTTTTTCTTCCTGGAACTTACACGTTCCCGAGAGCT
GGAGTTTTTCTTGTTTGTGGTCTTCTTTGCTGTGTATGTAGCAACAGTCCTGGGAAATGCACTCATTG
TGGTCACTATTACCTGTGAGTCCCGCCTACACACTCCTATGTACTTTCTCCTGCGGAACAAATCAGTC
CTGGACATCGTTTTTTCATCTATCACCGTCCCCAAGTTCCTGGTGGATCTTTTATCAGACAGGAAAAC
CATCTCCTACAATGGCTGCATGGCACAGATCTTTTTCTTCCACTTTGCTGGTGGGGCAGATATTTTTT
TCCTCTCTGTGATGGCCTATGACAGATACCTTGCAATCGCCAAGCCCCTGCACTATGTGACCATGATG
AGGAAAGAGGTGTGGGTGGCCTTGGTGGTGGCTTCTTGGGTGAGTGGTGGTTTGCATTCAATCATCCA
GGTAATTCTGATGCTTCCATTCCCCTTCTGTGGCCCCAACACACTGGATGCCTTCTACTGTTATGTGC
TCCAGGTGGTAAAACTGGCCTGCACTGACACCTTTGCTTTGGAGCTTTTCATGATCTCTAACAACGGA
CTGGTGACCCTGCTCTGGTTCCTCCTGCTCCTGGGCTCCTACACTGTCATTCTGGTGATGCTGAGATC
CCACTCTGGGGAGGGGCGGAACAAGGCCCTCTCCACGTGCACGTCCCACATGCTGGTGGTGACTCTTC
ACTTCGTGCCTTGTGTTTACATCTACTGCCGGCCCTTCATGACGCTGCCCATGGACACAACCATATCC
ATTAATAACACGGTCATTACCCCCATGCTGAACCCCATCATCTATTCCCTGAGAAATCAAGAGATGAA
GTCAGCCATGCAGAGGCTGCAGAGGAGACTTGGGCCTTCCGAGAGCAGAAAATGGGGG

HsOR11.13.7 (hOR4D6) amino acid sequence (SEQ ID NO:36)

MDQINHTNVKEFFFLELTRSRELEFFLFVVFFAVYVATVLGNALIVVTITCESRLHTPMYFLLRNKSV
LDIVFSSITVPKFLVDLLSDRKTISYNGCMAQIFFFHFAGGADIFFLSVMAYDRYLAIAKPLHYVTMM
RKEVWVALVVASWVSGGLHSIIQVILMLPFPFCGPNTLDAFYCYVLQVVKLACTDTFALELFMISNNG
LVTLLWFLLLLGSYTVILVMLRSHSGEGRNKALSTCTSHMLVVTLHFVPCVYIYCRPFMTLPMDTTIS
INNTVITPMLNPIIYSLRNQEMKSAMQRLQRRLGPSESRKWG*

FIG. 1 Continued

HsOR14.2.5 (hOR4E2) nucleotide sequence (SEQ ID NO:7)

atggacagtctaaaccaaacaagagtgactgaatttgtcttcttgggactcactgataaccgggtgct
Ggaaatgctgttttcatggcattctcagccatttatatgctaacgctttcagggaacattctcatca
Tcattgccacagtctttactccaagtctccatacccccatgtatttcttcctgagcaatctgtccttt
Attgacatctgccactcatctgtcactgtgcctaagatgttggagggtttgcttttagaaagaaagac
Catttcctttgacaactgcatcacacagctcttcttcctacatctctttgcctgtgccgagatctttc
Tgctgatcattatggcgtatgatcgttacgtggctatctgcactccactccactaccccaatgtgatg
Aacatgagagtctgtatacagcttgtctttgctctctggttgggggggtactgttcactcactagggca
Gaccttcttgactattcgtctaccttactgtggccccaacattattgacagctacttctgtgatgtgc
Ctcttgttatcaagctggcctgcacagatacatacctcacaggaatactgattgtgaccaatagtgga
Accatctccctcctgtttcttggccgtggtcacctcctatatggtcatcctggtttctcttcgaaa
Acactcagctgaagggcgccgtaaagccctgtctacctgctcggcccacttcatggtggttgccctct
Tctttgggccatgtatcttcatctatactcggccagacaccagcttctccattgacaaggtggtgtct
Gtcttctacacagtggtcaccccttcgctgaatcccttcatttacaccttgaggaatgaggaggtaaa
aagtgccatgaagcagctcaggcagagacaagttttttttcacgaaatcatataca HsOR14.2.5 (hOR4E2) amino acid sequence (SEQ ID NO:37)

MDSLNQTRVTEFVFLGLTDNRVLEMLFFMAFSAIYMLTLSGNILIIIATVFTPSLHTPMYFFLSNLSF
IDICHSSVTVPKMLEGLLLERKTISFDNCITQLFFLHLFACAEIFLLIIMAYDRYVAICTPLHYPNVM
NMRVCIQLVFALWLGGTVHSLGQTFLTIRLPYCGPNIIDSYFCDVPLVIKLACTDTYLTGILIVTNSG
TISLSCFLAVVTSYMVILVSLRKHSAEGRRKALSTCSAHFMVVALFFGPCIFIYTRPDTSFSIDKVVS
VFYTVVTPLLNPFIYTLRNEEVKSAMKQLRQRQVFFTKSYT*

FIG. 1 Continued

HsOR16.1.3 (hOR2C1) nucleotide sequence (SEQ ID NO:8)

ATGGACGGGGTGAATGATAGCTCCTTGCAGGGCTTTGTTCTGATGGGCATATCAGACCATCCCCAGCT
GGAGATGATCTTTTTTATAGCCATCCTCTTCTCCTATTTGCTGACCCTACTTGGGAACTCAACCATCA
TCTTGCTTTCCCGCCTGGAGGCCCGGCTCCATACACCCATGTACTTCTTCCTCAGCAACCTCTCCTCC
TTGGACCTTGCTTTCGCTACTAGTTCAGTCCCCCAAATGCTGATCAATTTATGGGGACCAGGCAAGAC
CATCAGCTATGGTGGCTGCATAACCCAGCTCTATGTCTTCCTTTGGCTGGGGGCCACCGAGTGCATCC
TGCTGGTGGTGATGGCATTTGACCGCTACGTGGCAGTGTGCCGGCCCCTCCGCTACACCGCCATCATG
AACCCCCAGCTCTGCTGGCTGCTGGCTGTGATTGCCTGGCTGGGTGGCTTGGGCAACTCTGTGATCCA
GTCAACATTCACTCTGCAGCTCCCATTGTGTGGGCACCGGAGGGTGGAGGGATTCCTCTGCGAGGTGC
CTGCCATGATCAAACTGGCCTGTGGCGACACAAGTCTCAACCAGGCTGTGCTCAATGGTGTCTGCACC
TTCTTCACTGCAGTCCCACTAAGCATCATCGTGATCTCCTACTGCCTCATTGCTCAGGCAGTGCTGAA
AATCCGCTCTGCAGAGGGGAGGCGAAAGGCGTTCAATACGTGCCTCTCCCATCTGCTGGTGGTGTTCC
TCTTCTATGGCTCAGCCAGCTATGGGTATCTGCTTCCGGCCAAGAACAGCAAACAGGACCAGGGCAAG
TTCATTTCCCTGTTCTACTCGTTGGTCACACCCATGGTGAATCCCCTCATCTACACGCTGCGGAACAT
GGAAGTGAAGGGCGCACTGAGGAGGTTGCTGGGGAAAGGAAGAGAAGTTGGCTGA

HsOR16.1.3 (hOR2C1) amino acid sequence (SEQ ID NO:38)

MDGVNDSSLQGFVLMGISDHPQLEMIFFIAILFSYLLTLLGNSTIILLSRLEARLHTPMYFFLSNLSS
LDLAFATSSVPQMLINLWGPGKTISYGGCITQLYVFLWLGATECILLVVMAFDRYVAVCRPLRYTAIM
NPQLCWLLAVIAWLGGLGNSVIQSTFTLQLPLCGHRRVEGFLCEVPAMIKLACGDTSLNQAVLNGVCT
FFTAVPLSIIVISYCLIAQAVLKIRSAEGRRKAFNTCLSHLLVVFLFYGSASYGYLLPAKNSKQDQGK
FISLFYSLVTPMVNPLIYTLRNMEVKGALRRLLGKGREVG*

FIG. 1 Continued

HsOR11.13.6 (hOR5A1) nucleotide sequence (SEQ ID NO:9)

ATGTCCATAACCAAAGCCTGGAACAGCTCATCAGTGACCATGTTCATCCTCCTGGGATTCACAGACCA
TCCAGAACTCCAGGCCCTCCTCTTTGTGACCTTCCTGGGCATCTATCTTACCACCCTGGCCTGGAACC
TGGCCCTCATTTTTCTGATCAGAGGTGACACCCATCTGCACACACCCATGTACTTCTTCCTAAGCAAC
TTATCTTTCATTGACATCTGCTACTCTTCTGCTGTGGCTCCCAATATGCTCACTGACTTCTTCTGGGA
GCAGAAGACCATATCATTTGTGGGCTGTGCTGCTCAGTTTTTTTTCTTTGTCGGCATGGGTCTGTCTG
AGTGCCTCCTCCTGACTGCTATGGCATACGACCGATATGCAGCCATCTCCAGCCCCCTTCTCTACCCC
ACTATCATGACCCAGGGCCTCTGTACACGCATGGTGGTTGGGGCATATGTTGGTGGCTTCCTGAGCTC
CCTGATCCAGGCCAGCTCCATATTTAGGCTTCACTTTTGCGGACCCAACATCATCAACCACTTCTTCT
GCGACCTCCCACCAGTCCTGGCTCTGTCTTGCTCTGACACCTTCCTCAGTCAAGTGGTGAATTTCCTC
GTGGTGGTCACTGTCGGAGGAACATCGTTCCTCCAACTCCTTATCTCCTATGGTTACATAGTGTCTGC
GGTCCTGAAGATCCCTTCAGCAGAGGGCCGATGGAAAGCCTGCAACACGTGTGCCTCGCATCTGATGG
TGGTGACTCTGCTGTTTGGACAGCCCTTTTCGTGTACTTGCGACCCAGCTCCAGCTACTTGCTAGGC
AGGGACAAGGTGGTGTCTGTTTTCTATTCATTGGTGATCCCCATGCTGAACCCTCTCATTTACAGTTT
GAGGAACAAAGAGATCAAGGATGCCCTGTGGAAGGTGTTGGAAAGGAAGAAAGTGTTTTCTTAG

HsOR11.13.6 (hOR5A1) amino acid sequence (SEQ ID NO:39)

MSITKAWNSSSVTMFILLGFTDHPELQALLFVTFLGIYLTTLAWNLALIFLIRGDTHLHTPMYFFLSN
LSFIDICYSSAVAPNMLTDFFWEQKTISFVGCAAQFFFFVGMGLSECLLLTAMAYDRYAAISSPLLYP
TIMTQGLCTRMVVGAYVGGFLSSLIQASSIFRLHFCGPNIINHFFCDLPPVLALSCSDTFLSQVVNFL
VVVTVGGTSFLQLLISYGYIVSAVLKIPSAEGRWKACNTCASHLMVVTLLFGTALFVYLRPSSSYLLG
RDKVVSVFYSLVIPMLNPLIYSLRNKEIKDALWKVLERKKVFS*

FIG. 1 Continued

HsOR11.18.36 (hOR8B8) nucleotide sequence (SEQ ID NO:10)

ATGGCTGCTGAGAATTCCTCCTTCGTGACACAGTTTATCCTCGCAGGCTTAACTGACCAACC
GGGAGTCCAGATCCCCCTCTTCTTCCTGTTTCTAGGCTTCTACGTGGTCACTGTGGTGGGGA
ACCTGGGCTTGATAACCCTGATAAGGCTCAACTCTCACTTGCACACCCCTATGTACTTCTTC
CTCTATAACTTGTCCTTCATAGATTTCTGCTATTCCAGTGTTATCACTCCCAAAATGCTGAT
GAGCTTTGTCTTAAAGAAGAACAGCATCTCCTACGCAGGGTGTATGACTCAGCTCTTCTTCT
TTCTTTTCTTTGTTGTCTCTGAGTCCTTCATCCTGTCAGCAATGGCGTATGACCGCTATGTG
GCCATCTGTAACCCACTGTTGTACATGGTCACCATGTCTCCCCAGGTGTGTTTTCTCCTTTT
GTTGGGTGTCTATGGGATGGGGTTTGCTGGGGCCATGGCCCACACAGCGTGCATGATGGGTG
TGACCTTCTGTGCCAATAACCTTGTCAACCACTACATGTGTGACATCCTTCCCCTTCTTGAG
TGTGCTTGCACCAGCACCTATGTGAATGAGCTTGTAGTGTTTGTTGTTGTGGGCATTGATAT
TGGTGTGCCCACAGTCACCATCTTCATTTCCTATGCTCTCATTCTCTCCAGCATCTTCCACA
TTGATTCCACGGAGGGCAGGTCCAAAGCCTTCAGCACCTGCAGCTCCCACATAATTGCAGTT
TCTCTGTTCTTTGGGTCAGGAGCATTCATGTACCTCAAACCCTTTTCTCTTTTAGCTATGAA
CCAGGGCAAGGTGTCTTCCCTATTCTATACCACTGTGGTGCCCATGCTCAACCCATTAATTT
ATAGCCTGAGGAATAAGGACGTCAAAGTTGCTCTAAAGAAAATCTTGAACAAAAATGCATTC
TCCTGA

HsOR11.18.36 (hOR8B8) amino acid sequence (SEQ ID NO:40)

MAAENSSFVTQFILAGLTDQPGVQIPLFFLFLGFYVVTVVGNLGLITLIRLNSHLHTPMYFFLYNLSF
IDFCYSSVITPKMLMSFVLKKNSISYAGCMTQLFFFLFFVVSESFILSAMAYDRYVAICNPLLYMVTM
SPQVCFLLLLGVYGMGFAGAMAHTACMMGVTFCANNLVNHYMCDILPLLECACTSTYVNELVVFVVG
IDIGVPTVTIFISYALILSSIFHIDSTEGRSKAFSTCSSHIIAVSLFFGSGAFMYLKPFSLLAMNQGK
VSSLFYTTVVPMLNPLIYSLRNKDVKVALKKILNKNAFS*

FIG. 1 Continued

CafaOR9.2.9 nucleotide sequence (SEQ ID NO:11)

ATGCAGTCAAAATTTGGGGCCAATAGCACAGCCATTACTGAGTTCATCCTGCTGGGCTTGGTGGACAC
ACCAGGGCTACAACCAGTTGTCTTTGTAGTCTTCCTCTTTGCCTACCTGGTCACAGTCGGAGGCAACC
TCAGCATCCTGGCTGCCATCTTGGTGGAACCCAAACTCCACACGCCCATGTACTTCTTCCTGGGGAAC
CTGTCAGTGCTGGATGTTGGGTGCATCACTGTCACTGTTCCCTCAATGTTGGCTCGCCTCTTGTCCCA
CAAACGTACAGTTCCCTACAGAGCCTGCCTCACACAACTCTTCTTCTTCCATCTCTTGGTTGGGGTGG
ACTGCTTCCTGTTGACAGCCATGGCCTATGACCGATTCCTGGCCATCTGCCGGCCCCTCACCTACAGC
ACCCAGATGAGCCAGACAGTCCAGAGAATATTGGTAGTTGTGTCCTGGGCTTTAGCCTTCACCAATGC
ACTGACCCACACAGTAGCCATAGCCACACTCAACTTTTGTGGTCCTAATGTGATCAACCACTTCTACT
GCGACCTCCCACAGCTCTTCCAGCTCTCCTGCTCCAGCACTCAGCTCAATGAGCTGCTGCTCTTTGCT
GTGGGTTTCATAATGGCAGGTACCCCCTTGGCTCTCATCATCACTTCCTATGCACATGTGGCAGCTGC
AGTCCTAAGAATCCGCTCTGCTGAGGGCAGGAAGAAAGCTTTCTCTACATGTGGCTCTCATCTCACTG
TGGTAGCCATATTCTATGGTTCAGGTATATTTAATTACATGCGACTGGGTACAGCCAAGCATTCAGAC
AAGGATAAAGGGGTTGGGGTCTTCAACACTGTCATCAACCCCATGCTGAATCCAATCATTTACAGCCT
CAGGAACCTTGATGTACAGGGTGCCCTCTGGCGGGTGCTCAGGGGAAGGCAGTCACTGGCTTGA

CafaOR9.2.9 amino acid sequence (SEQ ID NO:41)

MQSKFGANSTAITEFILLGLVDTPGLQPVVFVVFLFAYLVTVGGNLSILAAILVEPKLHTPMYFFLGN
LSVLDVGCITVTVPSMLARLLSHKRTVPYRACLTQLFFFHLLVGVDCFLLTAMAYDRFLAICRPLTYS
TQMSQTVQRILVVVSWALAFTNALTHTVAIATLNFCGPNVINHFYCDLPQLFQLSCSSTQLNELLLFA
VGFIMAGTPLALIITSYAHVAAAVLRIRSAEGRKKAFSTCGSHLTVVAIFYGSGIFNYMRLGTAKHSD
KDKGVGVFNTVINPMLNPIIYSLRNLDVQGALWRVLRGRQSLA*

FIG. 1 Continued

CafaOR38.1.21 nucleotide sequence (SEQ ID NO:12)

ATGATGGGAAATTTGAGTGGAGGCCACATAGCAGATTTTATTTTGGTGGGCTTCCCAACCTCTCCACC
CCTCCAGTTACTTCTCTTTGTCCTCTTCTTTGCAATTTACCTGTTGACACTGTTGGAGAATGCACTCA
TCGTTTCCACAATCTGGCTCACTCCAAGCCTTCACCGCCCGATGTACTTTTTCCTTGGCCATCTGTCC
TTCCTGGAGCTGTGGTACATCAATGTCACAGTTCCTCGTCTTTTGGGAGCATTTCTTACCCAGGACCG
TAGAGTCTCCTATGTAGGCTGCATGACCCAGCTCTACTTCTTCATTGCCCTAGCCTGCACCGAATGTG
TCCTGCTGGCAGTCATGGCCTATGACCGCTACCTGGCCATCTGTGAGCCCCTCCGTTATCCTAGTCTC
ATGCCGTCCAGCCTGGCCATTCGCCTTGCTGCTTCCTCTTGGGGTGGTGGCTTCTTCAGCTCCATGAT
GAAGCTTCTTTTCATTTCCCGACTGTCCTACTGTGGGCCCAACATCATCAACCATTTTTTCTGTGATA
TCTCCCCACTACTCAACCTTACCTGCTCTGACAAGGAGCAAGCAGAACTAGTAGACTTCCTGTTGGCC
CTGGTGATGATCCTGCTTCCTCTACTGGCTGTGGTTTCATCATATGCTGCCATCATTGCCACCATCCT
GAGGATCCCTACTGCCCAGGGACGTCGCAAAGCCTTTTCCACCTGTGCCTCTCACCTGGCAGTGGTTG
TCATCTACTACTCCTCCACCCTCTTCACCTATGCAAGGCCCCGGGCCATGTACACCTTCAACCACAAC
AAGATCATCTCTGTGCTCTATACGGTCATTGTACCATTCCTCAATCCAGCCATCTACTGCCTGAGGAA
CAAGGAGGTGAAGGATGCTCTCAGGAAGTTGGTTCTGGGCAGATGCCACTATCCTAGTGATGTCCCAG
ACTGA

CafaOR38.1.21 amino acid sequence (SEQ ID NO:42)

MMGNLSGGHIADFILVGFPTSPPLQLLLFVLFFAIYLLTLLENALIVSTIWLTPSLHRPMYFFLGHLS
FLELWYINVTVPRLLGAFLTQDRRVSYVGCMTQLYFFIALACTECVLLAVMAYDRYLAICEPLRYPSL
MPSSLAIRLAASSWGGGFFSSMMKLLFISRLSYCGPNIINHFFCDISPLLNLTCSDKEQAELVDFLLA
LVMILLPLLAVVSSYAAIIATILRIPTAQGRRKAFSTCASHLAVVVIYYSSTLFTYARPRAMYTFNHN
KIISVLYTVIVPFLNPAIYCLRNKEVKDALRKLVLGRCHYPSDVPD*

FIG. 1 Continued

CafaOR21.2.15 nucleotide sequence (SEQ ID NO:13)

ATGGTGGACCCCAATGGCAATGAATCCAGTGCCACATATTTTATTTTAATAGGCCTCCCAGGCTTGGA
AGAAGCTCAGTTCTGGTTGGCCTTCCCCTTGTGCTCCCTCTACTTTATTGCTGTATTGGGTAACCTGA
CAATCATCTACATTGTGCGGACTGAGCACAGCCTACATGAACCCATGTATGTTTTCTTTGCATGCTT
TCTGGCCTTGACATCCTTATCTCCACCTCATCTATGCCCAAAATGATGGCCATCTTCTGGTTCAATTC
CACTACCATCCAGTTTGATGCTTGTCTACTACAGATGTTTGCCATCCATTCTTTATCTGGCATGGAGT
CCACAGTACTGCTGGCCATGGCCTTTGACCGCTATGTGGCCATTTGCCACCCACTACGCCATGCCACT
GTACTAACATTGCCTCGTGTTATGAAGATTGGCATGGCTGCTGTGGTACGGGGTACTGCACTTATGGC
ACCCCTGCCTGTTTTTATCAAACGACTGCCTTTCTGCCACTCCAACATTCTTTCCCATTCCTACTGCC
TACACCAAGATGTCATGAAGCTGGCTTGTGCTGACATCCGTGTCAATATCATCTATGGCCTCATTGTC
ATCATCTCTGCCATTGGCCTGGACTCACTTCTCATCTCCTTGTCATATCTACTTATCCTCAAGACTGT
GTTGGGCTTGACACGTGAAGCCCAGGCAAAGGCATTTGGCACTTGTGTCTCTCATGTATGTGCTGTTT
TCATATTCTATGTACCTTTCATTGGATTATCTATGGTGCACCGCTTTGGCAAGAGACATGACTCCTTC
CTGCCCATCATTATGGCCAACACCTACCTACTTGTACCTCCTGTGCTCAACCCCATTGTTTATGGAGT
CAAGACAAAGGAGATCTGGCAGCGTATCCTTCGTCTTTTCCATGTGACCAACCATACTTCAGATCTCT
AG

CafaOR21.2.15 amino acid sequence (SEQ ID NO:43)

MVDPNGNESSATYFILIGLPGLEEAQFWLAFPLCSLYFIAVLGNLTIIYIVRTEHSLHEPMYVFLCML
SGLDILISTSSMPKMMAIFWFNSTTIQFDACLLQMFAIHSLSGMESTVLLAMAFDRYVAICHPLRHAT
VLTLPRVMKIGMAAVVRGTALMAPLPVFIKRLPFCHSNILSHSYCLHQDVMKLACADIRVNIIYGLIV
IISAIGLDSLLISLSYLLILKTVLGLTREAQAKAFGTCVSHVCAVFIFYVPFIGLSMVHRFGKRHDSF
LPIIMANTYLLVPPVLNPIVYGVKTKEIWQRILRLFHVTNHTSDL*

FIG. 1 Continued

CafaOR21.2.43 nucleotide sequence (SEQ ID NO:14)

ATGCCAAGGGTCACCATGGTGGTCTGGAATAACAATAACACTCTGGAGCCCATATTTATTCTGAAGGG
ATTTCCTGGGTTGGAGTGTGTTCATTCTTGGTTCTCAATCCCTTTCTGTCTTGCGTACTTGGTAGCAT
TTATTGGTAATGTCACCATCCTCTCTGTCATCTGGATAGAGTCCTCACTCCACCAGCCCATGTATTAC
TTTCTTTCCATCTTGGCACTGACTGACCTAGGCATGTCCATGTCCACACTTCCCACCATGCTTGCTGT
GTTATGGCTGGATGCTAGAGAGATCCAGGCAAGTGCTTGCTATGCTCAGCTCTTCTTCATCCACACAT
TCACATTCCTGGAGTCTTCGGTGCTATTGGCCATGGCCTTCGATCGTTTTGTTGCTATCTGCCGTCCA
CTGCACTACACCACCATCCTTAACAACAGTGTAATAGGCAAGATTGGCTTGGCCTGCTTGCTAAGAAG
CATGGGAGTTGTACTTCCTACACCTTTGCTACTGAGACATTATCACTACTGCCATGTCAATGCCCTTT
CCCATGCCTTCTGTTTGCACCAAGACGTTCTCAAATTGTCCTGTTCAGATGCCAGGATCAGCAGTGTC
TATGGACTGTGTGTAGTCATCACTACACTGGGCATGGATTCAGTCTTCATACTTCTTTCTTATGTCCT
GATTTTGAATGCTGTGCTGGGCATAGCATCTCATGAAGAGCGGCTAAAGGCACTCAACACATGTGTGT
CCCATATCTGCGTGGTGCTCATTTTCTTTGTGCCAGTTATTGGGGTGTCAATGGTCCATCGCTTTGGG
AAACATCTGTCTCCCATAGTTCACATCATCATGGCTGATATTTACTTGCTTTTCCCCCCAGTACTTAA
CCCTATTGTCTATAGTGTCAGGACAAAGCAGATTCGTATAAGAATTTTCCACAAGTTAAGACTAGGGA
GGAGGCTTTAA

CafaOR21.2.43 amino acid sequence (SEQ ID NO:44)

MPRVTMVVWNNNNTLEPIFILKGFPGLECVHSWFSIPFCLAYLVAFIGNVTILSVIWIESSLHQPMYY
FLSILALTDLGMSMSTLPTMLAVLWLDAREIQASACYAQLFFIHTFTFLESSVLLAMAFDRFVAICRP
LHYTTILNNSVIGKIGLACLLRSMGVVLPTPLLLRHYHYCHVNALSHAFCLHQDVLKLSCSDARISSV
YGLCVVITTLGMDSVFILLSYVLILNAVLGIASHEERLKALNTCVSHICVVLIFFVPVIGVSMVHRFG
KHLSPIVHIIMADIYLLFPPVLNPIVYSVRTKQIRIRIFHKLRLGRRL*

FIG. 1 Continued

CafaOR15.2.20 nucleotide sequence (SEQ ID NO:15)

ATGCTCATCATTATTCACTCATTGGTTATCTCTGCTTCTCTAACAGCTTTGGAATCCCAGAACACAAC
AATGCGTTTTGTGTCTGAGTTTGTCCTCCTGGGTTTCCCTGGTCAAAGGGAGATGCAGAACTTTTTCT
TCTCATTCATCCTGGTGATCTATCTCCTCACCCTGCTGGGGAATGGGATTATTGTCTGCATAGTGAAA
TGGGACAAGCAGCTTCACACACCCATGTACATCTTCTTGGGAAACTTTGCCTTCCTAGAGATCTGGTA
CACCTCCTCCACTGTCCCAAGTATGCTGGTCAACATCCTTTCCGAGACCAAGACCATCTCCTTCACTG
GGTGCTTCCTTCAATTCTACTTCTTTTTCTCACTGGGTACAACAGAGTGTTTCTTCTTATCAGTCATG
GCTTATGATCGGTACCTCGCCATCTGTCGCCCACTCCATTACCCCTCCATCATGACTGGGAAGCTCTG
TGTGGCCCTGGTCTGTGTTTGCTGGGTGAGTGGATTTCTCTGCTATCCAGTCCCCATTGTCCTCATCT
CCCAACTTCCATTCTGTGGACCCAACATCATTGATCACTTTGTGTGTGACCCAGGCCCACTGTTCGCA
CTGGCCTGCATCCCTGCTCCTTCCACTGAGCTTCTCTGTTACACCTTCAATTCACTGATTATCTTCGG
GCCCTTCCTCTTCATCCTGGGATCTTACACCCTGGTTCTCAGAGCTGTGCTTCGCATTCCTTCTGGTG
CAGGTCGAACTAAAGCATTCTCCACGTGTGGGTCCCATCTAATGGTGGTGTCTCTATTCTATGGAACC
CTTATGGTGATGTATGTGAGCCCGACATCAGGGAATCCGACGGGAATGCAAAAGATCATCACTCTGGT
ATACTCGGCAGTGACTCCACTCTTAAACCCCCTTATCTATAGTCTCCGAAACAAAGACATGAAAGATG
CCCTAAAGAAAGTCCTAGGATTAAGAAGTAACCAAAACTGA

CafaOR15.2.20 amino acid sequence (SEQ ID NO:45)

MLIIIHSLVISASLTALESQNTTMRFVSEFVLLGFPGQREMQNFFFSFILVIYLLTLLGNGIIVCIVK
WDKQLHTPMYIFLGNFAFLEIWYTSSTVPSMLVNILSETKTISFTGCFLQFYFFFSLGTTECFFLSVM
AYDRYLAICRPLHYPSIMTGKLCVALVCVCWVSGFLCYPVPIVLISQLPFCGPNIIDHFVCDPGPLFA
LACIPAPSTELLCYTFNSLIIFGPFLFILGSYTLVLRAVLRIPSGAGRTKAFSTCGSHLMVVSLFYGT
LMVMYVSPTSGNPTGMQKIITLVYSAVTPLLNPLIYSLRNKDMKDALKKVLGLRSNQN*

FIG. 1 Continued

CafaOR18.3.11 nucleotide sequence (SEQ ID NO:16)

ATGGGCCAGAGCAACCACACCAATGTGAAGGAATTTGTCTTTCTGAAACTCACTCACTTCCACGAGCT
AGAATTGTTCTTGTTTGTGGTCTTCCTTGCTGTATATGTAGCAACTGTGCTGGGCAATGTCCTCATTG
TGGTGACCATCACCTGTGAGTCCCACCTCCACTCTCCCATGTACTTTCTGCTGCGGAACAAATCAGTC
CTGGACATTGTCTTTTCATCTGTCACTGTTCCCAAGTTCCTGGTGGATCTGTTATCAGAGAGAAAAAC
CATCTCCTACAATGGCTGCATGGCACAGATCTTCTTCTTCCACTTCGCTGGTGGGGCAGACATTTTCT
TCCTCTCTGTGATGGCCTATGACAGGTACCTTGCAATCGCCAAACCCCTGCATTATGTGACCATTATG
AGGAGAGAGACGTGGGTGGGCTTGGTGGTGGCTTCCTGGGTGGGTGGTGGTTTGCACTCAATTGTCCA
GGTAACTCTCATGCTTCCACTCCCTTTCTGTGGCCCCAACATCCTGGATGCCTTCTACTGTGATGTGC
CCCAAGTGATTAAGCTGGCCTGTACCAACACCTTTGCCCTGGAGCTTCTCATGATCTCTAACAATGGG
CTGGTGACCCTGCTGTGGTTCCTCCTGCTCCTGGGCTCCTACACTGTCATTCTGGTGATGCTGAGATC
TCACTCTGGGGAGGGGCGGAATAAGGCCCTGTCCACCTGCACTTCCCATATCTTCGTGGTGACCCTGC
ACTTCGTGCCTTGCGTCTACATCTACTGCCGGCCCTTCATCACGCTGCCCATGGACACAGTTGTATCC
ATCAATAACACAGTCATTACCCCCATGCTGAACCCCATGATCTATACACTGAGGAACCAGGAGATGAA
GTCAGCCATGAAAAGACTGCAGAGAAGGCTTGGACCTTCTGAGAGCAGTTAG

CafaOR18.3.11 amino acid sequence (SEQ ID NO:46)

MGQSNHTNVKEFVFLKLTHFHELELFLFVVFLAVYVATVLGNVLIVVTITCESHLHSPMYFLLRNKSV
LDIVFSSVTVPKFLVDLLSERKTISYNGCMAQIFFFHFAGGADIFFLSVMAYDRYLAIAKPLHYVTIM
RRETWVGLVVASWVGGGLHSIVQVTLMLPLPFCGPNILDAFYCDVPQVIKLACTNTFALELLMISNNG
LVTLLWFLLLLGSYTVILVMLRSHSGEGRNKALSTCTSHIFVVTLHFVPCVYIYCRPFITLPMDTVVS
INNTVITPMLNPMIYTLRNQEMKSAMKRLQRRLGPSESS*

FIG. 1 Continued

CafaOR15.3.1 nucleotide sequence (SEQ ID NO:17)

ATGGAGGCTCCGAATCAAACAAGAGTGACTGAGTTTGTCTTCTTGGGGCTCACAGATAACTGGGCGCT
GGGGACGCTACTTTTTGTGGCATTCTCCCTGGCTTATGTGCTCACCCTTCTGGGGAACACTCTCATCA
TAGTGACCACGGCCCTTACCCGGCGCCTCCATACCCCCATGTACTTCTTCCTGAGCAACCTGTCCTTC
ATTGACACCTGCCACTCCTCGGTCACTGTGCCCAAGATGCTGGAGGGCCTGCTTAGGGAGAGAAAGAC
TATTTCCTTTGATGACTGCATTGCGCAGCTCTTCTTCCTACACCTGTTCGCTTGTGCTGAGATCCTTC
TGCTGACCGTCATGGCTTACGACCGCTACGTGGCCATCTGTGCCCCGCTGCGCTACCCCAACGTGATG
AGCATCCGGGTGTGTGTGCAGCTCGTCCTCGCCCTCTGGTGGGGGGGTACCGTTCACTCTCTGGTGCA
GACCCTCCTGACCATTCGTTTGCCCTACTGCGGCCCCAACGTTATCGATAGCTACTTCTGCGATGTGC
CCCCCGTCATCAAGCTGGCCTGCACGGACACCTACCTCACGGGAGTGCTCATTGTCTCCAACAGTGGA
ACCATCTCCCTCACCTGTTTCCTGGCTTTGGTCACCTCTTACACAATCATCCTGGTGTCTCTTAGAAA
ACAGTCTGCTGAAGGGCGCCGGAAAGCTCTGTCTACGTGCTCAGCCCACTTCATGGTGGTCGCCTTCT
TCTTTGGACCATGCATCTTCATCTACACTCGGCCAGACACCAGCTTCTCCATCGACAAGGTGGTATCT
GTCTTCTACACCGTGGTCACCCCTTTGCTAAATCCCCTCATTTACACCTTGAGGAATGAGGAGGTAAA
AAGTGCCATAAAGCATCTCAGACAGAAACAGGTTTTCTCATAA

CafaOR15.3.1 amino acid sequence (SEQ ID NO:47)

MEAPNQTRVTEFVFLGLTDNWALGTLLFVAFSLAYVLTLLGNTLIIVTTALTRRLHTPMYFFLSNLSF
IDTCHSSVTVPKMLEGLLRERKTISFDDCIAQLFFLHLFACAEILLLTVMAYDRYVAICAPLRYPNVM
SIRVCVQLVLALWWGGTVHSLVQTLLTIRLPYCGPNVIDSYFCDVPPVIKLACTDTYLTGVLIVSNSG
TISLTCFLALVTSYTIILVSLRKQSAEGRRKALSTCSAHFMVVAFFFGPCIFIYTRPDTSFSIDKVVS
VFYTVVTPLLNPLIYTLRNEEVKSAIKHLRQKQVFS*

FIG. 1 Continued

CafaOR6.3.1 nucleotide sequence (SEQ ID NO:18)

ATGCCAGAGGCCAACGACAGCTTCCTGGAGGGCTTCATTCTGATGGGTATATCTGACCATCCCCAGCT
GGAGATAATCTTTTTCATGGTCATTCTCTTCTCTTACTTACTGACTCTGCTTGGGAACTCAACCATTA
TCCTGCTTTCCTGGCTGGATGCCCGGCTCCATACTCCCATGTACTTCTTCCTCAGCAACCTCTCCACC
CTGGACCTTGCTTTTACTACTAGCTCAGTCCCCCAAATGCTGATCAACTTATGGGGACCAGATAAGAC
CATAAGCTATGGTGGCTGTGTGACCCAGCTCTATGTTTTCCTCTGGCTAGGGGCCACTGAGTGTATCC
TGCTTGTGGTGATGGCGTTTGACCGCTATGTGGCAGTTTGCCGGCCCCTGCACTACACCACCATCATG
AACCCTCGGCTCTGCTGGCTGCTGGCTGCCATTGCATGGCTGGGTGGCTTGAGCAACTCTGTGATCCA
GTCAACCTTCACTCTGCAGCTCCCCTTATGTGGGCACCGGAGGGTGGACAACTTCCTGTGTGAGGTAC
CTGCCATGATCAAACTGGCCTGTGGAGACACGAGTCTCAATGAGGTTGTGCTCAATGGTGTCTGCACC
TTCTTCACTGCTGTCCCACTAAGTGTCATCCTGATCTCCTACTGCTACATAGCTCAGGCAGTGCTGAA
GATCCACTCAGTAGAGGGACAGAGAAAGGCCTTTAATACGTGCCTCTCACATCTGGTGGTGGTGTTGC
TCTTCTATGGCTCAGCTATCTATGGGTATCTCCTTCCAGCTAAGACCAGCAACCAGGACCAGGGCAAA
TTCATTTCCCTCTTCTACTCTGTGGTCACACCAACGGTGAACCCTCTCATCTACACTCTGAGAAATAG
GGAAGTAAAGGGAGCACTAAGGAGGCTGCTAGGAAAGGGAAGATCACTTGGCTGA

CafaOR6.3.1 amino acid sequence (SEQ ID NO:48)

MPEANDSFLEGFILMGISDHPQLEIIFFMVILFSYLLTLLGNSTIILLSWLDARLHTPMYFFLSNLST
LDLAFTTSSVPQMLINLWGPDKTISYGGCVTQLYVFLWLGATECILLVVMAFDRYVAVCRPLHYTTIM
NPRLCWLLAAIAWLGGLSNSVIQSTFTLQLPLCGHRRVDNFLCEVPAMIKLACGDTSLNEVVLNGVCT
FFTAVPLSVILISYCYIAQAVLKIHSVEGQRKAFNTCLSHLVVVLLFYGSAIYGYLLPAKTSNQDQGK
FISLFYSVVTPTVNPLIYTLRNREVKGALRRLLGKGRSLG*

FIG. 1 Continued

CafaOR18.3.12 nucleotide sequence (SEQ ID NO:19)

ATGTCCACAGTTAAGGCCTGGAACAGCTCTTCAGTGACCATGTTCATCCTCCTGGGATTTGCAGACCA
TCCAGAACTGCAGACTCTTCTCTTTGTGACCTTCCTGAGTATCTATCTTGTGACACTGGCCTGGAACC
TGGCCCTCATCTTTCTGATCAGAAGTGACCCCATCTGCACACACCCATGTACTTCTTCCTCAGCAAC
TTGTCCTTCATTGACATCTGTTATTCTTCCACAGTGGCCCCCAAGATGCTCACTGATTTCTTCCAGGA
GCAAAAGACCATCTCGTTCTTGGGCTGTGCTGCTCAGTTTTTTTTCTTTGTCAGCATGGGTCTCACTG
AGTGCTTCCTTCTGACTGCCATGGCATATGATCGATACGCAGCCATCTCCAACCCCTTGCTCTACACT
GCCATCATGTCCCAGGGCCTCTGTACACGCATGGTGCTGGGGGCATATGTCGGTGGTTTCCTGAGCTC
CTTGATCCAGGCCATCTCTATATTTCAGCTCCACTTCTGTGGACCCAATATCATCAACCATTTCTTCT
GTGACCTTCCACCAGTCCTGGCACTTTCTTGCTCTGACACCTTCCCTAGTCAAGTGGTGAATTTTCTC
ATAGTGATCACTGTTGGGGGAACATCATTCCTCATCCTCCTCATCTCCTACAGTTACATAGGAGCTGC
TGTCTTGAAGATCCGCTCAGTGGAAGGCCGAAGGAAAGCCTTCAACACATGTGCCTCGCATCTGATGG
TGGTGACTCTTCTGTTTGGGACAGCTCTTTTCATGTACCTGCGGCCCAGCTCCAGCTACTCACTTGCC
AGGGACAAGGTGGTGTCTGTCTTCTATTCGCTGGTGATCCCCATGCTGAACCCTCTCATTTACAGTCT
AAGGAACAGAGATATCAAAGACGCCCTGTGGAAGGCATTGGAGAAGAAGAAAGTGTTTTTCCTAGATC
ATGATTGA

CafaOR18.3.12 amino acid sequence (SEQ ID NO:49)

MSTVKAWNSSSVTMFILLGFADHPELQTLLFVTFLSIYLVTLAWNLALIFLIRSDPHLHTPMYFFLSN
LSFIDICYSSTVAPKMLTDFFQEQKTISFLGCAAQFFFFVSMGLTECFLLTAMAYDRYAAISNPLLYT
AIMSQGLCTRMVLGAYVGGFLSSLIQAISIFQLHFCGPNIINHFFCDLPPVLALSCSDTFPSQVVNFL
IVITVGGTSFLILLISYSYIGAAVLKIRSVEGRRKAFNTCASHLMVVTLLFGTALFMYLRPSSSYSLA
RDKVVSVFYSLVIPMLNPLIYSLRNRDIKDALWKALEKKKVFFLDHD*

FIG. 1 Continued

CafaOR5.2.5 nucleotide sequence (SEQ ID NO:20)

ATGCCTTTAGTAAGAATGGCAGCTGAGAATTCCTCTGTGACAGAGTTTATCCTCTCAGGCTTAACCAA
CCAGCCAGGACTCCAGATTCCTCTCTTCTTCCTGTTTCTAGGTTTCTATGTGGTCACGGTGGTAGGGA
ACCTGGGCCTGATAACCCTGATTGGGCTGAATTCTCACCTGCACACCCCCATGTACTTTTTCCTCTTC
AACTTGTCCTTCATAGATTTCTGCTATTCCACTGTTATCACTCCCAAGATGCTGATGAATTTTGTCTT
GAGGAAGAACGTCATCTCCTACGCAGGGTGTATGACTCAGCTCTTCTTCTTTCTCTTCTTTGTTGTAT
CTGAGTCCTTCATCCTGTCAGCAATGGCATATGACCGCTATGCCGCCATCTGTAACCCACTGGTATAC
ACTGCCACCATGTCTCCTCAGGTCTGCTTCCTCCTTCTGTTGGGTGTCTATGTGATGGGGTTTGCTGG
AGCCATGGCCCACACAGTGTGCATGGTAAGACTGACCTTCTGTGCCAACAATCTGGTTGACCACTACA
TGTGCGACATCCTTCCCCTTCTTGAGCGTTCTTGCACCAGCACCTATGTCAATGAGCTGGTAGTTTTT
ATTGTTGTGGGCATTGATATTGGTGTGCCCACAGTTACCATCTTCATTTCTTATGCCCTCATCCTCTC
CAGCATTCTCCGTATTCATTCTACCAAGGGCAGGTCCAAAGCCTTCAGCACCTGCAGCTCCCACATAA
TTGCTGTTTCCCTCTTCTTTGGATCAGGGGCATTTATGTACCTCAAACCATCCTCTCTTTTACCTATG
AATCAGGGGAAAGTGTCCTCTTTGTTCTACACCATCGTTGTGCCCATGCTCAACCCACTAATCTACAG
CTTGAGGAATAAGGATGTCAAAATTGCTCTGAAGAAAACACTGAGCAAGAAACCATTCTCTTGA

CafaOR5.2.5 amino acid sequence (SEQ ID NO:50)

MPLVRMAAENSSVTEFILSGLTNQPGLQIPLFFLFLGFYVVTVVGNLGLITLIGLNSHLHTPMYFFLF
NLSFIDFCYSTVITPKMLMNFVLRKNVISYAGCMTQLFFFLFFVVSESFILSAMAYDRYAAICNPLVY
TATMSPQVCFLLLLGVYVMGFAGAMAHTVCMVRLTFCANNLVDHYMCDILPLLERSCTSTYVNELVVF
IVVGIDIGVPTVTIFISYALILSSILRIHSTKGRSKAFSTCSSHIIAVSLFFGSGAFMYLKPSSLLPM
NQGKVSSLFYTIVVPMLNPLIYSLRNKDVKIALKKTLSKKPFS*

FIG. 1 Continued

E1:13347030-13347977 nucleotide sequence (SEQ ID NO:21)

atgaagtcaaaattTGAGTACAATAGAACAGCCATTACTGAGTTCATCCTGCTGGGCTTAGT
GGAGACACCAGACCTGCGGCCAGTTGTCTTTGTAGTCTTCCTCCTTTCCTACCTGCTCACAG
TTGGGGGCAACCTCAGCATCCTGGCCGCCATCTTGGTGGagcccaaactccacaccccatg
tacttcttcctggggAACCTATCGGTGCTGGACATTGGGTGCATCACAGTCACTATTCCCTC
AATGTTGGCTCGTCTCCTGTCCCACAAGCGTACTGTTCCCTATGGAGCCTGCCTCACACAGC
TTTTCTTCTTTCACCTTCTCGTTGGGGTGGACTGCTTCCTTTTGACAGCCATGGCCTATGAC
CGATTCCTGGCCATCTGCCAGCCCCTCACCTACAGCACCCGAATGAGCCAGACAGTCCAGAG
GATATTGGTGGCTGTGTCCTGGGCTTTAGCCTTCACTAATGCACTGACCCACACAGTAGCCA
TATCCACCCTGAACTTCTGTGGTCCCAATGTGATCAATCACTTCTACTGTGACCTCCCACAG
CTCTTCCAGCTCTCCTGCTCCAGCACCCAACTCAATGAGTTGCTGCTCTTTGCTGTGGGTTT
CATAATGGCAGGTACTCCCCTGGCTCTCATCGTCACCTCCTATGCCCATGTGACAGCTGCAG
TCCTACGAATCCGTTCTGCTGAGGGCAGGAAGAAAGCCTTCTCCACATGTGGCTCTCATCTC
ACTGTGGTTGCCATATTCTACGGTTCAGGTATATTTAATTACATGCGACTGGGTTCAGCCAA
GCTTTCAGACAAGGATAAAGCTTTTGGAATTTTTAACACCGTCATCAACCCCATGCTGAATC
CAATCATCTACAGCCTCAGGAACCCTGACGTGCAGGGTGCCCTCTGGAGAGTGCTCATGGGG
AGGCGGCCACTGGCTTGA E1:13347030-13347977 amino acid sequence (SEQ ID NO:51)

MKSKFEYNRTAITEFILLGLVETPDLRPVVFVVFLLSYLLTVGGNLSILAAILVEPKLHTPM
YFFLGNLSVLDIGCITVTIPSMLARLLSHKRTVPYGACLTQLFFFHLLVGVDCFLLTAMAYD
RFLAICQPLTYSTRMSQTVQRILVAVSWALAFTNALTHTVAISTLNFCGPNVINHFYCDLPQ
LFQLSCSSTQLNELLLFAVGFIMAGTPLALIVTSYAHVTAAVLRIRSAEGRKKAFSTCGSHL
TVVAIFYGSGIFNYMRLGSAKLSDKDKAFGIFNTVINPMLNPIIYSLRNPDVQGALWRVLMG
RRPLA*

FIG. 1 Continued

F1:65134904-65135858 nucleotide sequence (SEQ ID NO:22)

ATGGGAAATTGGAGCAGAGGCCACATAGCAGAGTTCGTGTTGGTGGGCTTCCCTACCTCTCCGCCCCT
CCAGTGCCTCCTCTTTGTCCTCTTCCTGGCAATTTACCTGTTGACATTGTTGGAGAACGCACTCATCG
TTTCCACAGTCTGGCTCACGCCAAGCCTTCACCGCCCGATGTACTTTTTCCTTGGCCATCTCTCCTTC
CTGGAGCTGTGGTACATCAATGTCACAGTTCCCCGGCTTTTGGGAGCATTTCTTACCCAGGAGCGTAG
AGTCTCCTACGTAGGCTGCATGACTCAGCTCTACTTCTTTATTGCCCTAGCCTGCACCGAATGTGTCC
TGCTGGCGgtcatggcctatgaccgctaccTGGCCATCTGTGAGCCCCTCCGTTATCCTAGTCTCATG
CCATCCAGCCTGGCCATTCGCCTCGCTGCTTCCTCTTGGGGTAGTGGCTTCTTGAGCTCCATGATGAA
GCTTCTTTTCATTTCCCGGCTGTCCTACTGTGGACCCAACGTCATCAACCACTTTTTCTGCGATATCT
CCCCACTACTCAACCTCACCTGCTCTGACAAAGAGCAAGCAGAACTAGTAGACTTCCTCTTGGCCCTG
GTGATGATTCTGCTCCCTCTGTTGGCCGTGGTTTCATCATATGCTGCCATAATGGCTGCCATCCTCAG
GATTCCTACTGCCCAGGGACGTCGcaaagccttctccacctgtgccTCTCACCTGGCAGTGGTTGTTA
TCTACTACTCCTCCACCCTCTTCACCTATGCACGGCCCCAGGCCATGTACACCTTCAACCATAACAAG
GTCATCTCTGTGCTCTATACAGTCATTGTACCGTTCCTCAATCCAGCCATCTACTGCCTGAGGAACAA
GGAGGTGAAGGATGCTCTCAGGAAGTCAGTCCTGGGCAGATGCCACTATCCGAGGGACGTCCCAGATT
GA F1:65134904-65135858 amino acid sequence (SEQ ID NO:52)

MGNWSRGHIAEFVLVGFPTSPPLQCLLFVLFLAIYLLTLLENALIVSTVWLTPSLHRPMYFFLGHLSF
LELWYINVTVPRLLGAFLTQERRVSYVGCMTQLYFFIALACTECVLLAVMAYDRYLAICEPLRYPSLM
PSSLAIRLAASSWGSGFLSSMMKLLFISRLSYCGPNVINHFFCDISPLLNLTCSDKEQAELVDFLLAL
VMILLPLLAVVSSYAAIMAAILRIPTAQGRRKAFSTCASHLAVVVIYYSSTLFTYARPQAMYTFNHNK
VISVLYTVIVPFLNPAIYCLRNKEVKDALRKSVLGRCHYPRDVPD*

FIG. 1 Continued

D1:62955839-62956792 nucleotide sequence (SEQ ID NO:23)

ATGGTGGACACCAATGGCAGTGAATCTAGTGCCACATATTTCATTCTAATAGGCCTTCCAGGCTTGGA
AAAAGCTCAGTTCTGGTTGGCCTTCCCGTTATGCTCCCTCTACCTTATTGCTGTGCTAGGTAACCTGA
CAGTCATCTGCATTGTGCGGACTGAGCACAGACTACATGAAcccatgtatattttctttgcatGCTT
TCTGGCCTTGACATACTTATCTCTACTTCATCTATGCCCAGAATGATGGCCATCTTCTGGTTCAATTC
CACTACCATCCAGTTTGATGCTTGTCTTCTACAGATGTTTGCCATCCACTCCTTATCTGGCATGGAGT
CCACTGTACTGCTGGCCATGGCCTttgaccgctatgtggccattTGTCACCCACTACGCCATGCCACT
GTGCTAACATTGCCTCGTGTTACCAAGATTGGCGTGGCTGCTGTGGTACGGGGTACTTCACTTATGGC
ACCCCTGCCTATCTTCATCAAACGGCTGCCTTTCTGCCGCTCCAACATTCTTTCCCATTCCTACTGCC
TACATCAAGATGTCATGAAGCTGGCTTGTGCTGACATCCGTGTCAATATCATCTATGGCCTCATTGTC
ATCATCTCTGCCATTGGCCTGGACTCACTTCTCATCTCCTTGTCATATCTGCTTATCCTCAAGACTGT
GTTGGGCTTGACACGTGAAGCCCAGGCAAAGGCATTTGGCACTTGTGTCTCTCATGTGTGTGCTGTTT
TCATATTCTATGTACCTTTCATTGGGTTATCTATGGTGCACCGCTTTGGGAAGCGGCATGACTCCCTC
CTGCCCATCATTATGGCCAACACCTACTTGCTTGTTCCTCCTGTGCTCAACCCTATTGTTTATGGAGT
GAAGACAAAGGAGATCCGGCAGCGTATCCTTCGTCTTTTCCATGTGACCACCCATACTTCAGATCCCT
AG D1:62955839-62956792 amino acid sequence (SEQ ID NO:53)

MVDTNGSESSATYFILIGLPGLEKAQFWLAFPLCSLYLIAVLGNLTVICIVRTEHRLHEPMYIFLCML
SGLDILISTSSMPRMMAIFWFNSTTIQFDACLLQMFAIHSLSGMESTVLLAMAFDRYVAICHPLRHAT
VLTLPRVTKIGVAAVVRGTSLMAPLPIFIKRLPFCRSNILSHSYCLHQDVMKLACADIRVNIIYGLIV
IISAIGLDSLLISLSYLLILKTVLGLTREAQAKAFGTCVSHVCAVFIFYVPFIGLSMVHRFGKRHDSL
LPIIMANTYLLVPPVLNPIVYGVKTKEIRQRILRLFHVTTHTSDP*

FIG. 1 Continued

D1:63312327-63313289 nucleotide sequence (SEQ ID NO:24)

ATGCCAAGGTTCACCATGGTGGTCTGGAATAACAATAACACCATGGAGCCTATATTTATTCTGAGGGG
ATTTCATGGATTGGAGTGTGTCTATTCTTGGATCTCAGTCCCATTCTGTCTTGCATACTTGGTAGCAT
TTATTGGTAATGTTACCATCCTCTCTGTCATTTGGATAGAGTCATCACTCCATCAGCCCATGTACTAC
TTCCTTTCCATCTTGGCACTGACTGACCTAGGTATGTCTATGTCCACACTTCCCACCATGCTTGCTGT
GTTATGGCTGGATGCTCGGGAGATCCAGGCAAGTGCTTGCTATGCTCAGCTCTTTTTCATCCACACAT
TCACATTCCTGGAGTCTTCGGTGCTACTGGCCATGGCCTTTGACCGTTTTGTTGCTATCTGCCGTCCA
CTGCACTATACTACCATCCTTAACAACAGTGTAATAGGCAAGATTGGTTTGGCCTGCTTGCTAAGAAG
CATGGGAGTTGTACTTCCTACACCTTTGCTACTGAGACATTATCACTACTGCCATGACAATGCCCTTT
CCCATACCTTCTGTTTGCACCAAGACATTCTGAAATTATCCTGTTCAGATGCAAGGATCAGCAGTGTC
TATGGCCTGTGTGTAGTTATTACCACACTTGGTGTGGATTCAGTCTGCATACTTCTTTCTTATATCCT
GATTCTGAATGCTGTGCTGGGGATTGCATCTCATGAAGAGCGGCGGAAGGCACTCAACACATGCATAT
CCCATATCTGTGTTGTGCTCATTTTCTTTGTGCCAGTAATTGGGGTGTCAATGGTCCATCGCTTTGGG
AAACATCTGTCTCCAAGAATTCACATCATCATGGCCGATATTTACCTGCTTTTCCCCCCAGTGCTTAA
CCCTATTGTCTATAGCATCAAAACAAAGCAGATTCGTCTAAGAATTCTCCGCAGGTTTGGACTGCGGA
GGGGGCATTAA

D1:63312327-63313289 amino acid sequence (SEQ ID NO:54)

MPRFTMVVWNNNNTMEPIFILRGFHGLECVYSWISVPFCLAYLVAFIGNVTILSVIWIESSLHQPMYY
FLSILALTDLGMSMSTLPTMLAVLWLDAREIQASACYAQLFFIHTFTFLESSVLLAMAFDRFVAICRP
LHYTTILNNSVIGKIGLACLLRSMGVVLPTPLLLRHYHYCHDNALSHTFCLHQDILKLSCSDARISSV
YGLCVVITTLGVDSVCILLSYILILNAVLGIASHEERRKALNTCISHICVVLIFFVPVIGVSMVHRFG
KHLSPRIHIIMADIYLLFPPVLNPIVYSIKTKQIRLRILRRFGLRRGH*

FIG. 1 Continued

B3:72908295-72909287 nucleotide sequence (SEQ ID NO:25)

ATGTTCATTGTTATTCACTCCTTCGTTACTTCTATTTCTCTAACAGCTTTGGAATCTCAGAACGCAAC
AATGCATTTTGTGACTGAGTTTGTCCTCCTGGGTTTTCCTGGTCAAAGGGAGATGCAgaactttttct
tctcattaatcCTTGTGGTCTATCTCCTCACTCTGCTGGGGAATGGGGTTATTGTCTATGTAGTGAAA
TGGGACAAGCGGCTTCACACACCCATGTACATCCTCTTGGGAAACTTTGCCTTCCTAGAGATCTGGTA
CATCTCCTCCACTGTCCCAAACATGCTGGTCACCATCCTCTCTGAGACCAAGACCATCTCCTTCACTG
GATGCTTcctccaattttatttcttttctcattgggtACAACAGAGTGTTTCTTCTTATCAGTTATG
GCTTATGACCGGTACCTTGCCATCTGTCGCCCACTACATTATCCTTCCATCATGACTGGGAAGCTCTG
TGTGATCCTGGTCTGCGTTTGCTGGGTGAGTGGATTTCTCTGCTATCCAATCCCCATTGTCCTCATCT
CCCAACTTCCCTTCTGTGGACCTAACATCATTGACCACTTCGTGTGTGACCCAGGCCCATTGTTCGCA
CTGGCCTGCATCCCTGCTCCTTCCACTGAACTTATCTGCTATACCTTCAACTCAGTGATTATCTTTGG
GCCCTTCCTTTCTATCTTGGGATCTTACACTCTGGTACTCAGAGCTGTGCTTCGTATTCCTTCTGGTG
CTGGTCAAACTAAAGCTTTCTCCACATGTGGGTCACACCTAATGGTGGTGTCTCTATTCTATGGAACC
CTTATGGTGATGTATGTAAGCCCAACATCAGGAAATCCAGCAGGAATGCAGAAGATCGTCACTTTGGT
ATACTCAGCAGTGACTCCACTCTTAAACCCCCTTATCTATAGTCTTCGAAATAAAGACATGAAAGATG
CCCTAAAGAAACTCCTAGGATTAAGAAGTAACCCAAACTGA B3:72908295-72909287 amino acid sequence (SEQ ID NO:55)

MFIVIHSFVTSISLTALESQNATMHFVTEFVLLGFPGQREMQNFFFSLILVVYLLTLLGNGVIVYVVK
WDKRLHTPMYILLGNFAFLEIWYISSTVPNMLVTILSETKTISFTGCFLQFYFFFSLGTTECFFLSVM
AYDRYLAICRPLHYPSIMTGKLCVILVCVCWVSGFLCYPIPIVLISQLPFCGPNIIDHFVCDPGPLFA
LACIPAPSTELICYTFNSVIIFGPFLSILGSYTLVLRAVLRIPSGAGQTKAFSTCGSHLMVVSLFYGT
LMVMYVSPTSGNPAGMQKIVTLVYSAVTPLLNPLIYSLRNKDMKDALKKLLGLRSNPN*

FIG. 1 Continued

D1:105486528-105487493 nucleotide sequence (SEQ ID NO:26)

ATGGAGGAGGGTGGTCCCAACCATGGCCAGAGCAACCACACCAATGTGAAGGAATTTGTCTT
CCTAGAACTCACTCACTTCCAGGAGCTGGAATGTTTCTTGTTTGTGGCTTTCCTTGCTGTAT
ATGTAACCACCGTGCTGGGCAATGCCCTCATTGTGCTGACCATCACCTATGAGTCCCACCTT
CACACTCCCATGTACTTTCTGCTGCGGAACAAATCGGTCCTGGACATTGTTTTTTCATCTGT
CACTGTTCCCAAGTTCCTGGTGGATCTGTTATCAGAGAGGAAAACCATCTCCTACAATGGCT
GCATGGCACAGatcttcttcttccattttgctGGTGGGGcagatattttcttcctctccgTG
ATGGCCTATGACAGATACCTTGCAATCGCCAAACCCCTGCATTATGTGACCATTATGAAGAG
AGAGGTGTGGGTGGGCTTGGTGGTGGCTTCCTGGGTGGGCGGTGGTTTGCACTCAATTGTCC
AGATAATTCTGATGCTTCCACTCTCCTTCTGTGGCCCCAACATCCTGGATGCCTTCTACTGT
GATGTGCCCCAAGTAGTTAAGCTGGCTTGCACTGATACCTTTGCTCTGGAACTTCTCATGAT
CTCTAACAATGGGTTGGTGACCCTGCTATGGTTCCTCTTGCTCCTGGGATCCTACACCGTTA
TTCTGGTGATGCTGAGATCTCACTCTGGGGCAGGACGGAACAAGGCCCTGTCCACCTGCACC
TCCCATATCCTCGTGGTGACTCTGCACTTTGTGCCTTGTGTCTACATCTACTGCCGGCCCTT
CACTACACTGCCCATGGACACAGCTGTGTCCATCAATAACACGGTCATTACGCCCATGCTGA
ACCCCATGATTTATACCCTGAGGAACCAGGAGATGAAGTCTGCCATGAAAAGACTACACAGA
AGGCTTGGACCTTCTGAGAGCAGTAAGCTGGGGTGA D1:105486528-105487493 amino acid sequence (SEQ ID NO:56)

MEEGGPNHGQSNHTNVKEFVFLELTHFQELECFLFVAFLAVYVTTVLGNALIVLTITYESHLHTPMYF
LLRNKSVLDIVFSSVTVPKFLVDLLSERKTISYNGCMAQIFFFHFAGGADIFFLSVMAYDRYLAIAKP
LHYVTIMKREVWVGLVVASWVGGGLHSIVQIILMLPLSFCGPNILDAFYCDVPQVVKLACTDTFALEL
LMISNNGLVTLLWFLLLLGSYTVILVMLRSHSGAGRNKALSTCTSHILVVTLHFVPCVYIYCRPFTTL
PMDTAVSINNTVITPMLNPMIYTLRNQEMKSAMKRLHRRLGPSESSKLG*

FIG. 1 Continued

B3:74116955-74117893 nucleotide sequence (SEQ ID NO:27)

ATGGATGCTCTAAATCAAACAAGAGTGACTGAATTTGTCTTCTTGGGACTCACTGATAAGTGGGTGCT
GGAGATACTATTTTTTCTGGCATTCTCCGTCACATATGTATTAACCCTTTTGGGAAACACTCTCATTA
TAGTTACTATAGTCTTTACTCCACGCCTCCATAccccatgtatttcttcctgagCAATCTGTCCTTT
ATTGACATCTGCCACTCATCTGTCACTGTGCCCAAGATGCTAGAGGGCTTGCTTTTAGAGATAAAGAC
TATTTCCTTTGATAATTGCATTGCACAGCTCTTCTTCCTACATCTGTTTGCTTGTGCTGAGATCTTTC
TGCTGACCATTATGGCTTATGATCGTTATGTAGCCATCTGTGCTCCATTGCACTATTCTAATGTGATG
AACATGAGGGTCTGTGTACAGCTTGTCTTTGCTCTCTGGTTGGGGGCTACTGTTCACTCTCTGGTGCA
GACCTTCTTGACCATTCGTCTACCTTACTGTGGCCCCAACATTATTGATAGCTACTTCTGCGATGTGC
CCCCTGTCATCAAGCTGGCTTGCACAGATACATACCTCACGGGAATGCTAATTGTGTCTAATAGTGGA
ACCATCTCCCTCACCTGTTTCCTGGCTTTGGTCACCTCTTACACGGTCATCCTGGTTTCTCTTAGAAA
ACAGTCAGCTGAAGGGCGCCGGAAAGCCTTGTCTACCTGTTCAGCCCACTTCATGGTTGTAGCCTTCT
TTTTTGGACCATGTATCTTCATCTACACTCGGCCAGACACTAGCTTCTCCATTGACAAGGTGGTATCT
GTCTTCTACACAGTGGTCACTCCTTTGCTGAATCCTCTCATTTACACCTTGAGAAATGAGGAGGTAAA
AAGTGCCATGAAGCATCTCAGACAGAGAGGTTTTTTCATGAAGTCAGGTACATGA B3:74116955-74117893 amino acid sequence (SEQ ID NO:57)

MDALNQTRVTEFVFLGLTDKWVLEILFFLAFSVTYVLTLLGNTLIIVTIVFTPRLHTPMYFFLSNLSF
IDICHSSVTVPKMLEGLLLEIKTISFDNCIAQLFFLHLFACAEIFLLTIMAYDRYVAICAPLHYSNVM
NMRVCVQLVFALWLGATVHSLVQTFLTIRLPYCGPNIIDSYFCDVPPVIKLACTDTYLTGMLIVSNSG
TISLTCFLALVTSYTVILVSLRKQSAEGRRKALSTCSAHFMVVAFFFGPCIFIYTRPDTSFSIDKVVS
VFYTVVTPLLNPLIYTLRNEEVKSAMKHLRQRGFFMKSGT*

FIG. 1 Continued

E3:40237904-40238842 nucleotide sequence (SEQ ID NO:28)

ATGGCAGAGGCCAACAACAGCTTTTCAGAGGGCTGCATCCTGATGGGTATATCTGACCATCCCCAGCT
GGAGATCGTCTTTTTCATAGTCATTCTCTTCTCTTACTCGCTGACCCTAGTTGGGAATTCGACCACCA
TCCTGCTCTCCTGCCTGGATGCCCggctccacaccccatgtacttcttcctcagcAACCTCTCCTCC
CTGGACCTCGCTTTTACTACCAGCTCGGTCCCCCAAATGCTGACCAACTTATGGGGACCAGATAAGAC
TATAAGCTACGCTGGCTGTGTGATCCAGCTCTATGTTTTCCTCTGGCTAGGGGCCACTGAGTGCATCC
TGCTCGTGGTGATGGCATTCGACCGCCATGTGGCAGTTTGCCAGCCCCTGCGCTACACCGTCATCGTG
AGCCCTCGGCTCTGCCGGCTGCTGGCTGCCATTGCATGGCTGGGCGGCTTGAGCAACTCCATGATCCA
GTCAACGTTCACTCTCCAGCTCCCATTGTGTGGGCACCGGAGGGTGGACAACTTCCTGTGTGAGGTGC
CTGCCATGATCAAACTGGCCTGTGGAGACACAAGTCTCAACGAGGCCGTGCTCAATGGTGTCTGCACC
TTCTTCACTGCCGTCCCGCTGAGCATCATCCTGATCTCCTACTGCTCCATAGCTCGGGCAGTGCTGAA
GATCCGCTCagctgagggacagagaaaggccTTTAATACTTGCCTTTCCCATCTGGTGGTGGTGCTCC
TCTTCTATGGGTCAGCTATCTACGGGTACCTCCTTCCGGCTAAGACCAGCCACCAGGGCCAAGGCAAA
TTCATTTCCCTCTTCTACTCTGTGGTCACGCCAATGGTGAACCCTCTCATCTACACTCTGAGAAACAA
GGAGGTAAAGGCGGCACTGAGGAGGCTccggggaaagggaagagaattcGGCTGA E3:40237904-40238842 amino acid sequence (SEQ ID NO:58)

MAEANNSFSEGCILMGISDHPQLEIVFFIVILFSYSLTLVGNSTTILLSCLDARLHTPMYFFLSNLSS
LDLAFTTSSVPQMLTNLWGPDKTISYAGCVIQLYVFLWLGATECILLVVMAFDRHVAVCQPLRYTVIV
SPRLCRLLAAIAWLGGLSNSMIQSTFTLQLPLCGHRRVDNFLCEVPAMIKLACGDTSLNEAVLNGVCT
FFTAVPLSIILISYCSIARAVLKIRSAEGQRKAFNTCLSHLVVVLLFYGSAIYGYLLPAKTSHQGQGK
FISLFYSVVTPMVNPLIYTLRNKEVKAALRRLRGKGREFG*

FIG. 1 Continued

D1:105462554-105463512 nucleotide sequence (SEQ ID NO:29)

ATGAGAAGCATGTCCACAGCTAAGGCCTGGAATAGCTCTTCAGTAACCATGTTCATCTTCCTGGGATT
TGCAGACCATCCAGAACTCCAGACCCTTCTCTTTGTGACCTTCCTGGGTATCTATCTTGTGACACTGG
CCTGGAACCTGGCCCTCATCTTTTTGATCAGAGGTGACCCCCGTCTGCAcacacccatgtacttcttc
ctcagcAACTTGTCTTTCATCGACATCTGCTACTCTTCTACAGTGGCCCCCAAGATGCTCACTGATTT
CTTCTGGGAGCAAAAGACCATATCATTCTTGGGCTGTGctgctcagttttttttctttgtcagtatGG
GTCTCACTGAGTGCTTCCTCCTGACTGCCATGGCATACGACAGATACGCAGCCATCTCCAATCCCCTG
CTGTACACAGCCATCATGTCCCAAGGCCTCTGCACACGCATGGTGCTTGGGGCATATGTTGGTGGCTT
CCTGAGCTCCCTGATCCAGGCCAGCTCCATATTTCAGCTTCACTTCTGCGGACCCAACATTATCAATC
ATTTCTTCTGTGACCTCCCTCCAGTACTGGCACTTTCTTGCTCTGACACCTTTCCTAGTCAAGTGGTG
AATTTTCTCGTGGTAGTCACTATTGGGGGACATCATTCCTCATCCTCATCATCTCCTACAGTTACAT
AGGAACTGCTGTCTTGAAAATCCGTTCAGTGGAAGGCCGAAAGAAAGCCTTCAGCACATGTGCCTCAC
ACTTGATGGTGGTGACTCTGTTGTTTGGGACGGCCCTTTTCATGTACCTGAGACCCAGCTCCAGCTAC
TCGCTTGGCAGGGACAAGGTAGTGTCTGTGTTCTATTCACTGGTGATCCCCATGCTGAACCCTCTTAT
TTACAgtttgaggaacagagagatcaaAGATGCCCTATGGAAGGTGTTGGAGAAGAAGAAACTGTTTT
CCTAG D1:105462554-105463512 amino acid sequence (SEQ ID NO:59)

MRSMSTAKAWNSSSVTMFIFLGFADHPELQTLLFVTFLGIYLVTLAWNLALIFLIRGDPRLHTPMYFF
LSNLSFIDICYSSTVAPKMLTDFFWEQKTISFLGCAAQFFFFVSMGLTECFLLTAMAYDRYAAISNPL
LYTAIMSQGLCTRMVLGAYVGGFLSSLIQASSIFQLHFCGPNIINHFFCDLPPVLALSCSDTFPSQVV
NFLVVVTIGGTSFLILIISYSYIGTAVLKIRSVEGRKKAFSTCASHLMVVTLLFGTALFMYLRPSSSY
SLGRDKVVSVFYSLVIPMLNPLIYSLRNREIKDALWKVLEKKKLFS*

FIG. 1 Continued

D1:21266824-21267768 nucleotide sequence (SEQ ID NO:30)

ATGCCTTTAATGAGAATGGCAGCTGAGAACTCCTCTGTGACAGAATTTATCCTTGCAGGCTTAACCAA
CCAGCCCGGACTTCGGATGCccctcttcttcctgtttctagGTTTCTATGTGGTCACTGTGATGGGGA
ACCTGGGTCTGATAACCCTGATTGGGCTGAATTCTCACCTgcacaccccccatgtacttcttcctcttc
AACTTGTCCTTCATAGATTTTTGCTATTCCACTGTTATCACTCCCAAGATGCTGATGAGTTTTGTCTC
AAAGAACACCATCGCCTACGCAGGGTGTATGACTcagctcttcttttttcttttctttgttgtctCTG
AGTCCTTCATCCTGTCAGCAATGGCATATGACCGCTACACCGCCATCTGTAACCCACTGGTGTACACA
GCCACCATGTCTCCTCAGGTCTGCTCGCTTCTTCTGTTGGGTGTCTATGTGATGGGGTTTGCTGGGGC
CATGGCCCACACGACATGCATGGTGAGGCTGACCTTCTGTGCCAACAATCTGGTTGACCACTACATGT
GTGACATCCTTCCCCTTCTTGAGCGCTCTTGCACCAGCACCTATGTAAATGAGCTGGTAGTTTTCGTT
GTCGTGGGCATTGATATTGGCGTGCCCACAGTTACCATCTTCATTTCTTATGccctcatcctccaccag
cattcTCCATATTCGTTCCACTGAGGGCAGGTCCAAAGCCTTCAGCACATGCAGCTCTCACATAAttg
ctgtttctcttttctttgggtCAGGGGCATTTATGTACCTCAAACCATCCTCTCTTTTACCTATGAAT
CAGGGGAAAGTGTCCTCCTTGTTCTATACCACCGTTGTGCCCATGCTCAACCCGCTAATCTATAGCTT
AAGAAATAAAGATGTCAAAGTTGCTCTGAAGAAATCATTGAGCAAAAAGACATTCTCTTGA D1:21266824-21267768 amino acid sequence (SEQ ID NO:60)

MPLMRMAAENSSVTEFILAGLTNQPGLRMPLFFLFLGFYVVTVMGNLGLITLIGLNSHLHTPMYFFLF
NLSFIDFCYSTVITPKMLMSFVSKNTIAYAGCMTQLFFFLFFVVSESFILSAMAYDRYTAICNPLVYT
ATMSPQVCSLLLLGVYVMGFAGAMAHTTCMVRLTFCANNLVDHYMCDILPLLERSCTSTYVNELVVFV
VVGIDIGVPTVTIFISYALILTSILHIRSTEGRSKAFSTCSSHIIAVSLFFGSGAFMYLKPSSLLPMN
QGKVSSLFYTTVVPMLNPLIYSLRNKDVKVALKKSLSKKTFS*

FIG. 1 Continued

SEQ ID NOS 41, 51 and 31, respectively, in order of appearance

|  | 1 | 10 | 20 | 30 | 40 | 50 |
|---|---|---|---|---|---|---|
| CafaOR9.2.9 | MQSKFGANSTAITEFILLGLVQTPGLQPVVFVVFLFAYLVTVGGNLSILA | | | | | |
| CatG1 | MKSKFEYNRTAITEFILLGLVETPDLRPVVFVVFLLSYLLTVGGNLSILA | | | | | |
| HsOR17.1.11 | MQPESGANGTVIAEFILLGLLEAPGLQPVVFVLFLFAYLVTVRGNLSILA | | | | | |

|  | 60 | 70 | 80 | 90 | 100 |
|---|---|---|---|---|---|
| CafaOR9.2.9 | AILVEPKLHTPMYFFLGNLSVLDVGCITVTVPSMLARLLSHKRTVPYRAC | | | | |
| CatG1 | AILVEPKLHTPMYFFLGNLSVLDIGCITVTIPSMLARLLSHKRTVPYGAC | | | | |
| HsOR17.1.11 | AVLVEPKLHTPMYFFLGNLSVLDVGCISVTVPSMLSRLLSRKRAVPCGAC | | | | |

|  | 110 | 120 | 130 | 140 | 150 |
|---|---|---|---|---|---|
| CafaOR9.2.9 | LTQLFFFHLLVGVDCFLLTAMAYDRFLAICRPLTYSTQMSQTVQRILVVV | | | | |
| CatG1 | LTQLFFFHLLVGVDCFLLTAMAYDRFLAICQPLTYSTRMSQTVQRILVAV | | | | |
| HsOR17.1.11 | LTQLFFFHLFVGVDCFLLTAMAYDRFLAICRPLTYSTRMSQTVQRMLVAA | | | | |

|  | 160 | 170 | 180 | 190 | 200 |
|---|---|---|---|---|---|
| CafaOR9.2.9 | SWALAFTNALTHTVAIATLNFCGPNVINHFYCDLPQLFQLSCSSTQLNEL | | | | |
| CatG1 | SWALAFTNALTHTVAISTLNFCGPNVINHFYCDLPQLFQLSCSSTQLNEL | | | | |
| HsOR17.1.11 | SWACAFTNALTHTVAMSTLNFCGPNVINHFYCDLPQLFQLSCSSTQLNEL | | | | |

|  | 210 | 220 | 230 | 240 | 250 |
|---|---|---|---|---|---|
| CafaOR9.2.9 | LLFAVGFIMAGTPLALIITSYAHVAAAVLRIRSAEGRKKAFSTCGSHLTV | | | | |
| CatG1 | LLFAVGFIMAGTPLALIVTSYAHVTAAVLRIRSAEGRKKAFSTCGSHLTV | | | | |
| HsOR17.1.11 | LLFAVGFIMAGTPMALIVISYIHVAAAVLRIRSVEGRKKAFSTCGSHLTV | | | | |

|  | 260 | 270 | 280 | 290 | 300 |
|---|---|---|---|---|---|
| CafaOR9.2.9 | VAIFYGSGIFNYMRLGTAKHSDKDKGVGVFNTVINPMLNPIIYSLRNLDV | | | | |
| CatG1 | VAIFYGSGIFNYMRLGSAKLSDKDKAFGIFNTVINPMLNPIIYSLRNPDV | | | | |
| HsOR17.1.11 | VAIFYGSGIFNYMRLGSTKLSDKDKAVGIFNTVINPMLNPIIYSFRNPDV | | | | |

|  | 310 | 320 | 330 | 340 | 350 |
|---|---|---|---|---|---|
| CafaOR9.2.9 | QGALWRVLRGRQSLA | | | | |
| CatG1 | QGALWRVLMGRRPLA | | | | |
| HsOR17.1.11 | QSAIWRMLTGRRSLA | | | | |

FIG. 2A

SEQ ID NOS 52, 32 and 42, respectively, in order of appearance

|            | 1          10         20         30         40         50 |
|------------|------------------------------------------------------------|
| CatG2      | -MGNWSRGHIAEFVLVGFPTSPPLQCLLFVLFLAIYLLTLLENALIVSTV          |
| HsOR1.4.8  | -MRNLSGGHVEEFVLVGFPTTPPLQLLLFVLFFAIYLLTLLENALIVFTI          |
| CafaOR38.1.21 | MMGNLSGGHIADFILVGFPTSPPLQLLLFVLFFAIYLLTLLENALIVSTI       |

|            |           60         70         80         90        100 |
|------------|-----------------------------------------------------------|
| CatG2      | WLTPSLHRPMYFFLGHLSFLELWYINVTVPRLLGAFLTQERRVSYVGCMT         |
| HsOR1.4.8  | WLAPSLHRPMYFFLGHLSFLELWYINVTIPRLLAAFLTQDGRVSYVGCMT         |
| CafaOR38.1.21 | WLTPSLHRPMYFFLGHLSFLELWYINVTVPRLLGAFLTQDRRVSYVGCMT      |

|            |          110        120        130        140        150 |
|------------|-----------------------------------------------------------|
| CatG2      | QLYFFIALACTECVLLAVMAYDRYLAICEPLRYPSLMPSSLAIRLAASSW         |
| HsOR1.4.8  | QLYFFIALACTECVLLAVMAYDRYLAICGPLLYPSLMPSSLATRLAAASW         |
| CafaOR38.1.21 | QLYFFIALACTECVLLAVMAYDRYLAICEPLRYPSLMPSSLAIRLAASSW      |

|            |          160        170        180        190        200 |
|------------|-----------------------------------------------------------|
| CatG2      | GSGFLSSMMKLLFISRLSYCGPNVINHFFCDISPLLNLTCSDKEQAELVD         |
| HsOR1.4.8  | GSGFFSSMMKLLFISQLSYCGPNIINHFFCDISPLLNLTCSDKEQAELVD         |
| CafaOR38.1.21 | GGGFFSSMMKLLFISRLSYCGPNIINHFFCDISPLLNLTCSDKEQAELVD      |

|            |          210        220        230        240        250 |
|------------|-----------------------------------------------------------|
| CatG2      | FLLALVMILLPLLAVVSSYAAIMAAILRIPTAQGRRKAFSTCASHLAVVV         |
| HsOR1.4.8  | FLLALVMILLPLLAVVSSYTAIIAAILRIPTSRGHKAFSTCAAHLAVVV          |
| CafaOR38.1.21 | FLLALVMILLPLLAVVSSYAAIIATILRIPTAQGRRKAFSTCASHLAVVV      |

|            |          260        270        280        290        300 |
|------------|-----------------------------------------------------------|
| CatG2      | IYYSSTLFTYARPQAMYTFNHNKVISVLYTVIVPFLQPAIYCLRNKEVKD         |
| HsOR1.4.8  | IYYSSTLFTYARPRAMYTFNHNKIISVLYTIIVPFFQPAIYCLRNKEVKE         |
| CafaOR38.1.21 | IYYSSTLFTYARPRAMYTFNHNKIISVLYTVIVPFLQPAIYCLRNKEVKD      |

|            |          310        320        330        340        350 |
|------------|-----------------------------------------------------------|
| CatG2      | ALRKSVLGRCHYPRDVPD                                        |
| HsOR1.4.8  | AFRKTVMGRCHYPRDVQD                                        |
| CafaOR38.1.21 | ALRKLVLGRCHYPSDVPD                                     |

FIG. 3A

SEQ ID NOS 43, 53 and 33, respectively, in order of appearance

|              | 1          10         20         30         40         50 |
|--------------|---|
| CafaOR21.2.15 | -MVDPNGNESSATYFILIGLPGLEEAQFWLAFPLCSLYFIAVLGNLTIIY |
| CatG3        | -MVDTNGSESSATYFILIGLPGLEKAQFWLAFPLCSLYLIAVLGNLTVIC |
| HsOR11.3.14  | MMVDPNGNESSATYFILIGLPGLEEAQFWLAFPLCSLYLIAVLGNLTIIY |
|              | 60         70         80         90         100 |
| CafaOR21.2.15 | IVRTEHSLHEPMYVFLCMLSGLDILISTSSMPKMMAIFWFNSTTIQFDAC |
| CatG3        | IVRTEHRLHEPMYIFLCMLSGLDILISTSSMPRMMAIFWFNSTTIQFDAC |
| HsOR11.3.14  | IVRTEHSLHEPMYIFLCMLSGIDILISTSSMPKMLAIFWFNSTTIQFDAC |
|              | 110        120        130        140        150 |
| CafaOR21.2.15 | LLQMFAIHSLSGMESTVLLAMAFDRYVAICHPLRHATVLTLPRVMKIGMA |
| CatG3        | LLQMFAIHSLSGMESTVLLAMAFDRYVAICHPLRHATVLTLPRVTKIGVA |
| HsOR11.3.14  | LLQMFAIHSLSGMESTVLLAMAFDRYVAICHPLRHATVLTLPRVTKIGVA |
|              | 160        170        180        190        200 |
| CafaOR21.2.15 | AVVRGTALMAPLPVFIKRLPFCHSNILSHSYCLHQDVMKLACADIRVNII |
| CatG3        | AVVRGTSLMAPLPIFIKRLPFCRSNILSHSYCLHQDVMKLACADIRVNII |
| HsOR11.3.14  | AVVRGAALMAPLPVFIKQLPFCRSNILSHSYCLHQDVMKLACDDIRVNVV |
|              | 210        220        230        240        250 |
| CafaOR21.2.15 | YGLIVIISAIGLDSLLISLSYLLILKTVLGLTREAQAKAFGTCVSHVCAV |
| CatG3        | YGLIVIISAIGLDSLLISLSYLLILKTVLGLTREAQAKAFGTCVSHVCAV |
| HsOR11.3.14  | YGLIVIISAIGLDSLLISFSYLLILKTVLGLTREAQAKAFGTCVSHVCAV |
|              | 260        270        280        290        300 |
| CafaOR21.2.15 | FIFYVPFIGLSMVHRFGKRHDSFLPIIMANTYLLVPPVLNPIVYGVKTKE |
| CatG3        | FIFYVPFIGLSMVHRFGKRHDSLLPIIMANTYLLVPPVLNPIVYGVKTKE |
| HsOR11.3.14  | FIFYVPFIGLSMVHRFSKRRDSPLPVILANIYLLVPPVLNPIVYGVKTKE |
|              | 310        320        330        340        350 |
| CafaOR21.2.15 | IWQRILRLFHVTNHTSDL |
| CatG3        | IRQRILRLFHVTTHTSDP |
| HsOR11.3.14  | IRQRILRLFHVATHASEP |

FIG. 4A

SEQ ID NOS 34, 44 and 54 respectively, in order of appearance

|  | 1         10        20        30        40        50 |
|---|---|
| HsOR11.3.40 | -----MGDWNNSDAVEPIFILRGFPGLEYVHSWLSILFCLAYLVAFMGNV |
| CafaOR21.2.43 | MPRVTMVVWNNNNTLEPIFILKGFPGLECVHSWFSIPFCLAYLVAFIGNV |
| CatG4 | MPRFTMVVWNNNNTMEPIFILRGFHGLECVHSWISVPFCLAYLVAFIGNV |

|  | 60        70        80        90        100 |
|---|---|
| HsOR11.3.40 | TILSVIWIESSLHQPMYYFISILAVNDLGMSLSTLPTMLAVLWLDAPEIQ |
| CafaOR21.2.43 | TILSVIWIESSLHQPMYYFISILALTDLGMSMSTLPTMLAVLWLDAREIQ |
| CatG4 | TILSVIWIESSLHQPMYYFLSILALTDLGMSMSTLPTMLAVLWLDAREIQ |

|  | 110       120       130       140       150 |
|---|---|
| HsOR11.3.40 | ASACYAQLFFIIHTFTFLESSVLLAMAFDRFVAICHPLHYPTILTNSVIGK |
| CafaOR21.2.43 | ASACYAQLFFIIHTFTFLESSVLLAMAFDRFVAICRPLHYTTILNNSVIGK |
| CatG4 | ASACYAQLFFIIHTFTFLESSVLLAMAFDRFVAICRPLHYTTILNNSVIGK |

|  | 160       170       180       190       200 |
|---|---|
| HsOR11.3.40 | IGLACLLRSLGVVLPTPLLLRHYHYCHGNALSHAFCLHQDVLRLSCTDAR |
| CafaOR21.2.43 | IGLACLLRSMGVVLPTPLLLRHYHYCHVNALSHAFCLHQDVLKLSCSDAR |
| CatG4 | IGLACLLRSMGVVLPTPLLLRHYHYCHDNALSHTFCLHQDILKLSCSDAR |

|  | 210       220       230       240       250 |
|---|---|
| HsOR11.3.40 | TNSIYGLCVVIATLGVDSIFILLSYVLILNTVLDIASREEQLKALNTCVS |
| CafaOR21.2.43 | ISSVYGLCVVITTLGMDSVFILLSYVLILNAVLGIASHEERLKALNTCVS |
| CatG4 | ISSVYGLCVVITTLGVDSVCILLSYILILNAVLGIASHEERRKALNTCIS |

|  | 260       270       280       290       300 |
|---|---|
| HsOR11.3.40 | HICVVLIFFVPVIGVSMVHRFGKHLSPIVHILMADIYLLLPPVLNPIVYS |
| CafaOR21.2.43 | HICVVLIFFVPVIGVSMVHRFGKHLSPIVHIIMADIYLLFPPVLNPIVYS |
| CatG4 | HICVVLIFFVPVIGVSMVHRFGKHLSPRIHIIMADIYLLFPPVLNPIVYS |

|  | 310       320       330       340       350 |
|---|---|
| HsOR11.3.40 | VRTKQIRLGILHKFVLRRRF |
| CafaOR21.2.43 | VRTKQIRIRIFHKLRLGRRL |
| CatG4 | IKTKQIRLRILRRFGLRRGH |

FIG. 5A

SEQ ID NOS 35, 45 and 55, respectively, in order of appearance

|  | 1　　　　　　10　　　　　　20　　　　　　30　　　　　　40　　　　　　50 |
|---|---|
| HsOR14.1.27 | MFFIIHSLVTSVFLTALGPQNRTMHFVTEFVLLGFHGQREMQSCFFSFIL |
| CafaOR15.2.20 | MLIIIHSLVISASLTALESQNTTMRFVSEFVLLGFPGQREMQNFFFSFIL |
| CatGr5 | MFIVIHSFVTSISLTALESQNATMHFVTEFVLLGFPGQREMQNFFFSLIL |
|  | 60　　　　　　70　　　　　　80　　　　　　90　　　　　　100 |
| HsOR14.1.27 | VLYLLTLLGNGAIVCAVKLDRRLHTPMYILLGNFAFLEIWYISSTVPNML |
| CafaOR15.2.20 | VIYLLTLLGNGIIVCIVKWDKQLHTPMYIFLGNFAFLEIWYTSSTVPSML |
| CatGr5 | VVYLLTLLGNGVIVYVVKWDKRLHTPMYILLGNFAFLEIWYISSTVPNML |
|  | 110　　　　　120　　　　　130　　　　　140　　　　　150 |
| HsOR14.1.27 | VNILSEIKTISFSGCFLQFYFFFSLGTTECFFLSVMAYDRYLAICRPLHY |
| CafaOR15.2.20 | VNILSEIKTISFTGCFLQFYFFFSLGTTECFFLSVMAYDRYLAICRPLHY |
| CatGr5 | VTILSETKTISFTGCFLQFYFFFSLGTTECFFLSVMAYDRYLAICRPLHY |
|  | 160　　　　　170　　　　　180　　　　　190　　　　　200 |
| HsOR14.1.27 | PSIMTGKFCIILVCVCWVGGFLCYPVPIVLISQLPFCGPNIIDHLVCDPG |
| CafaOR15.2.20 | PSIMTGKLCVALVCVCWVSGFLCYPVPIVLISQLPFCGPNIIDHFVCDPG |
| CatGr5 | PSIMTGKLCVILVCVCWVSGFLCYPIPIVLISQLPFCGPNIIDHFVCDPG |
|  | 210　　　　　220　　　　　230　　　　　240　　　　　250 |
| HsOR14.1.27 | PLFALACISAPSTELICYTFNSMIIFGPFLSILGSYTLVIRAVLCIPSGA |
| CafaOR15.2.20 | PLFALACIPAPSTELLCYTFNSLIIFGPFLFILGSYTLVLRAVLRIPSGA |
| CatGr5 | PLFALACIPAPSTELICYTFNSVIIFGPFLSILGSYTLVLRAVLRIPSGA |
|  | 260　　　　　270　　　　　280　　　　　290　　　　　300 |
| HsOR14.1.27 | GRTKAFSTCGSHLMVVSLFYGTLMVMYVSPTSGNPAGMQKIITLVYTAMT |
| CafaOR15.2.20 | GRTKAFSTCGSHLMVVSLFYGTLMVMYVSPTSGNPTGMQKIITLVYTAVT |
| CatGr5 | GQTKAFSTCGSHLMVVSLFYGTLMVMYVSPTSGNPAGMQKIVTLVYTAVT |
|  | 310　　　　　320　　　　　330　　　　　340　　　　　350 |
| HsOR14.1.27 | PFLNPLIYSLRNKDMKDALKRVLGLTVSQN |
| CafaOR15.2.20 | PLLNPLIYSLRNKDMKDALKKVLGLRSNQN |
| CatGr5 | PLLNPLIYSLRNKDMKDALKKLLGLRSNPN |

FIG. 6A

SEQ ID NOS 36, 56 and 46, respectively, in order of appearance

|  | 1 | 10 | 20 | 30 | 40 | 50 |
|---|---|---|---|---|---|---|
| HsOR11.13.7 | -------MDQINHTNVKEFFFLELTRSRELEFFLFVVFFAVYVATVLGNA |
| CatGr6 | MEEGGPNHGQSNHTNVKEFVFLELTHFQELECFLFVAFLAVYVTTVLGNA |
| CafaOR18.3.11 | -------MGQSNHTNVKEFVFLKLTHFHELELFLFVVFLAVYVATVLGNV |

|  | 60 | 70 | 80 | 90 | 100 |
|---|---|---|---|---|---|
| HsOR11.13.7 | LIVVTITCESRLHTPMYFLLRNKSVLDIVFSSITVPKFLVDLLSDRKTIS |
| CatGr6 | LIVLTITYESHLHTPMYFLLRNKSVLDIVFSSVTVPKFLVDLLSERKTIS |
| CafaOR18.3.11 | LIVVTITCESHLHSPMYFLLRNKSVLDIVFSSVTVPKFLVDLLSERKTIS |

|  | 110 | 120 | 130 | 140 | 150 |
|---|---|---|---|---|---|
| HsOR11.13.7 | YNGCMAQIFFFHFAGGADIFFLSVMAYDRYLAIAKPLHYVTMMRKEVWVA |
| CatGr6 | YNGCMAQIFFFHFAGGADIFFLSVMAYDRYLAIAKPLHYVTIMKREVWVG |
| CafaOR18.3.11 | YNGCMAQIFFFHFAGGADIFFLSVMAYDRYLAIAKPLHYVTIMRRETWVG |

|  | 160 | 170 | 180 | 190 | 200 |
|---|---|---|---|---|---|
| HsOR11.13.7 | LVVASWVSGGLHSIIQVILMLPFPFCGPNTLDAFYCYVLQVVKLACTDTF |
| CatGr6 | LVVASWVGGGLHSIVQIILMLPLSFCGPNILDAFYCDVPQVVKLACTDTF |
| CafaOR18.3.11 | LVVASWVGGGLHSIVQVTLMLPLPFCGPNILDAFYCDVPQVIKLACTNTF |

|  | 210 | 220 | 230 | 240 | 250 |
|---|---|---|---|---|---|
| HsOR11.13.7 | ALELFMISNNGLVTLLWFLLLLGSYTVILVMLRSHSGEGRNKALSTCTSH |
| CatGr6 | ALELLMISNNGLVTLLWFLLLLGSYTVILVMLRSHSGAGRNKALSTCTSH |
| CafaOR18.3.11 | ALELLMISNNGLVTLLWFLLLLGSYTVILVMLRSHSGEGRNKALSTCTSH |

|  | 260 | 270 | 280 | 290 | 300 |
|---|---|---|---|---|---|
| HsOR11.13.7 | MLVVTLHFVPCVYIYCRPFMTLPMDTTISINNTVITPMLNPIIYSLRNQE |
| CatGr6 | ILVVTLHFVPCVYIYCRPFTTLPMDTAVSINNTVITPMLNPMIYTLRNQE |
| CafaOR18.3.11 | IFVVTLHFVPCVYIYCRPFITLPMDTVVSINNTVITPMLNPMIYTLRNQE |

|  | 310 | 320 | 330 | 340 | 350 |
|---|---|---|---|---|---|
| HsOR11.13.7 | MKSAMQRLQRRLGPSESRKWG |
| CatGr6 | MKSAMKRLHRRLGPSESSKWG |
| CafaOR18.3.11 | MKSAMKRLQRRLGPSESS--- |

FIG. 7A

SEQ ID NOS 47, 37 and 57, respectively, in order of appearance

|  | 1        10        20        30        40        50 |
|---|---|
| CafaOR15.3.1 | MEAPNQTRVTEFVFLGLTDNWALGTLLFVAFSLAYVLTLLGNTLIIVTTA |
| HsOR14.2.5 | MDSLNQTRVTEFVFLGLTDNRVLEMLFFMAFSAIYMLTLSGNILIIIATV |
| CatG7 | MDALNQTRVTEFVFLGLTDKWVLEILFFLAFSVTYVLTLLGNTLIIVTIV |

|  | 60        70        80        90        100 |
|---|---|
| CafaOR15.3.1 | LTRRLHTPMYFFLSNLSFIDTCHSSVTVPKMLEGLLRERKTISFDDCIAQ |
| HsOR14.2.5 | FTPSLHTPMYFFLSNLSFIDICHSSVTVPKMLEGLLLERKTISFDNCITQ |
| CatG7 | FTPRLHTPMYFFLSNLSFIDICHSSVTVPKMLEGLLLEIKTISFDNCIAQ |

|  | 110        120        130        140        150 |
|---|---|
| CafaOR15.3.1 | LFFLHLFACAEILLLTVMAYDRYVAICAPLRYPNVMSIRVCVQLVLALWW |
| HsOR14.2.5 | LFFLHLFACAEIFLLIIMAYDRYVAICTPLHYPNVMNMRVCIQLVFALWL |
| CatG7 | LFFLHLFACAEIFLLTIMAYDRYVAICAPLHYSNVMNMRVCVQLVFALWL |

|  | 160        170        180        190        200 |
|---|---|
| CafaOR15.3.1 | GGTVHSLVQTLLTIRLPYCGPNVIDSYFCDVPPVIKLACTDTYLTGVLIV |
| HsOR14.2.5 | GGTVHSLGQTFLTIRLPYCGPNIIDSYFCDVPLVIKLACTDTYLTGILIV |
| CatG7 | GATVHSLVQTFLTIRLPYCGPNIIDSYFCDVPPVIKLACTDTYLTGMLIV |

|  | 210        220        230        240        250 |
|---|---|
| CafaOR15.3.1 | SNSGTISLTCFLALVTSYTIILVSLRKQSAEGRRKALSTCSAHFMVVAFF |
| HsOR14.2.5 | TNSGTISLSCFLAVVTSYMVILVSLRKHSAEGRRKALSTCSAHFMVVALF |
| CatG7 | SNSGTISLTCFLALVTSYTVILVSLRKQSAEGRRKALSTCSAHFMVVAFF |

|  | 260        270        280        290        300 |
|---|---|
| CafaOR15.3.1 | FGPCIFIYTRPDTSFSIDKVVSVFYTVVTPLLNPLIYTLRNEEVKSAIKH |
| HsOR14.2.5 | FGPCIFIYTRPDTSFSIDKVVSVFYTVVTPLLNPFIYTLRNEEVKSAMKQ |
| CatG7 | FGPCIFIYTRPDTSFSIDKVVSVFYTVVTPLLNPLIYTLRNEEVKSAMKH |

|  | 310        320        330        340        350 |
|---|---|
| CafaOR15.3.1 | LRQKQVFS----- |
| HsOR14.2.5 | LRQRQVFFTKSYT |
| CatG7 | LRQRGFFMKSGT- |

FIG. 8A

SEQ ID NOS 38, 58 and 48, respectively, in order of appearance

|  | 1 10 20 30 40 50 |
|---|---|
| HsOR16.1.3 | MDGVNDSSLQGFVLMGISDHPQLEMIFFIAILFSYLLTLLGNSTIILLSR |
| CatG8 | MAEANNSFSEGCILMGISDHPQLEIVFFIVILFSYSLTLVGNSTTILLSC |
| CafaOR6.3.1 | MPEANDSFLEGFILMGISDHPQLEIIFFMVILFSYLLTLLGNSTIILLSW |

|  | 60 70 80 90 100 |
|---|---|
| HsOR16.1.3 | LEARLHTPMYFFLSNLSSLDLAFATSSVPQMLINLWGPGKTISYGGCITQ |
| CatG8 | LDARLHTPMYFFLSNLSSLDLAFTTSSVPQMLTNLWGPDKTISYAGCVIQ |
| CafaOR6.3.1 | LDARLHTPMYFFLSNLSTLDLAFTTSSVPQMLINLWGPDKTISYGGCVTQ |

|  | 110 120 130 140 150 |
|---|---|
| HsOR16.1.3 | LYVFLWLGATECILLVVMAFDRYVAVCRPLRYTAIMNPQLCWLLAVIAWL |
| CatG8 | LYVFLWLGATECILLVVMAFDRHVAVCQPLRYTVIVSPRLCRLLAAIAWL |
| CafaOR6.3.1 | LYVFLWLGATECILLVVMAFDRYVAVCRPLHYTTIMNPRLCWLLAAIAWL |

|  | 160 170 180 190 200 |
|---|---|
| HsOR16.1.3 | GGLGNSVIQSTFTLQLPLCGHRRVEGFLCEVPAMIKLACGDTSLNQAVLN |
| CatG8 | GGLSNSMIQSTFTLQLPLCGHRRVDNFLCEVPAMIKLACGDTSLNEAVLN |
| CafaOR6.3.1 | GGLSNSVIQSTFTLQLPLCGHRRVDNFLCEVPAMIKLACGDTSLNEVVLN |

|  | 210 220 230 240 250 |
|---|---|
| HsOR16.1.3 | GVCTFFTAVPLSIIVISYCLIAQAVLKIRSAEGRRKAFNTCLSHLLVVFL |
| CatG8 | GVCTFFTAVPLSIILISYCSIARAVLKIRSAEGQRKAFNTCLSHLVVVLL |
| CafaOR6.3.1 | GVCTFFTAVPLSVILISYCYIAQAVLKIHSVEGQRKAFNTCLSHLVVVLL |

|  | 260 270 280 290 300 |
|---|---|
| HsOR16.1.3 | FYGSASYGYLLPAKNSKQDQGKFISLFYSLVTPMVNPLIYTLRNMEVKGA |
| CatG8 | FYGSAIYGYLLPAKTSHQGQGKFISLFYSVVTPMVNPLIYTLRNKEVKAA |
| CafaOR6.3.1 | FYGSAIYGYLLPAKTSNQDQGKFISLFYSVVTPTVNPLIYTLRNREVKGA |

|  | 310 320 330 340 350 |
|---|---|
| HsOR16.1.3 | LRRLLGKGREVG |
| CatG8 | LRRLRGKGREFG |
| CafaOR6.3.1 | LRRLLGKGRSLG |

FIG. 9A

SEQ ID NOS 49, 59 and 39, respectively, in order of appearance

|   | 1 | 10 | 20 | 30 | 40 | 50 |
|---|---|---|---|---|---|---|
| CafaOR18.3.12 | ---MSTVKAWNSSSVTMFILLGFADHPELQTLLFVTFLSIYLVTLAWNLA | | | | | |
| CatG9 | MRSMSTAKAWNSSSVTMFIFLGFADHPELQTLLFVTFLGIYLVTLAWNLA | | | | | |
| HsOR11.13.6 | ---MSITKAWNSSSVTMFILLGFTDHPELQALLFVTFLGIYLTTLAWNLA | | | | | |

|   | 60 | 70 | 80 | 90 | 100 |
|---|---|---|---|---|---|
| CafaOR18.3.12 | LIFLIRSDPHLHTPMYFFLSNLSFIDICYSSTVAPKMLTDFFQEQKTISF | | | | |
| CatG9 | LIFLIRGDPRLHTPMYFFLSNLSFIDICYSSTVAPKMLTDFFWEQKTISF | | | | |
| HsOR11.13.6 | LIFLIRGDTHLHTPMYFFLSNLSFIDICYSSAVAPNMLTDFFWEQKTISF | | | | |

|   | 110 | 120 | 130 | 140 | 150 |
|---|---|---|---|---|---|
| CafaOR18.3.12 | LGCAAQFFFFVSMGLTECFLLTAMAYDRYAAISNPLLYTAIMSQGLCTRM | | | | |
| CatG9 | LGCAAQFFFFVSMGLTECFLLTAMAYDRYAAISNPLLYTAIMSQGLCTRM | | | | |
| HsOR11.13.6 | VGCAAQFFFFVGMGLSECLLLTAMAYDRYAAISSPLLYPTIMTQGLCTRM | | | | |

|   | 160 | 170 | 180 | 190 | 200 |
|---|---|---|---|---|---|
| CafaOR18.3.12 | VLGAYVGGFLSSLIQAISIFQLHFCGPNIINHFFCDLPPVLALSCSDTFP | | | | |
| CatG9 | VLGAYVGGFLSSLIQASSIFQLHFCGPNIINHFFCDLPPVLALSCSDTFP | | | | |
| HsOR11.13.6 | VVGAYVGGFLSSLIQASSIFRLHFCGPNIINHFFCDLPPVLALSCSDTFL | | | | |

|   | 210 | 220 | 230 | 240 | 250 |
|---|---|---|---|---|---|
| CafaOR18.3.12 | SQVVNFLIVITVGGTSFLILLISYSYIGAAVLKIRSVEGRRKAFNTCASH | | | | |
| CatG9 | SQVVNFLVVVTIGGTSFLILIISYSYIGTAVLKIRSVEGRKKAFSTCASH | | | | |
| HsOR11.13.6 | SQVVNFLVVVTVGGTSFLQLLISYGYIVSAVLKIPSAEGRWKACNTCASH | | | | |

|   | 260 | 270 | 280 | 290 | 300 |
|---|---|---|---|---|---|
| CafaOR18.3.12 | LMVVTLLFGTALFMYLRPSSSYSLARDKVVSVFYSLVIPMLNPLIYSLRN | | | | |
| CatG9 | LMVVTLLFGTALFMYLRPSSSYSLGRDKVVSVFYSLVIPMLNPLIYSLRN | | | | |
| HsOR11.13.6 | LMVVTLLFGTALFVYLRPSSSYLLGRDKVVSVFYSLVIPMLNPLIYSLRN | | | | |

|   | 310 | 320 | 330 | 340 | 350 |
|---|---|---|---|---|---|
| CafaOR18.3.12 | RDIKDALWKALEKKKVFFLDHD | | | | |
| CatG9 | REIKDALWKVLEKKKLFS---- | | | | |
| HsOR11.13.6 | KEIKDALWKVLERKKVFS---- | | | | |

FIG. 10A

SEQ ID NOS 60, 3,809, 50 and 40, respectively, in order of appearance

|  | 1 10 20 30 40 50 |
|---|---|
| CatG10 | MPLMRMAAENS-SVTEFILAGLTNQPGLRMPLFFLFLGFYVVTVMGNLGL |
| Olfr145 | -----MATENA-SVPEFILAGLTDQPGLRMPLFFLFLGFYMVTMVGNLGL |
| CafaOR5.2.5 | MPLMRMAAENS-SVTEFILSGLTNQPGLQIPLFFLFLGFYVVTVVGNLGL |
| HsOR11.18.36 | -----MAAENSSFVTQFILAGLTDQPGVQIPLFFLFLGFYVVTVVGNLGL |
|  | 60 70 80 90 100 |
| CatG10 | ITLIGLNSHLHTPMYFFLFNLSFIDFQYSTVITPKMLMSFVS-KNTIAYA |
| Olfr145 | ITLIGLNSHLHTPMYFFLFNLSLIDFQYSTVITPKMLMSFVSKKNIISYS |
| CafaOR5.2.5 | ITLIGLNSHLHTPMYFFLFNLSFIDFQYSTVITPKMLMNFVLRKNVISYA |
| HsOR11.18.36 | ITLIRLNSHLHTPMYFFLYNLSFIDFQYSSVITPKMLMSFVLKKNSISYA |
|  | 110 120 130 140 150 |
| CatG10 | GCMTQLFFFLFFVVSEEFILSAMAYDRYTAICNPLVYTATMSPQVCSLLL |
| Olfr145 | GCMTQLFFFLFFVVSEEFILSAMAYDRYVAICNPLMYTVTMSPQVCLLLL |
| CafaOR5.2.5 | GCMTQLFFFLFFVVSEEFILSAMAYDRYAAICNPLVYTATMSPQVCFLLL |
| HsOR11.18.36 | GCMTQLFFFLFFVVSEEFILSAMAYDRYVAICNPLLYMVTMSPQVCFLLL |
|  | 160 170 180 190 200 |
| CatG10 | LGVYVMGFAGAMAHTTCMVRLTFCANNLVDHYMCDILPLLERSCTSTYVN |
| Olfr145 | LGVYVMGFAGAMAHTAFMVKLTFCADKLVNHYMCDILPLLERSCTSTYVN |
| CafaOR5.2.5 | LGVYVMGFAGAMAHTVCMVRLTFCANNLVDHYMCDILPLLERSCTSTYVN |
| HsOR11.18.36 | LGVYGMGFAGAMAHTACMMGVTFCANNLVNHYMCDILPLLECACTSTYVN |
|  | 210 220 230 240 250 |
| CatG10 | ELVVFVVVGIDIGVPTVTIFISYALILTSILHIRSTEGRSKAFSTCSSHI |
| Olfr145 | ELVVFIVVGIDIGVPTVTIFISYALILSSILRISSTEGRSKAFSTCSSHI |
| CafaOR5.2.5 | ELVVFIVVGIDIGVPTVTIFISYALILSSILRIHSTKGRSKAFSTCSSHI |
| HsOR11.18.36 | ELVVFVVVGIDIGVPTVTIFISYALILSSIFHIDSTEGRSKAFSTCSSHI |
|  | 260 270 280 290 300 |
| CatG10 | IAVSLFFGSGAFMYLKPSSLLPMNQGKVSSLFYTTVVPMLNPLIYSLRNK |
| Olfr145 | IAVSLFFGSGAFMYLKPSSLLPMNQGKVSSLFYTIVVPMLNPLIYSLRNK |
| CafaOR5.2.5 | IAVSLFFGSGAFMYLKPSSLLPMNQGKVSSLFYTIVVPMLNPLIYSLRNK |
| HsOR11.18.36 | IAVSLFFGSGAFMYLKPFSLLAMNQGKVSSLFYTTVVPMLNPLIYSLRNK |
|  | 310 320 330 340 350 |
| CatG10 | DVKVALKKSLSKKTFS |
| Olfr145 | DVKVALRKTLSRSSFS |
| CafaOR5.2.5 | DVKIALKKTLSKKPFS |
| HsOR11.18.36 | DVKVALKKILNKNAFS |

FIG. 11A

| Dog OR | | Odorant | Response | EC$_{50}$ | Emax | Assay |
|---|---|---|---|---|---|---|
| OR_2 | OR6P1 | p-Anisaldehyde | Active | 30μM | 63.5 | CRE-NanoLuc |
| | | 4-Ethoxybenzaldehyde | Active | 35μM | 39 | CRE-NanoLuc |
| OR_3 | OR51E1 | Isovaleric acid | Active | 30μM | 91 | CNG |
| | | 4-Methylvaleric acid | Active | 35μM | 90 | CNG |
| | | Hexanoic acid | Active | 90μM | 74 | CNG |
| | | 3-Methyl-2-hexanoic acid | Low activity | >100μM | 8 | CNG |
| OR_4 | OR51L1 | Hexanoic acid | Inactive | — | 1.6 | CRE-NanoLuc |
| | | Allyl phenylacetate | Active | >100μM | 2.9 | CRE-NanoLuc |
| OR_8 | OR2C1 | Nonanethiol | Active | 2μM | 6.3 | CNG |
| | | Isovaleric acid | Active | n.d. | 6.8 | CRE-NanoLuc |
| OR_9 | OR5A1 | Citral | Active | 1μM | 3.6 | CRE-NanoLuc |
| | | Amyl acetate | Active | 2μM | 6.1 | CRE-NanoLuc |
| | | β-Ionone | Active | 1μM | 6.1 | CRE-NanoLuc |
| OR_10 | OR8B8 | Acetophenone | Active | 110μM | 33 | CRE-NanoLuc |
| | | Propriophenone | Active | 75μM | 9.6 | CRE-NanoLuc |
| | | Coumarin | Active | 125μM | 44 | CRE-NanoLuc |

Inactive | Doubtful response, very low activity | Active, but low activity and/or EC$_{50}$ cannot be determined | Active

FIG. 16

| Cat OR | | Odorant | Response | EC$_{50}$ | Emax | Assay |
|---|---|---|---|---|---|---|
| OR_2 | OR6P1 | p-Anisaldehyde | Active | ~100μM | 17.3 | CRE-NanoLuc |
| | | 4-Ethoxybenzaldehyde | Active | 165μM | 13.1 | CRE-NanoLuc |
| OR_3 | OR51E1 | Isovaleric acid | Active | 45μM | 93 | CNG |
| | | 4-Methylvaleric acid | Active | 45μM | 78 | CNG |
| | | Hexanoic acid | Active | 125μM | 41 | CNG |
| | | 3-Methyl-2-hexanoic acid | Low activity | >100μM | 3 | CNG |
| OR_4 | OR51L1 | Hexanoic acid | Active | >50μM | 3 | CRE-NanoLuc |
| | | Allyl phenylacetate | Active | >100μM | 8.6 | CRE-NanoLuc |
| OR_8 | OR2C1 | Nonanethiol | Active | 2μM | 4.5 | CNG |
| OR_9 | OR5A1 | Isovaleric acid | Active | 20μM | 78 | CRE-NanoLuc |
| | | Citral | Active | 4μM | 43 | CRE-NanoLuc |
| | | Amyl acetate | Active | 5μM | 64 | CRE-NanoLuc |
| | | β-Ionone | Active | 3μM | 84 | CRE-NanoLuc |
| OR_10 | OR8B8 | Acetophenone | Inactive | — | 1.4 | CRE-NanoLuc |
| | | Propriophenone | Inactive | — | 1.1 | CRE-NanoLuc |
| | | Coumarin | Active | n.d. | 2.7 | CRE-NanoLuc |

Inactive | Doubtful response, very low activity | Active, but low activity and/or EC$_{50}$ cannot be determined | Active

FIG. 17

SCREENING METHODS USING OLFACTORY RECEPTORS AND NOVEL COMPOUNDS IDENTIFIED USING THE SAME

CROSS-REFERENCE TO RELATED APPLICATION

This application is a U.S. National Stage Patent Application under 35 U.S.C. § 371 of International Application No. PCT/US2017/054620, filed on Sep. 29, 2017, which claims priority to U.S. Provisional Application No. 62/402,823 filed on Sep. 30, 2016, the contents of each of which are incorporated by reference in their entireties, and to which priority is claimed.

SEQUENCE LISTING

The application contains a Sequence Listing which has been filed electronically in ASCII format and is hereby incorporated by reference in its entirety. Said ASCII copy, created on Mar. 15, 2019, is named 0692690314SL.txt and is 7,123,648 bytes in size. The Sequence Listing, electronically filed herewith, does not extend beyond the scope of the specification and thus does not contain new matter.

FIELD

The presently disclosed subject matter relates to the use of olfactory receptors (ORs) for the identification of olfactory modulators. The presently disclosed subject matter further relates to the use of olfactory receptors to screen raw materials for making pet food products, as well as screening finished pet food products, for the presence of olfactory modulating compounds.

BACKGROUND

Olfactory profiles for edible compositions can be characterized by a set of psychophysical descriptors, such as, for example, one or more of a fruity, floral, honey, fatty, minty and metallic smell. In certain embodiments, a combination of different odorants can be perceived as a new odor object. Chemical compounds that elicit these odor senses are often referred to as odorants. Without being bound by theory, it is hypothesized that odors are sensed by olfactory receptors in the nasal cavity and throat which transmit signals to the brain where the odorants and resulting olfactory profiles are registered. Olfactory receptors comprise a large class of G-protein coupled receptors (GPCR) that detect compounds associated with odor sensory perception.

Pet food manufacturers have a long-standing desire to provide pet food products that have high nutritional value. In addition, and with particular regard to cat and dog foods, pet food manufacturers desire a high degree of palatability so that pets can receive the full nutritional benefit from their food. Domestic animals are notoriously finicky in their food preferences, and often refuse to eat a pet food product that it has accepted over time or refuse to eat any more than a minimal amount of a pet food product. This phenomenon may be, in part, due to the subtle differences in the sensory profiles of the raw material, which can be perceived by the domestic animals because of their gustatory and olfactory systems. As a result, pet owners frequently change types and brands of pet food in order to maintain their pets in a healthy and contented condition.

While there have been recent advances in odor and flavor technologies, there remains a need for methods of screening raw materials that are used to make pet food product, and for screening finished pet food products, to ensure that the most palatable products and processes for making the pet food products are used. There also remains a need for compounds that can enhance or modify the palatability of pet food products by enhancing or modifying the odor, texture and/or flavor profiles of the pet food products. The enhancement or modification can be used to increase the intensity of a desirable attribute, to replace a desirable attribute that is not present or somehow lost in the pet food product, or to decrease the intensity of an undesirable attribute. In particular, it is desirable to decrease the presence or intensity of undesirable repellant odors in a pet food product. Similarly, there is a need to increase the acceptance of pet medications by enhancing or modifying the palatability of the medications.

The pet care industry is also concerned with developing odor deterrents that can effectively discourage a pet from scratching, chewing, licking, or ingesting things that harm the health of the animal or the property of the owners. While it is known that certain odorants can be effective to deter pets, there is a significant variation in pets' reactions to these odor deterrents. Thus, there exists a need for compounds that effectively impart an undesirable odor to harmful or toxic objects.

Therefore, there remains a need in the art for methods to screen raw pet food materials (e.g. new protein sources), as well as final pet food products, to provide fragrant, palatable and nutritious pet food. There also remains a need to identify compounds that enhance, decrease, or otherwise modulate the palatability and/or deterrence of pet food products, or objects, and for odor compositions comprising these compounds.

SUMMARY OF THE INVENTION

The presently disclosed subject matter provides methods for identifying compounds that enhance, increase, decrease and/or modulate the activity and/or expression of an olfactory receptor. In certain embodiments, the methods entail screening for compounds that modulate the olfactory receptor activity and/or expression in a pet food product or medicine, or in raw materials used to make the pet food product or medicine. The presently disclosed subject matter also provides compounds that enhance, increase, decrease and/or modulate the activity and/or expression of an olfactory receptor identified by said methods. In certain embodiments, the olfactory receptor is a canine or feline receptor.

In certain embodiments, the method for identifying compounds that enhance, increase, decrease and/or modulate the activity and/or expression of an olfactory receptor comprises expressing an olfactory receptor having a nucleotide sequence set forth in any one or more of SEQ ID NOs:11-30, or any one or more of the nucleotide sequences set forth in SEQ ID NOs:61-3808, or a fragment or variant thereof, in a cell. The method can further comprise contacting the cell expressing the olfactory receptor with a sample (e.g., pet food raw material, finished pet food, or a test compound) and determining the activity and/or expression of the olfactory receptor in the presence of the sample as compared to the activity and/or expression of the receptor in the absence of the sample. In certain embodiments, the activity and/or expression of the olfactory receptor is determined in the presence of the sample and an olfactory receptor agonist.

In certain embodiments, a method for identifying compounds that enhance, increase, decrease and/or modulate the activity and/or expression of an olfactory receptor comprises expressing an olfactory receptor having an amino acid sequence set forth in any one or more of SEQ ID NOs:41-60, or any one or more of amino acid sequence set forth in SEQ ID NOs:61-3808, or a fragment or variant thereof, in a cell. The method can further comprise contacting the cell expressing the olfactory receptor with a sample (e.g., pet food raw material, finished pet food, or a test compound) and determining the activity and/or expression of the olfactory receptor in the presence of the sample as compared to the activity and/or expression of the receptor in the absence of the sample. In certain embodiments, the activity and/or expression of the olfactory receptor is determined in the presence of the sample and an olfactory receptor agonist.

In certain embodiments, the present disclosure provides a method for identifying a composition that modulates the activity of an olfactory receptor comprising (a) contacting an olfactory receptor agonist with an olfactory receptor, (b) determining the activity of the olfactory receptor, (c) contacting a test agent with the olfactory receptor, (d) determining the activity of the olfactory receptor, and (e) selecting the test agent as the composition when the activity of (d) is greater than or less than the activity of (b).

In certain embodiments, the olfactory receptor agonist is selected from the group consisting of trifernal, isovaleric acid, 3-methyl-2-hexanoic acid, alpha-ionone, hexyl acetate, amyl mercaptan, helional, para-anisaldehyde, 4-ethoxybenzaldehyde, menthol, methyl-eugenol, methyl-salicylate, phenylacetaldehyde, beta-ionone, amyl acetate, nonanethiol, acetophenone, coumarin, lilial, meta-anisaldehyde, 4-methyl-valeric acid, pentanol, allyl-phenylacetate, hexanoic acid, alpha-ionone, citral, isoamylacetate, octanethiol, propiophenone, 7-methoxycoumarin and combinations thereof.

In certain non-limiting embodiments, the methods for identifying a compound that modulates the activity of an olfactory receptor described herein utilize cells expressing an olfactory receptor that is native to the cells. Examples of such cells expressing a native olfactory receptor include, for example but not limited to, human, dog and/or cat olfactory cells (e.g., olfactory receptor cells). In certain embodiments, the human, dog and/or cat olfactory cells expressing an olfactory receptor are isolated from a human, dog and/or cat and cultured in vitro. In certain embodiments, the olfactory receptor cells can be immortalized, for example, such that the cells isolated from a human, dog and/or cat can be propagated in culture.

In certain embodiments, the cell expresses a calcium-binding photoprotein, a cyclic nucleotide gated (CNG) channel, a cAMP response element (CRE)-containing luciferase reporter, a GloSensor luciferase, or a PKA-NanoBiT system. In certain embodiments, the calcium-binding photoprotein is selected from the group consisting of clytin, aequorin, obelin, any recombinant or isolated versions thereof, and any combinations thereof. In certain embodiments, an intracellular calcium level is monitored by luminescence detection or fluorescence detection. In certain embodiments, the fluorescence detection comprises a calcium sensitive fluorescent dye selected from the group consisting of Fura-2 AM, Fura-2 pentapotassium, Fura Red AM, Indo-1 AM, Indo-1 pentapotassium, Fluo-3, Fluo-4, Fluo-8, Calcium Green-1, Calcium 3, Calcium 4, Calcium 5, Rhod-2, derivatives thereof and combinations thereof.

In certain embodiments, the test agent has an EC50 value of no more than about 200 µM. In certain embodiments, the test agent has an Emax value of no less than about 2.0.

The present disclosure also provides for methods for identifying compounds that enhance, increase, decrease and/or modulate the activity and/or expression of an olfactory receptor, wherein the assay is conducted using a cell-free assay, for example, wherein the olfactory receptor is bound to or otherwise attached to a substrate.

The present disclosure also provides for methods for identifying compounds that enhance, increase, decrease and/or modulate the activity and/or expression of an olfactory receptor, wherein the assay is conducted using an in silico model of the olfactory receptor, for example, wherein the olfactory receptor is modeled using a computer program and binding of the compound to the receptor is predicted through docking algorithms.

The presently disclosed subject matter further provides a method for making a palatable pet food product, wherein the raw materials used to generate the pet food product are screened to determine if they contain compounds that enhance, increase, decrease and/or modulate the activity and/or expression of an olfactory receptor. In certain embodiments, the raw material is a novel protein source. In certain embodiments the raw material is a protein source that is not commonly consumed in the human food chain. In certain embodiments, a raw pet food product that comprises a compound that increases the activity and/or expression of an olfactory receptor (for example, as compared to an olfactory receptor not contacted with the raw material) is not selected for use in generating a finished pet food product. In certain embodiments, a raw pet food product that comprises a compound that increases the activity and/or expression of an olfactory receptor (for example, as compared to an olfactory receptor not contacted with the raw material) is selected for use in generating a finished pet food product. In other embodiments, a raw pet food material that does not increase the activity and/or expression of an olfactory receptor (or that reduces the activity of an olfactory receptor, for example, in the presence of an olfactory receptor agonist) is selected for generating a finished pet food product. In other embodiments, a raw pet food material that does not increase the activity and/or expression of an olfactory receptor (or that reduces the activity of an olfactory receptor, for example, in the presence of an olfactory receptor agonist) is not selected for generating a finished pet food product.

The presently disclosed subject matter further provides a method for making a palatable pet food product, wherein the finished pet food product is screened to determine if it contains compounds that enhance, increase, decrease and/or modulate the activity and/or expression of an olfactory receptor. In certain embodiments, the compounds are formed during the manufacturing process. In one embodiment, a finished pet food product that comprises a compound that increases the activity and/or expression of an olfactory receptor (for example, as compared to an olfactory receptor not contacted with the finished pet food product) is supplemented with one or more compounds that decrease the activity and/or expression of an olfactory receptor (for example, an antagonist compound). In one embodiment, a finished pet food product that comprises a compound that decreases the activity and/or expression of an olfactory receptor (for example, as compared to an olfactory receptor not contacted with the finished pet food product, or as compared to an olfactory receptor contacted with an agonist) is supplemented with one or more compounds that increases the activity and/or expression of an olfactory receptor (for example, an agonist compound).

The presently disclosed subject matter further provides a method for making a palatable pet medicine product, wherein the finished pet medicine product is screened to determine if it contains compounds that enhance, increase, decrease and/or modulate the activity and/or expression of an olfactory receptor. In certain embodiments, the compounds are formed during the manufacturing process. In one embodiment, a finished pet medicine product that comprises a compound that increases the activity and/or expression of an olfactory receptor (for example, as compared to an olfactory receptor not contacted with the finished pet medicine product) is supplemented with one or more compounds that decrease the activity and/or expression of an olfactory receptor (for example, an antagonist compound). In one embodiment, a finished pet medicine product that comprises a compound that decreases the activity and/or expression of an olfactory receptor (for example, as compared to an olfactory receptor not contacted with the finished pet medicine product, or as compared to an olfactory receptor contacted with an agonist) is supplemented with one or more compounds that increases the activity and/or expression of an olfactory receptor (for example, an agonist compound).

The presently disclosed subject matter further provides flavor compositions that comprise a modulator of an olfactory receptor, e.g., an agonist and/or an antagonist and/or an allosteric modulator and/or an inverse agonist, identified according to the methods described herein.

In certain embodiments, said compounds can be used in methods for maintaining the health of an animal by imparting a repellant odor and/or decreasing the palatability of an object or surface. In certain embodiments, the method comprises applying an odor deterrent product comprising a compound as described herein to the object or surface. In certain embodiments, the object is harmful to the health of the animal or toxic to the animal.

The foregoing has outlined rather broadly the features and technical advantages of the present application in order that the detailed description that follows may be better understood. Additional features and advantages of the application will be described hereinafter which form the subject of the claims of the application. It should be appreciated by those skilled in the art that the conception and specific embodiment disclosed may be readily utilized as a basis for modifying or designing other structures for carrying out the same purposes of the present application. It should also be realized by those skilled in the art that such equivalent constructions do not depart from the spirit and scope of the application as set forth in the appended claims. The novel features which are believed to be characteristic of the application, both as to its organization and method of operation, together with further objects and advantages will be better understood from the following description.

BRIEF DESCRIPTION OF THE DRAWINGS

FIG. 1 shows human, canine and feline olfactory receptor (OR) nucleotide sequences (SEQ ID NOs:1-30) along with their corresponding amino acid sequences (SEQ ID NOs: 31-60). The sequences include the human olfactory receptor HsOR17.1.11 (hOR3A1), HsOR1.4.8 (hOR6P1), HsOR11.3.14 (hOR51E1), HsOR11.3.40 (hOR51L1), HsOR14.1.27 (hOR11H6), HsOR11.13.7 (hOR4D6), HsOR14.2.5 (hOR4E2), HsOR16.1.3 (hOR2C1), HsOR11.13.6 (hOR5A1), and HsOR11.18.36 (hOR8B8); the canine olfactory receptor CafaOR9.2.9, CafaOR38.1.21, CafaOR21.2.15, CafaOR21.2.43, CafaOR15.2.20, CafaOR18.3.11, CafaOR15.3.1, CafaOR6.3.1, CafaOR18.3.12, and CafaOR5.2.5; and the feline olfactory receptor E1:13347030-13347977, F1:65134904-65135858, D1:62955839-62956792, D1:63312327-63313289, B3:72908295-72909287, D1:105486528-105487493, B3:74116955-74117893, E3:40237904-40238842, D1:105462554-105463512, and D1:21266824-21267768.

FIGS. 2A-2E. A) Alignment of canine, feline, and human olfactory receptor sequences as labeled (SEQ ID NOs:41, 51 and 31, respectively, in order of appearance). The active site, defined as those residues within 9 Å(1 Å=$10^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (Lilial) used in the modeling. C) A near view of the ligand bound to the canine receptor CafaOR9.2.9. The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make hydrogen bond with the ligand include Gln103. Additional residues that can potentially make ring stacking, salt bridges, hydrogen bonding, pi interactions, charged interactions, van der Waals interactions, or hydrophobic interactions with the ligand include Leu104, Lys275, Arg87, Val81, Met84, Val279, Tyr262, Met209, Gly258, Val111, Tyr255, Thr282, Phe107 and Thr80.

FIGS. 3A-3E. A) Alignment of canine, feline, and human olfactory receptor sequences as labeled (SEQ ID NOs: 52, 32 and 42, respectively, in order of appearance). The active site, defined as those residues within 9 Å(1 Å=$10^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (p-Anisaldehyde) used in the modeling. C) A near view of the ligand bound to the canine receptor CafaOR38.1.21. The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make hydrogen bond with the ligand include Lys273. Additional residues that can potentially make ring stacking, salt bridges, hydrogen bonding, pi interactions, charged interactions, van der Waals, or hydrophobic interactions with the ligand include Thr78, Leu82, Tyr260, Thr256, Tyr253 and Phe105.

FIGS. 4A-4E. A) Alignment of canine, feline, and human olfactory receptor sequences as labeled (SEQ ID NOs: 43, 53 and 33, respectively, in order of appearance). The active site, defined as those residues within 9 Å(1 Å=$10^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand ((+)-menthol) used in the modeling. C) A near view of the ligand bound to the canine receptor CafaOR21.2.15. The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make ring stacking, salt bridges, hydrogen bonding, pi interactions, charged interactions, van der Waals, or hydrophobic interactions with the ligand include Met83, His107, Ile106, Leu182, Asn197, Gly201, Val204, Ser260, Phe256 and Leu273. Additional residues that can potentially make van der Waals or hydrophobic interaction with the ligand include Met103.

FIGS. 5A-5E. A) Alignment of canine, feline, and human olfactory receptor sequences as labeled (SEQ ID NOs:34, 44 and 54, respectively, in order of appearance). The active site, defined as those residues within 9 Å(1 Å=$10^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (Androstadienone) used in the modeling. C) A near view of the ligand bound to the canine receptor CafaOR21.2.43. The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make ring stacking, salt bridges, hydrogen bonding, pi interactions, charged interactions, van der Waals, or hydrophobic interactions with the ligand include Met80, Met88, Leu108, Ile111, His112, Thr115, Val209, Val210, Thr213, Leu214, Val262, Ile263, Ser266, Ile281, Ala284, and Leu288. Additional residues that can potentially make van der Waals or hydrophobic interaction with the ligand include Asp285.

FIGS. 6A-6E. A) Alignment of canine, feline, and human olfactory receptor sequences as labeled (SEQ ID NOs:35, 45 and 55, respectively, in order of appearance). The active site, defined as those residues within 9 Å(1 Å=$10^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (isobuteric acid) used in the modeling. C) A near view of the ligand bound to the feline receptor catGr5 (B3: 72908295-72909287). The figure illustrates where the compound binds within the seven-helical transmembrane-domain (7TM) of the chosen receptor. D) A near view of the ligand bound the receptor that illustrates residues defining the environment of the bound ligand. A smaller number of residues is chosen relative to those highlighted in A) for ease of viewing. E) An interaction map of the ligand bound to the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make hydrogen bond with the ligand include Tyr277. Additional residues that can potentially make ring stacking, salt bridges, hydrogen bonding, pi interactions, charged interactions, van der Waals, or hydrophobic interactions with the ligand include Phe119, Pro177, Leu180, Ile181, Pro199, Cys217, and Phe220. Additional residues that can potentially make van der Waals or hydrophobic interaction with the ligand include Tyr277 and Lys290.

FIGS. 7A-7E. A) Alignment of canine, feline, and human olfactory receptor sequences as labeled (SEQ ID NOs:36, 56 and 46, respectively, in order of appearance). The active site, defined as those residues within 9 Å(1 Å=$10^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (β-ionone) used in the modeling. C) A near view of the ligand bound to the feline receptor catGr6 (D1:

Figure 2B:
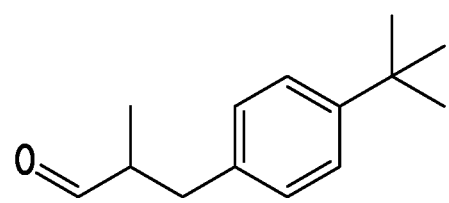
Figure 2C:
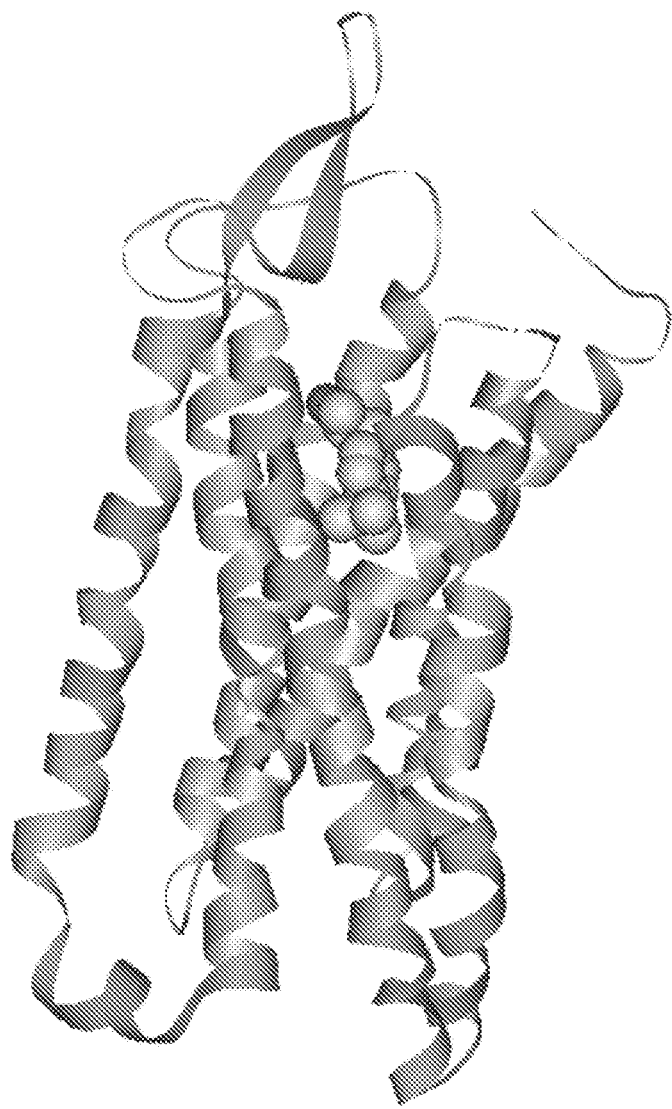
Figure 2D:
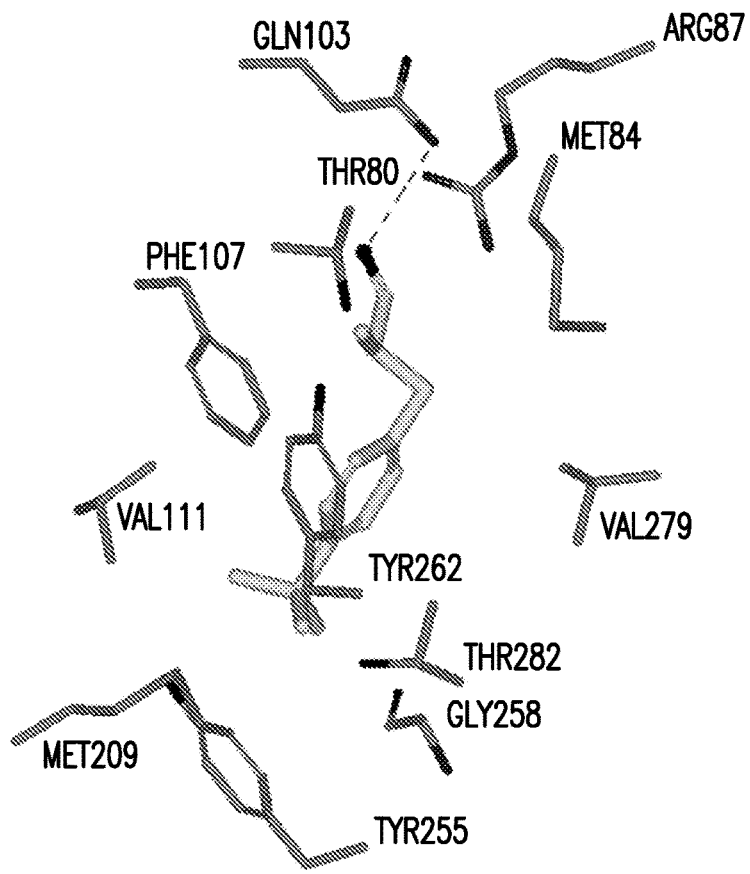
Figure 2E:
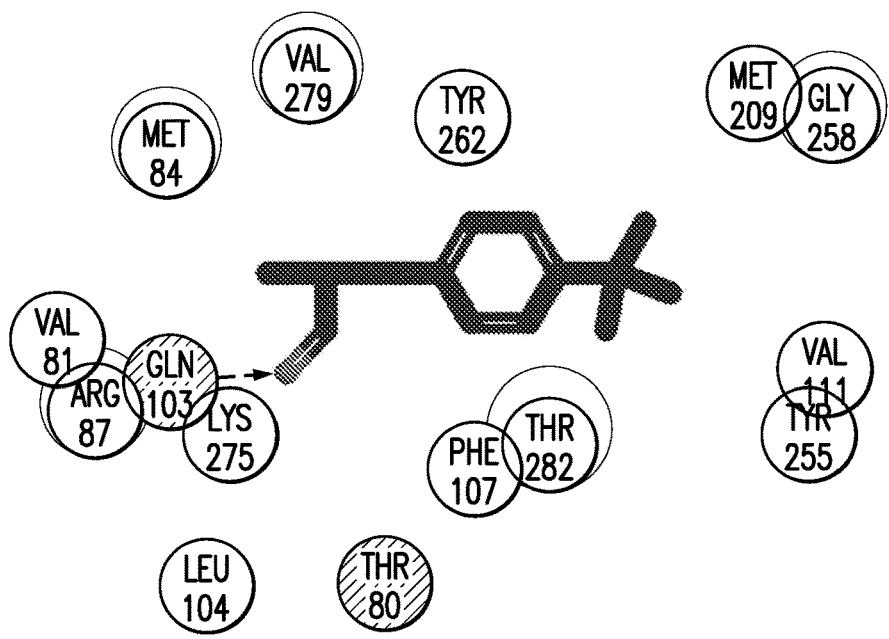
Figure 3B:
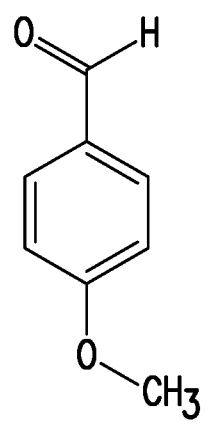
Figure 3C:
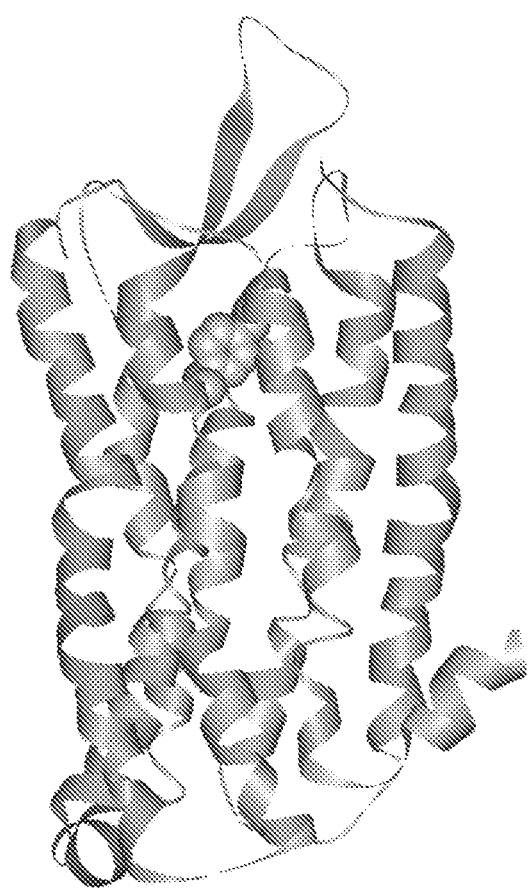
Figure 3D:
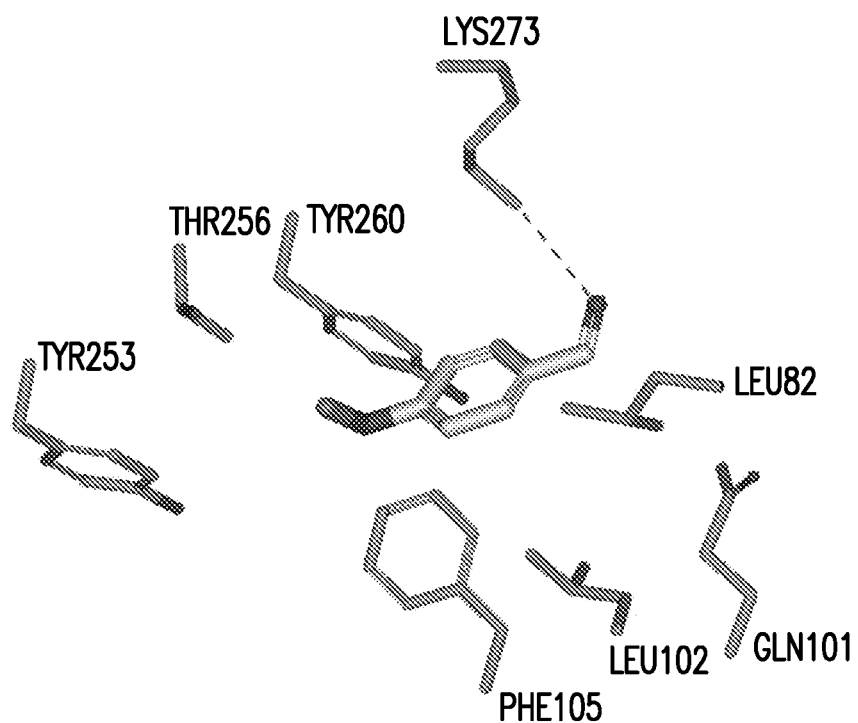
Figure 3E:
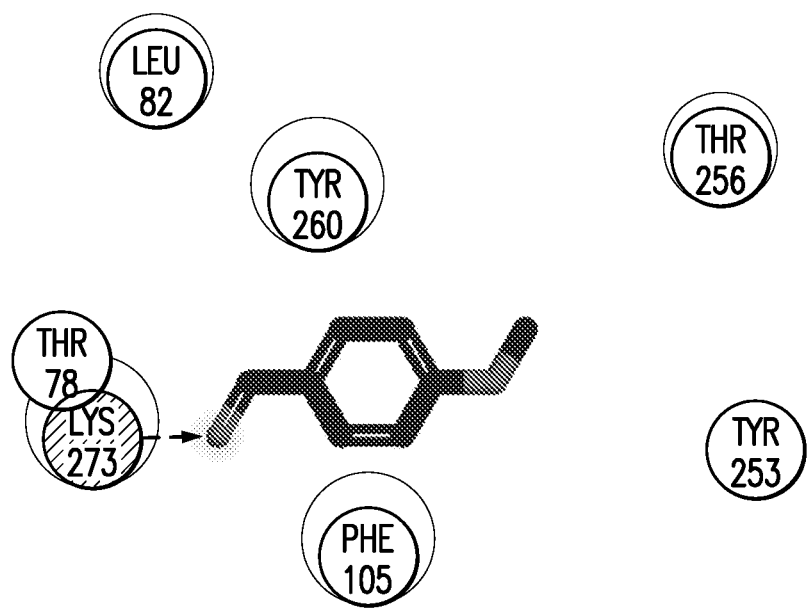
Figure 4B:
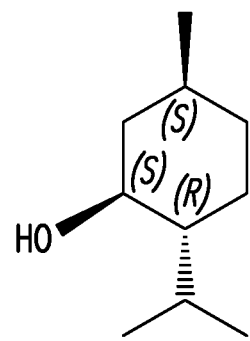
Figure 4C:
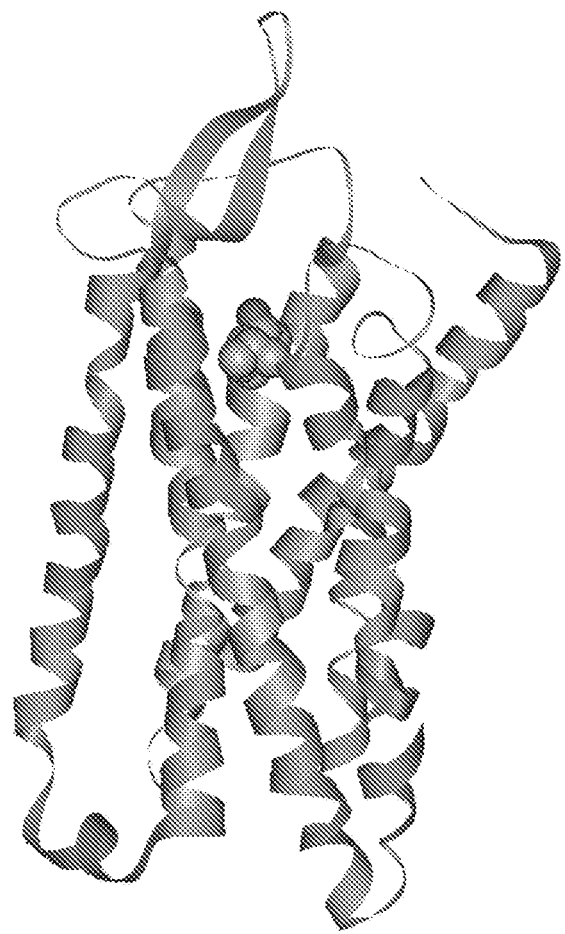
Figure 4D:
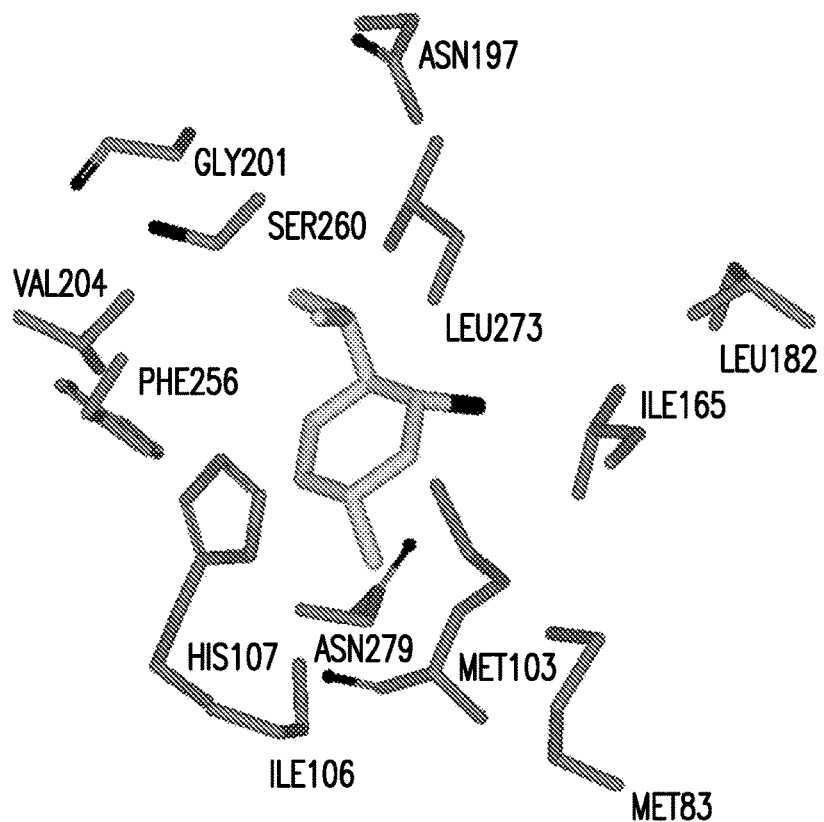
Figure 4E:
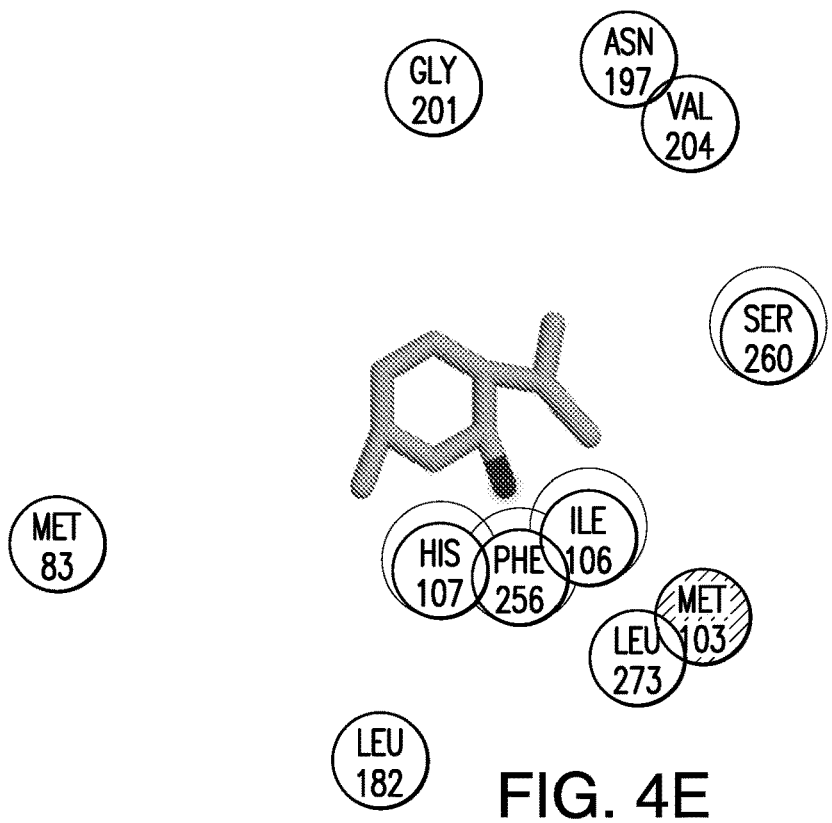
Figure 5B:
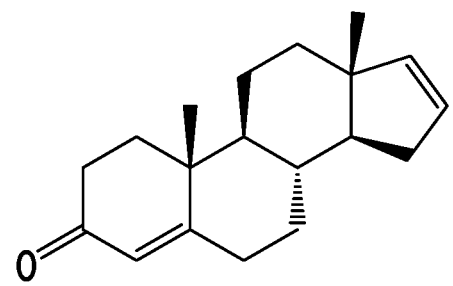
Figure 5C:
Figure 5D:
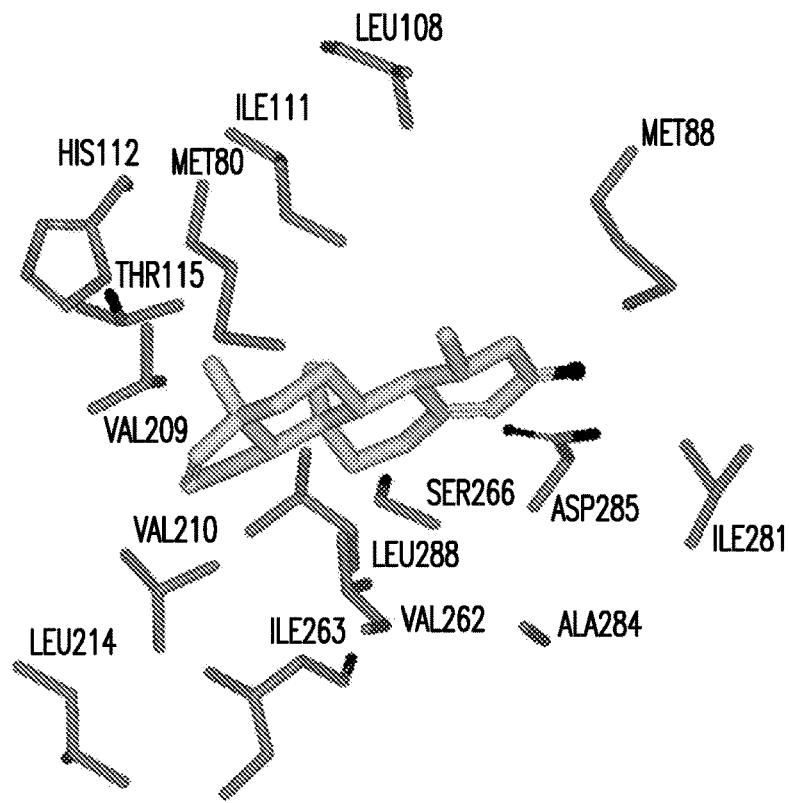
Figure 5E:
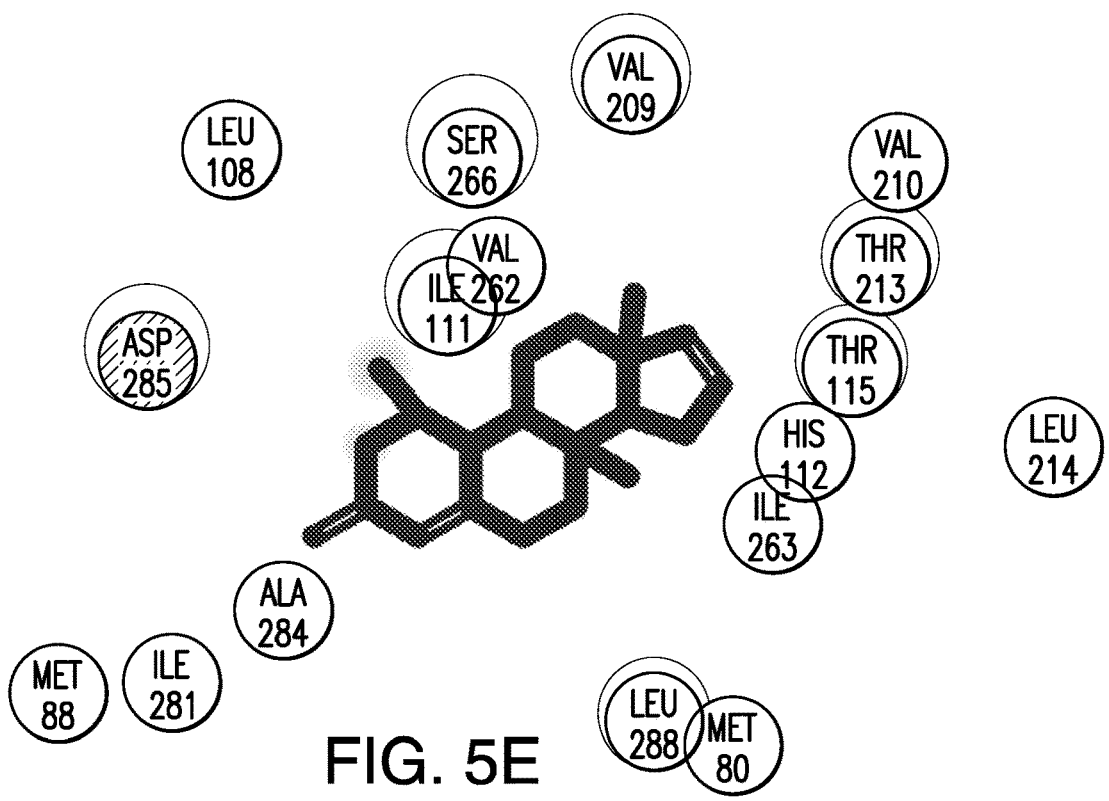
Figure 6B:
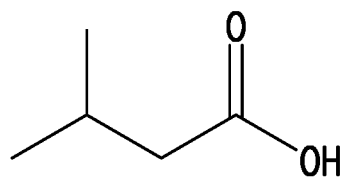
Figure 6C:
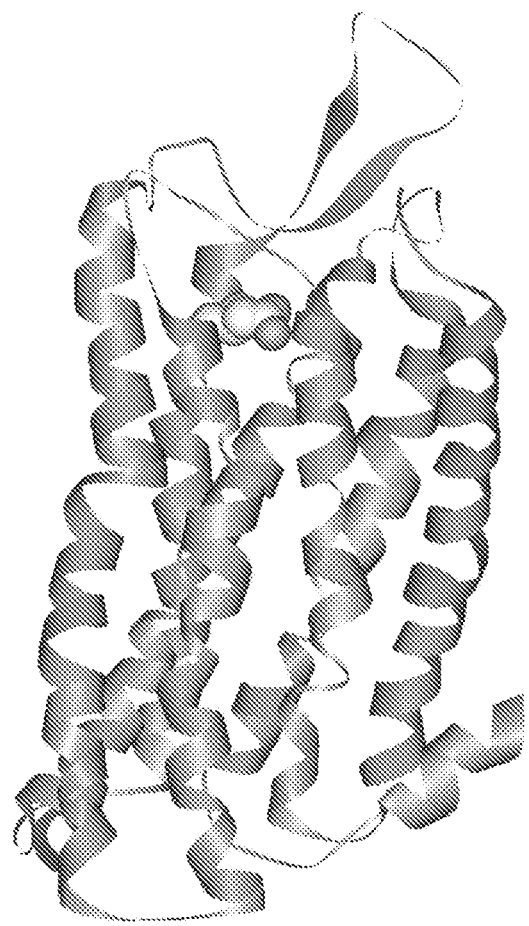
Figure 6D:
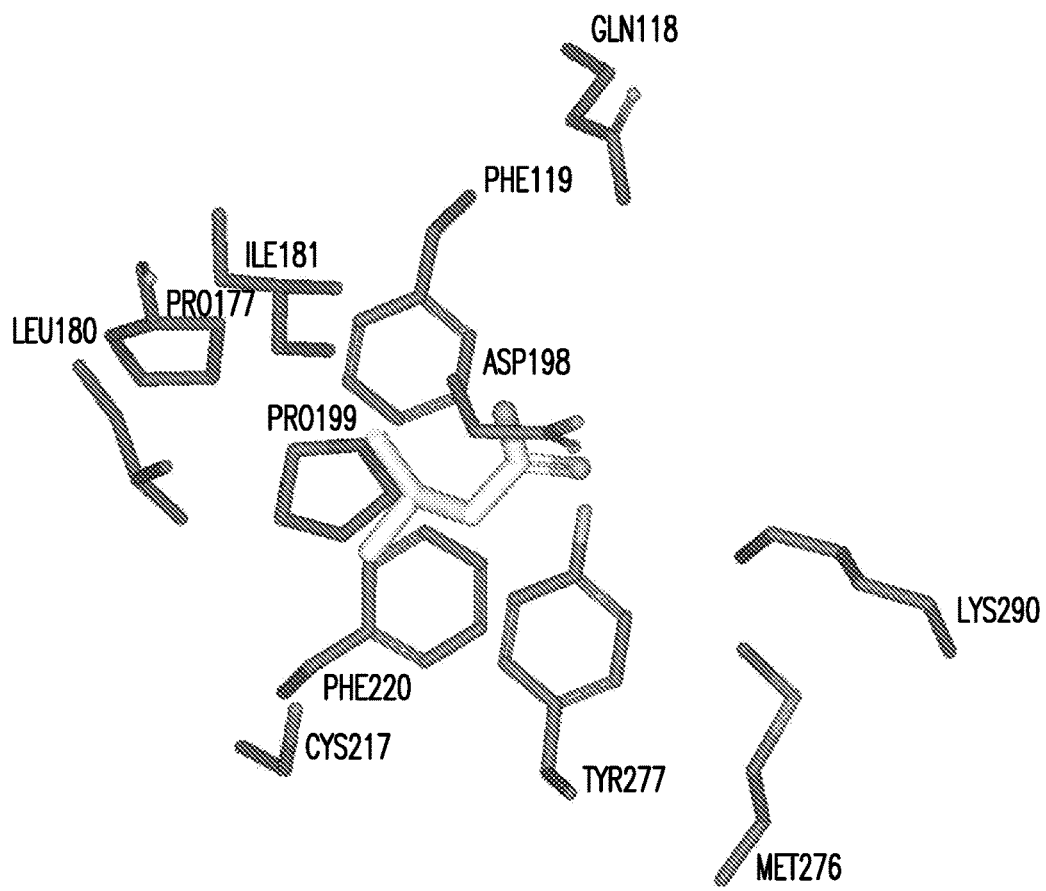
Figure 6E:
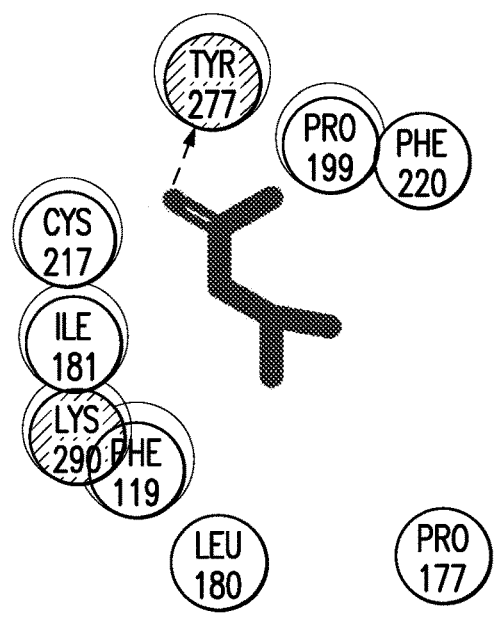
Figure 7B:
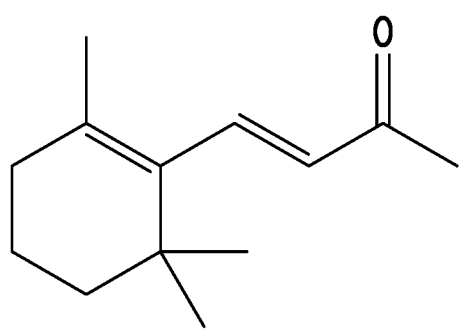
Figure 7C:
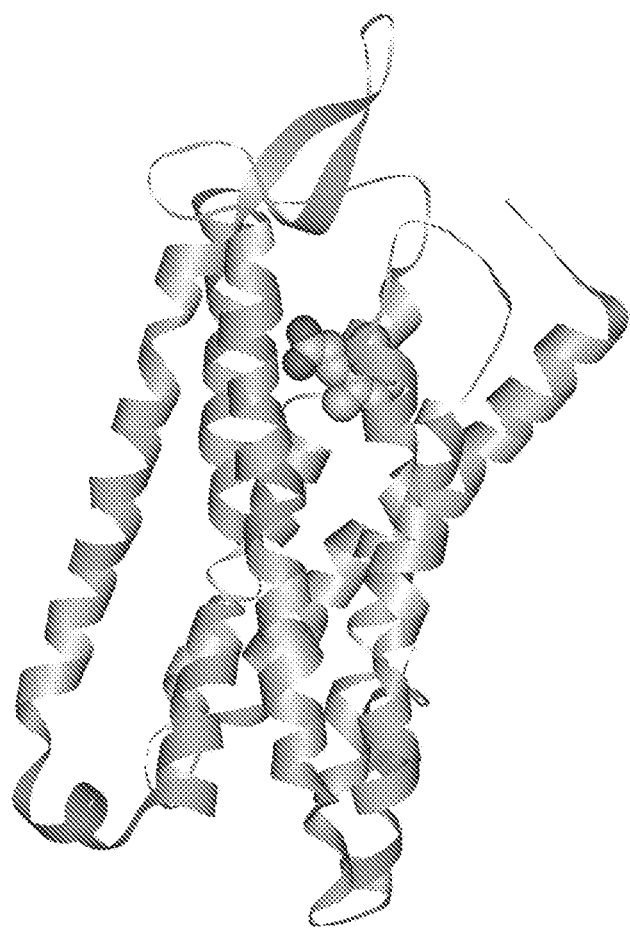
Figure 7D:
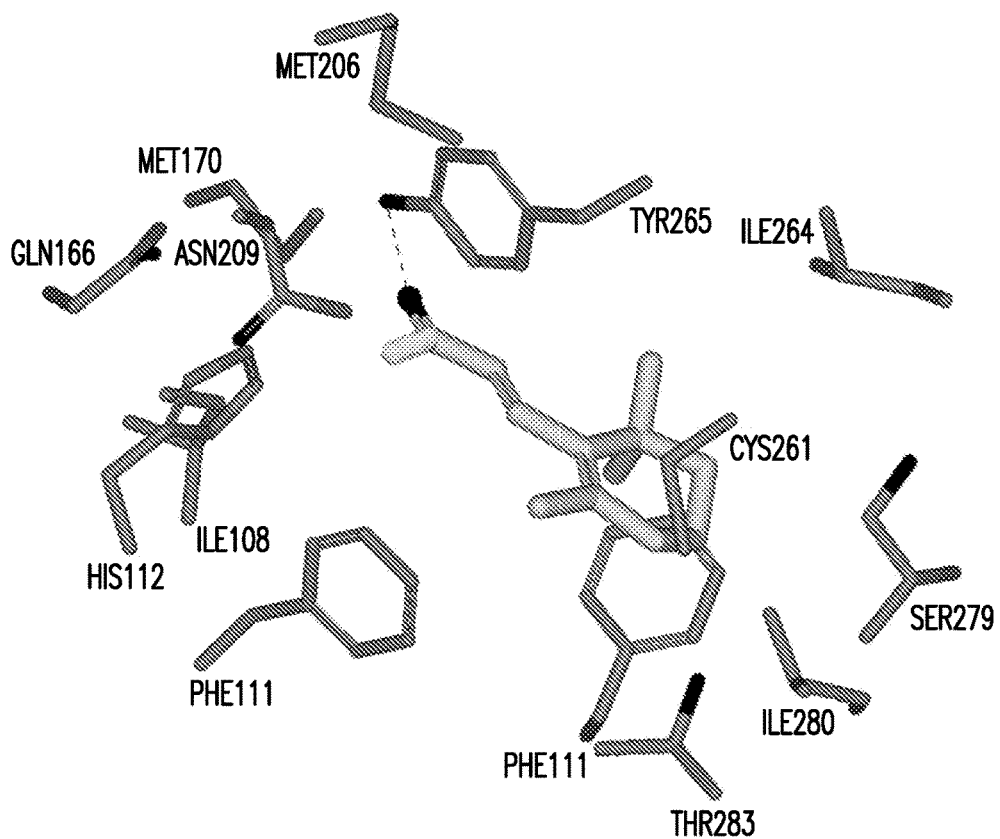
Figure 7E:
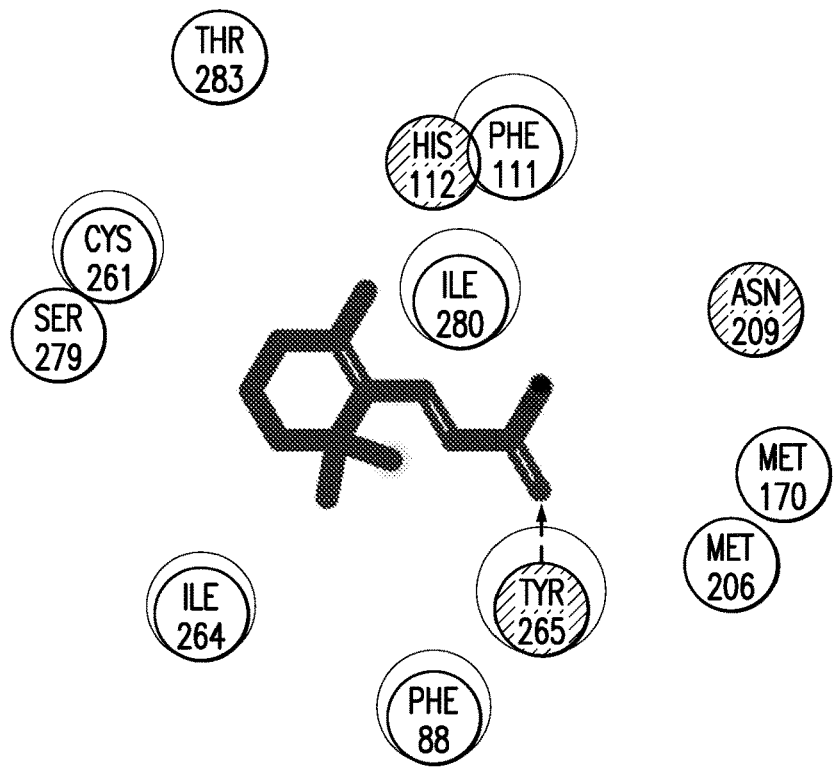
Figure 8B:
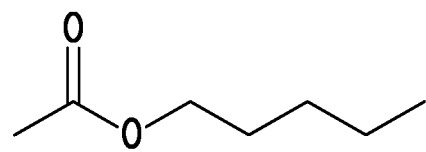
Figure 8C:
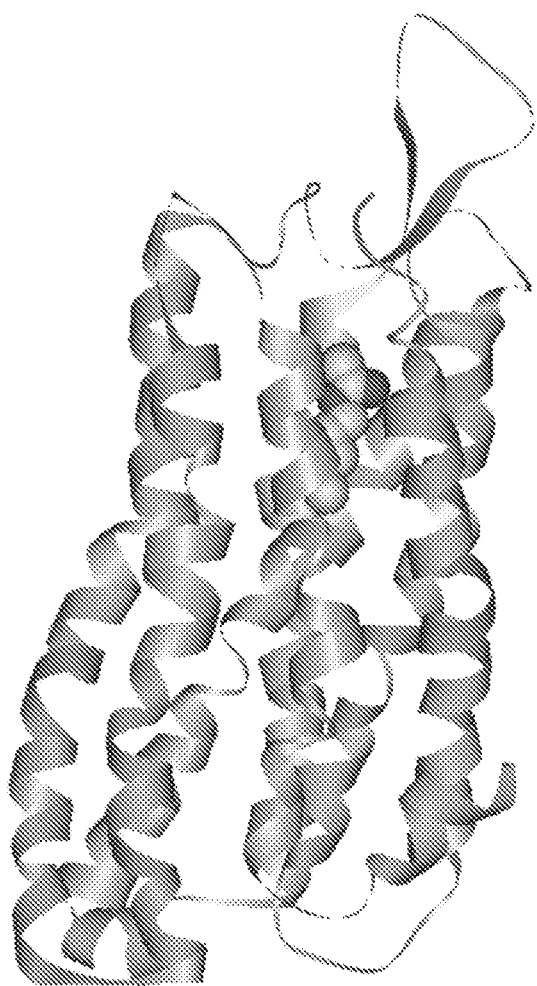
Figure 8D:
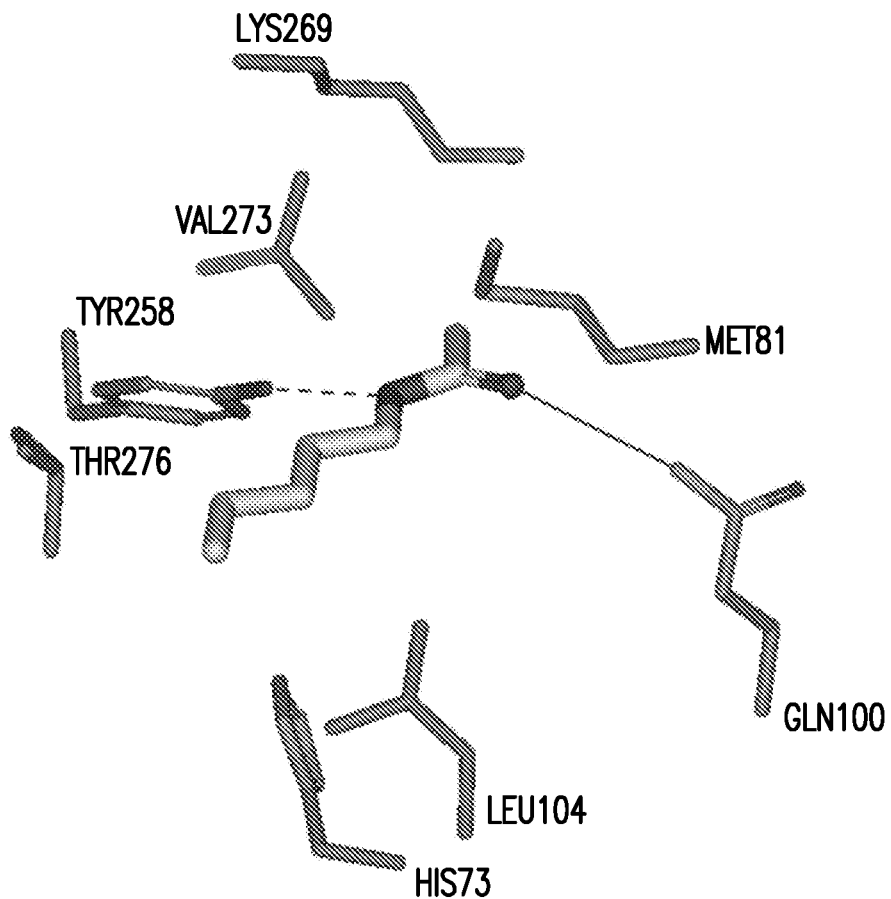
Figure 8E:
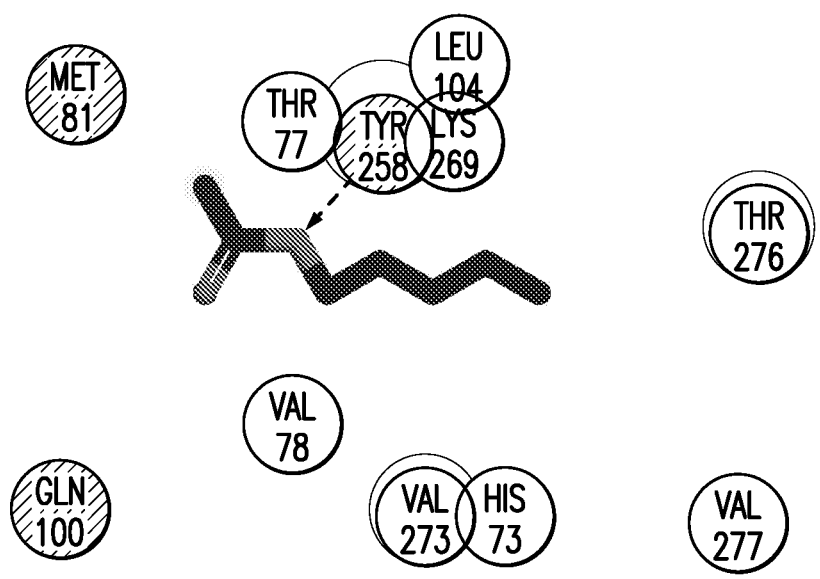
Figure 9B:
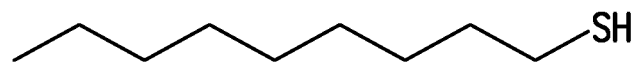
Figure 9C:
Figure 9D:
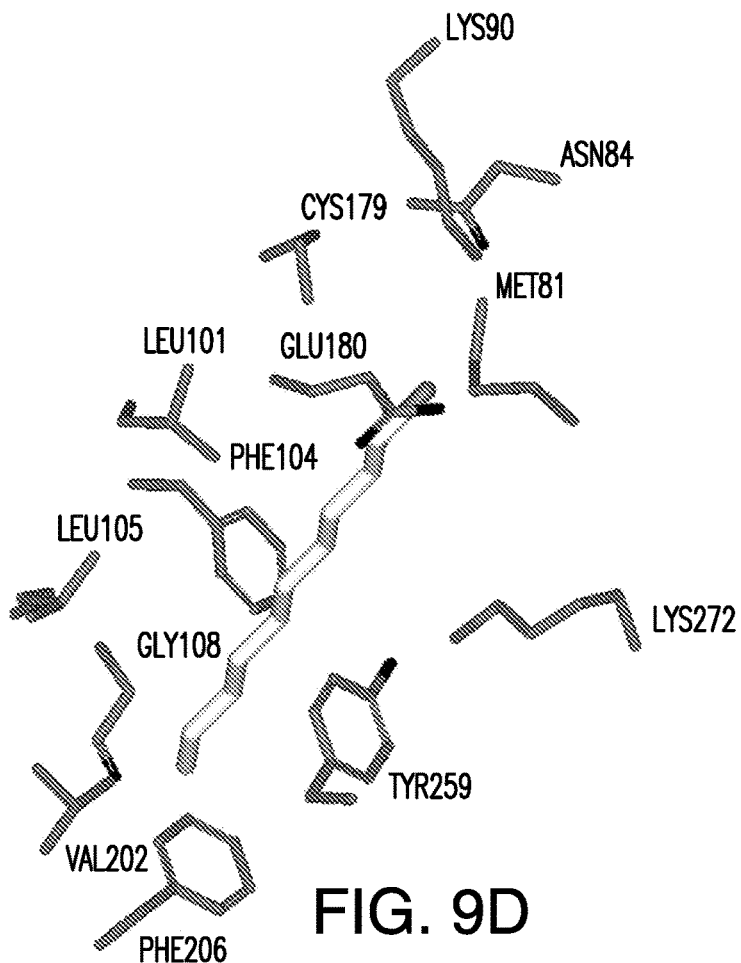
Figure 9E:
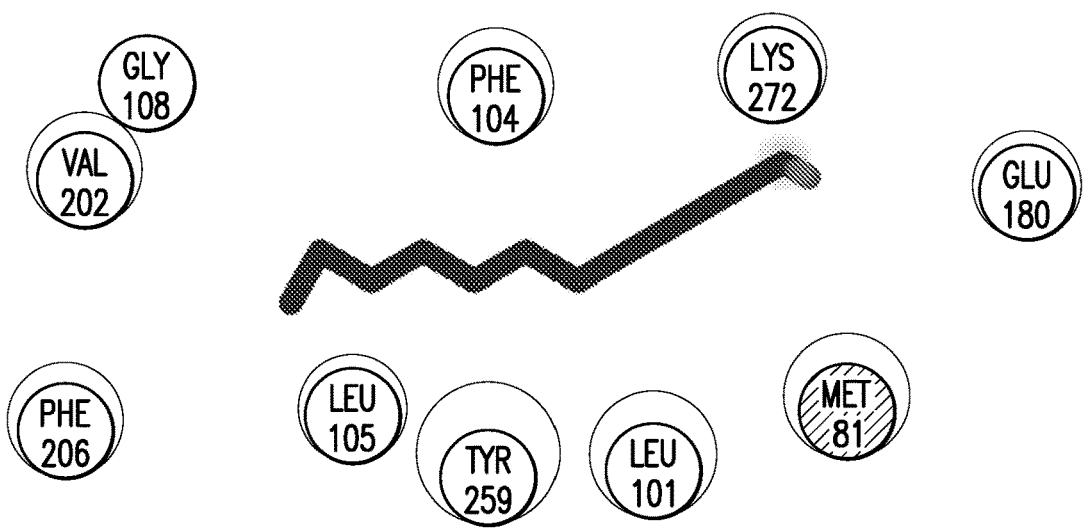
Figure 10B:
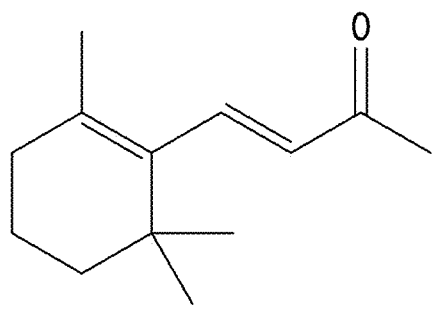
Figure 10C:
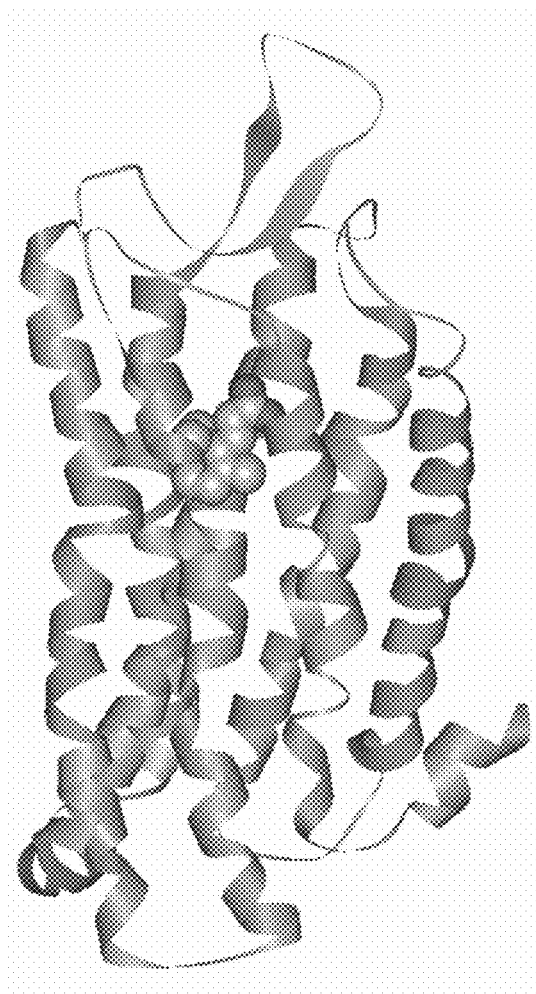
Figure 10D:
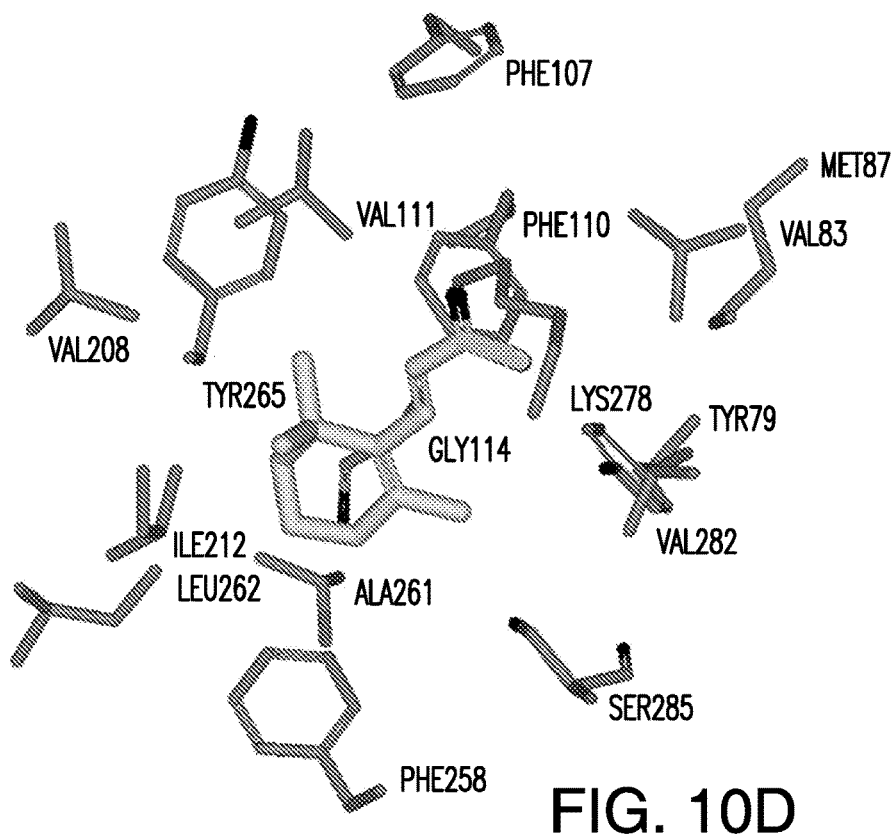
Figure 10E:
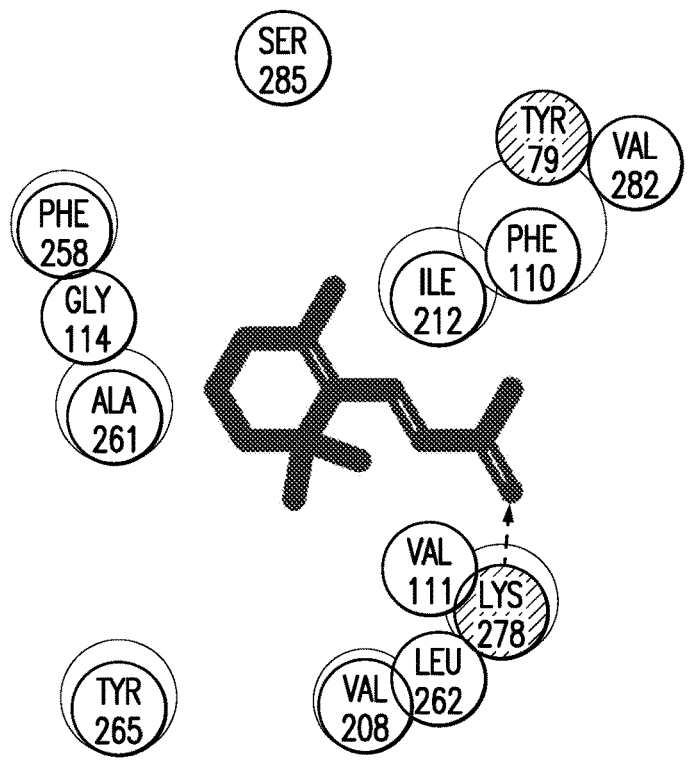
Figure 11B:
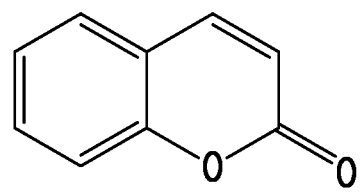
Figure 11C:
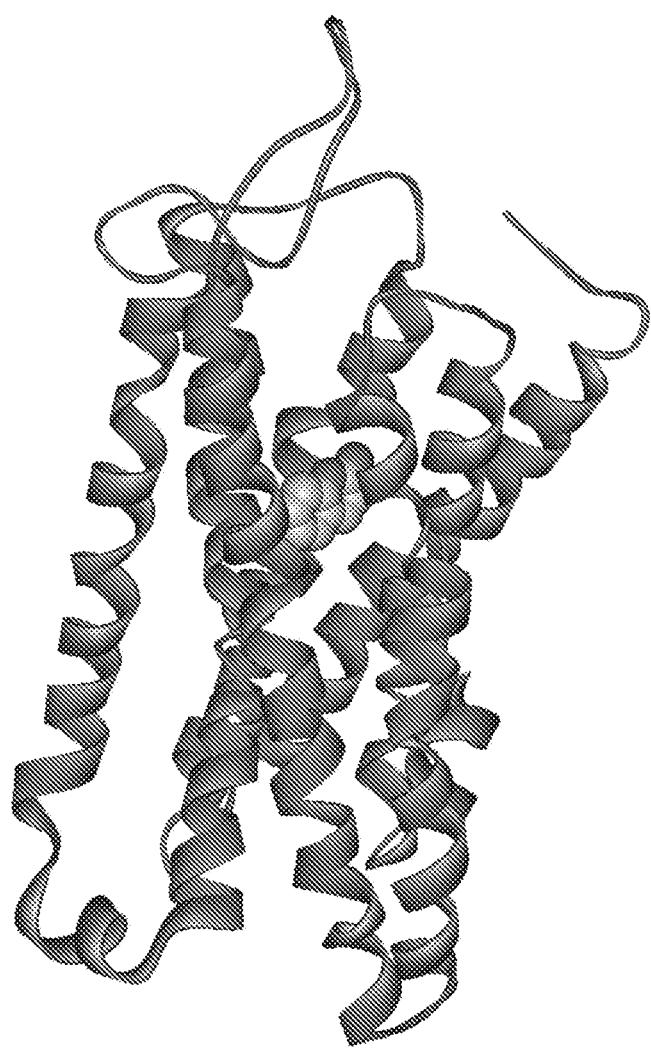
Figure 11D:
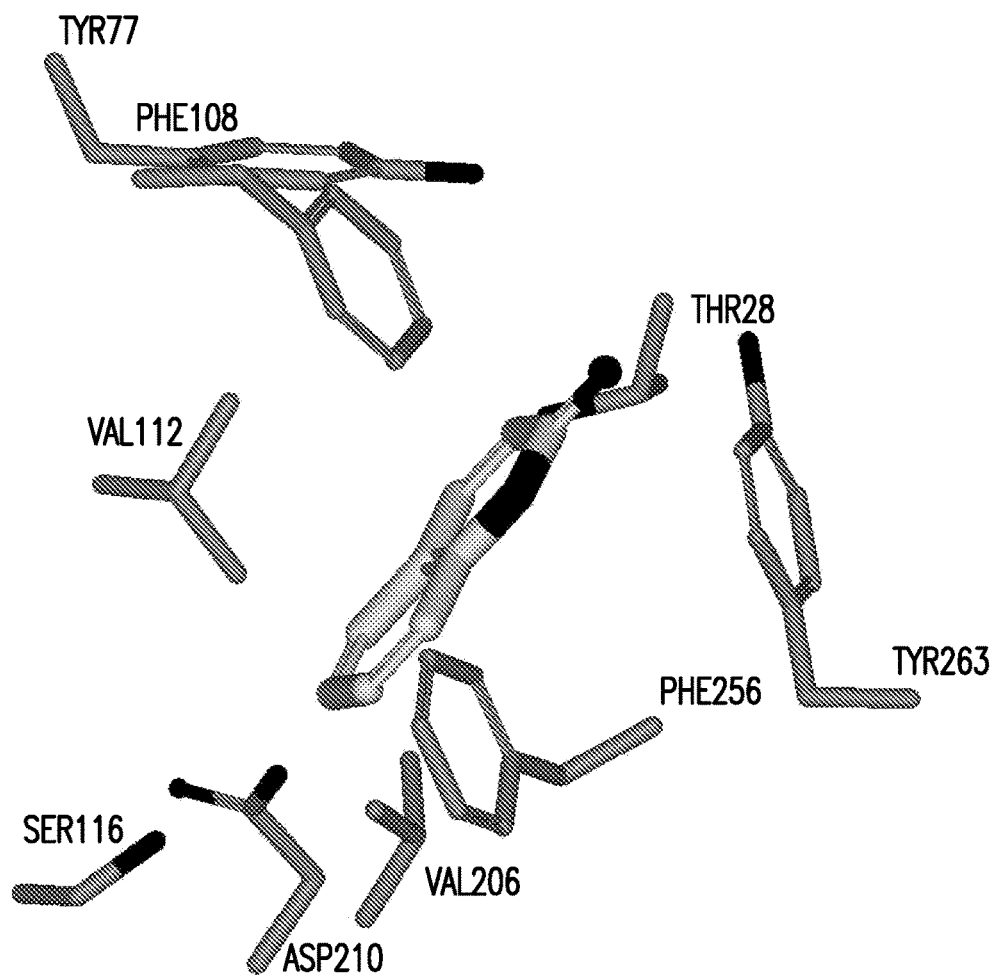
Figure 11E:
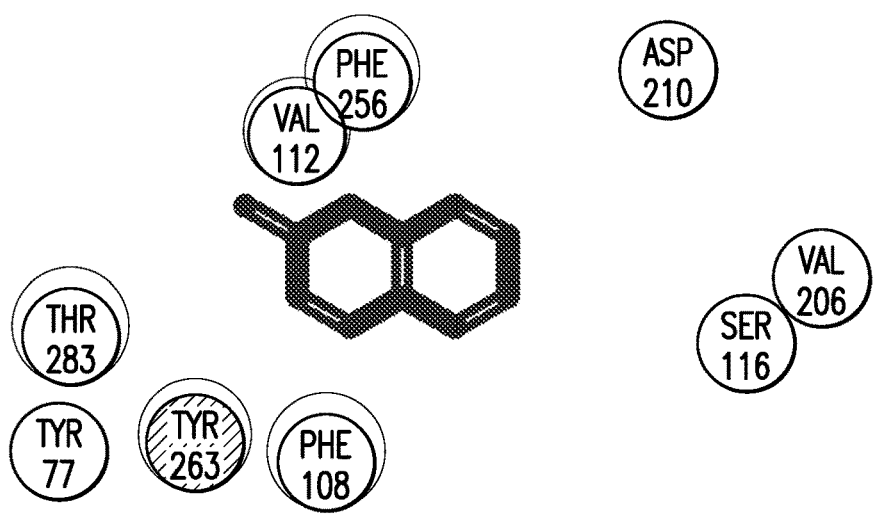

105486528-105487493). The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make hydrogen bond with the ligand include Tyr265. Additional residues that can potentially make ring stacking, salt bridges, hydrogen bonding, pi interactions, charged interactions, van der Waals, or hydrophobic interactions with the ligand include Phe88, Phe111, Met170, Met206, Cys261, Ile264, Ser279, Ile280, and Thr283. Additional residues that can potentially make van der Waals or hydrophobic interaction with the ligand include His112, Asn209 and Tyr265.

FIGS. 8A-8E. A) Alignment of canine, feline, and human olfactory receptor sequences as labeled (SEQ ID NOs:47, 37 and 57, respectively, in order of appearance). The active site, defined as those residues within 9 Å(1 Å=10$^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (Amyl acetate) used in the modeling. C) A near view of the ligand bound to the feline receptor catG7 (B3: 74116955-74117893). The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make hydrogen bond with the ligand include Met81, Tyr258, and Gln100. Additional residues that can potentially make ring stacking, salt bridges, hydrogen bonding, pi interactions, charged interactions, van der Waals, or hydrophobic interactions with the ligand Thr77, Lys269, Leu104, Thr276, Val277, His73, Val273 and Val78.

FIGS. 9A-9E. A) Alignment of canine, feline, and human olfactory receptor sequences as labeled (SEQ ID NOs:38, 58 and 48, respectively, in order of appearance). The active site, defined as those residues within 9 Å(1 Å=10$^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (1-nonanethiol) used in the modeling. C) A near view of the ligand bound to the feline receptor catG8 (E3: 40237904-40238842). The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make ring stacking, salt bridges, hydrogen bonding, pi interactions, or charged interactions with the ligand include Leu101, Phe104, Leu105, Gly108, Glu180, Val202, Phe206, Tyr259, and Lys272. Additional residues that can potentially make van der Waals or hydrophobic interaction with the ligand include Met81.

FIGS. 10A-10E. A) Alignment of canine, feline, and human olfactory receptor sequences as labeled (SEQ ID NOs:49, 59 and 39, respectively, in order of appearance). The active site, defined as those residues within 9 Å(1 Å=10$^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (β-ionone) used in the modeling. C) A near view of the ligand bound to the feline receptor catG9 (D1:105462554-105463512). The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make hydrogen bond with the ligand include Lys278. Additional residues that can potentially make ring stacking, salt bridges, hydrogen bonding, pi interactions, or charged interactions with the ligand include Phe110, Val111, Gly114, Val208, Ile212, Phe258, Ala261, Leu262, Tyr265, Val282, and Ser285. Additional residues that can potentially make van der Waals or hydrophobic interaction with the ligand include Tyr79 and Lys278.

FIGS. 11A-11E. A) Alignment of canine, murine, feline, and human olfactory receptor sequences as labeled (SEQ ID NOs:60, 3,809, 50 and 40, respectively, in order of appearance). The active site, defined as those residues within 9 Å (1 Å=$10^{-10}$ m) of any heavy atom in the ligand, is highlighted by black boxes over the sequence alignment. Residues N-terminal to the seven-transmembrane domain are included for ease of identifying residues by number within the protein sequence. Residues C-terminal to the seven-transmembrane domain are not included in the alignments. B) Chemical structure of the ligand (Coumarin) used in the modeling. C) A near view of the ligand bound to the canine receptor CafaOR5.2.5. The figure illustrates where the compound binds within the seven-helical transmembrane-domain (7TM) of the chosen receptor. D) A near view of the ligand bound to the receptor that illustrates residues defining the environment of the bound ligand. A smaller number of residues is chosen relative to those highlighted in A) for ease of viewing. E) An interaction map of the ligand bound the receptor that illustrates residues defining the environment of the bound ligand. Residues that can contact the ligand are shown as circles. Dark circles are those that interact primarily through van der Waals or hydrophobic contacts. Lighter circles are those that interact with ligand via other interaction types such as hydrogen bonds, ring stacking, salt bridges. When present, a halo around a circle indicates that there is significant loss of water-accessible surface area for that residue on ligand binding. When present, hydrogen bonds are indicated by dotted lines. Residues that can potentially make ring stacking, salt bridges, hydrogen bonding, pi interactions, or charged interactions with the ligand include Tyr77, Phe108, Val112, Ser116, Val206, Asp210, Phe256, and Thr283. Additional residues that can potentially make van der Waals or hydrophobic interaction with the ligand include Tyr263.

Figure 12:
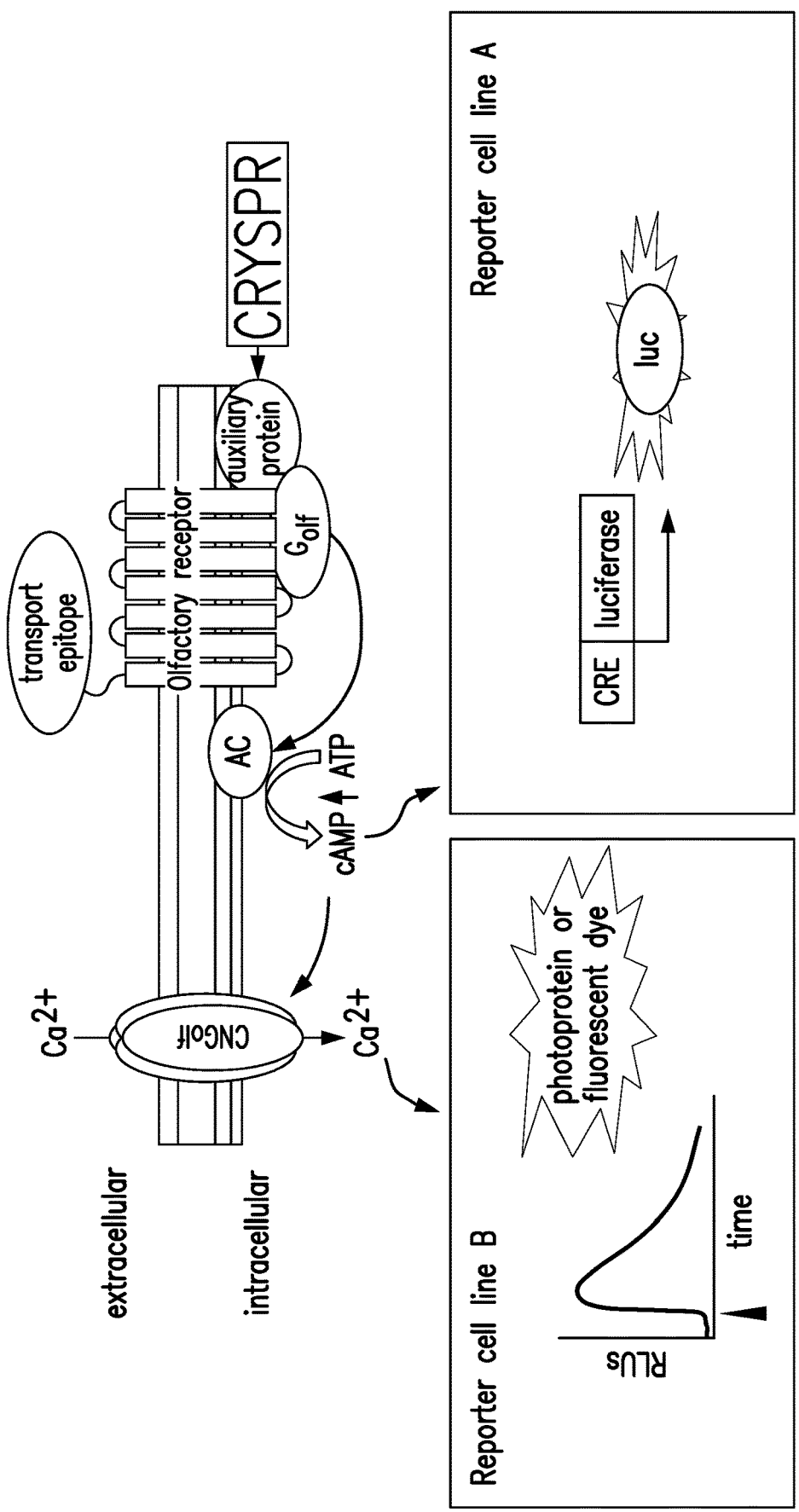

FIG. 12 shows native olfactory receptor signaling pathway and possible functional assays.

Figure 13:
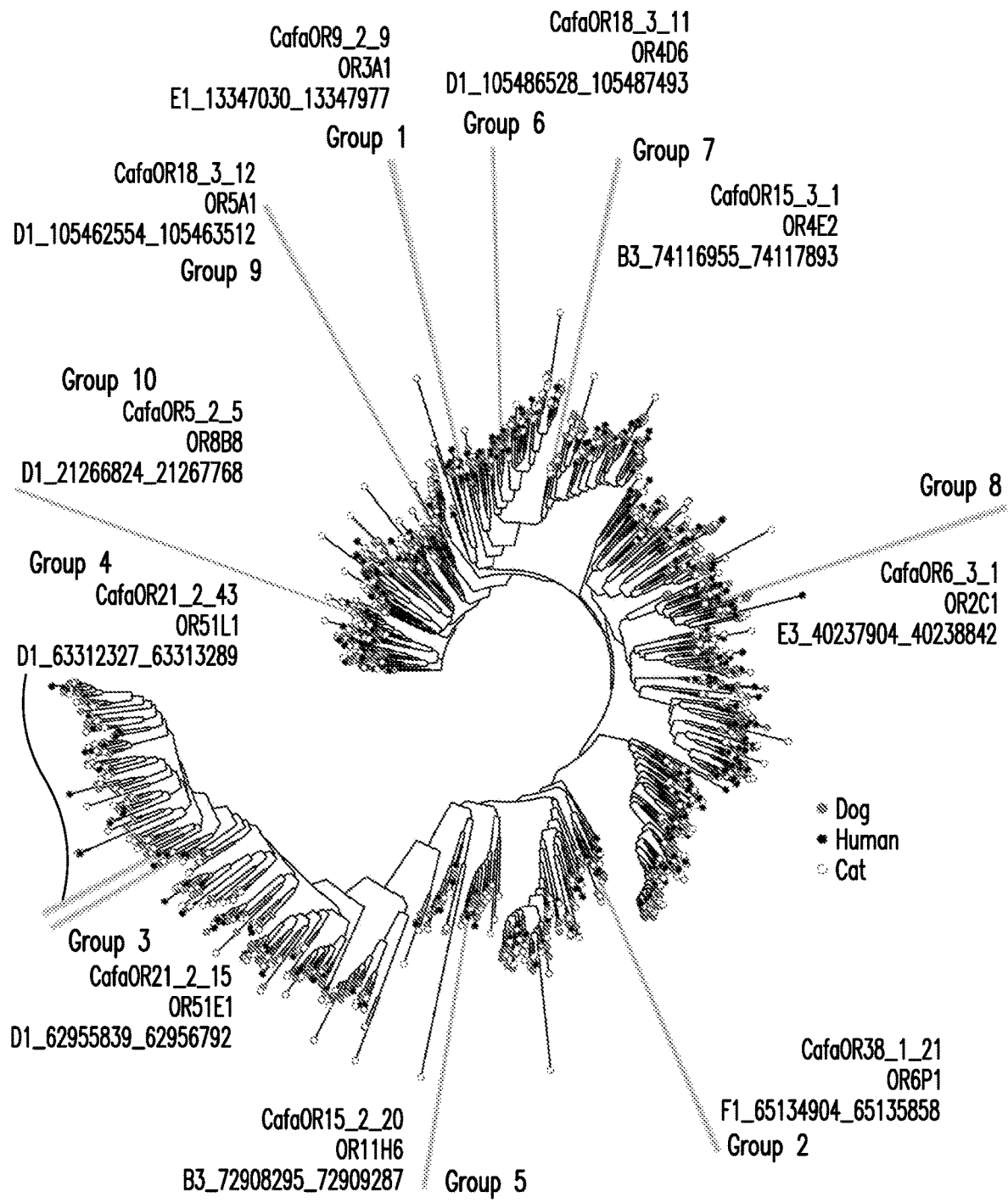

FIG. 13 shows a phylogenetic tree for multi-species (human/canine/feline) covering the olfactory genetic space. The phylogenetic tree shows all olfactory receptors and highlighted the 30 selected olfactory receptors (10 human receptors, 10 canine receptors, 10 feline receptors).

Figure 14:
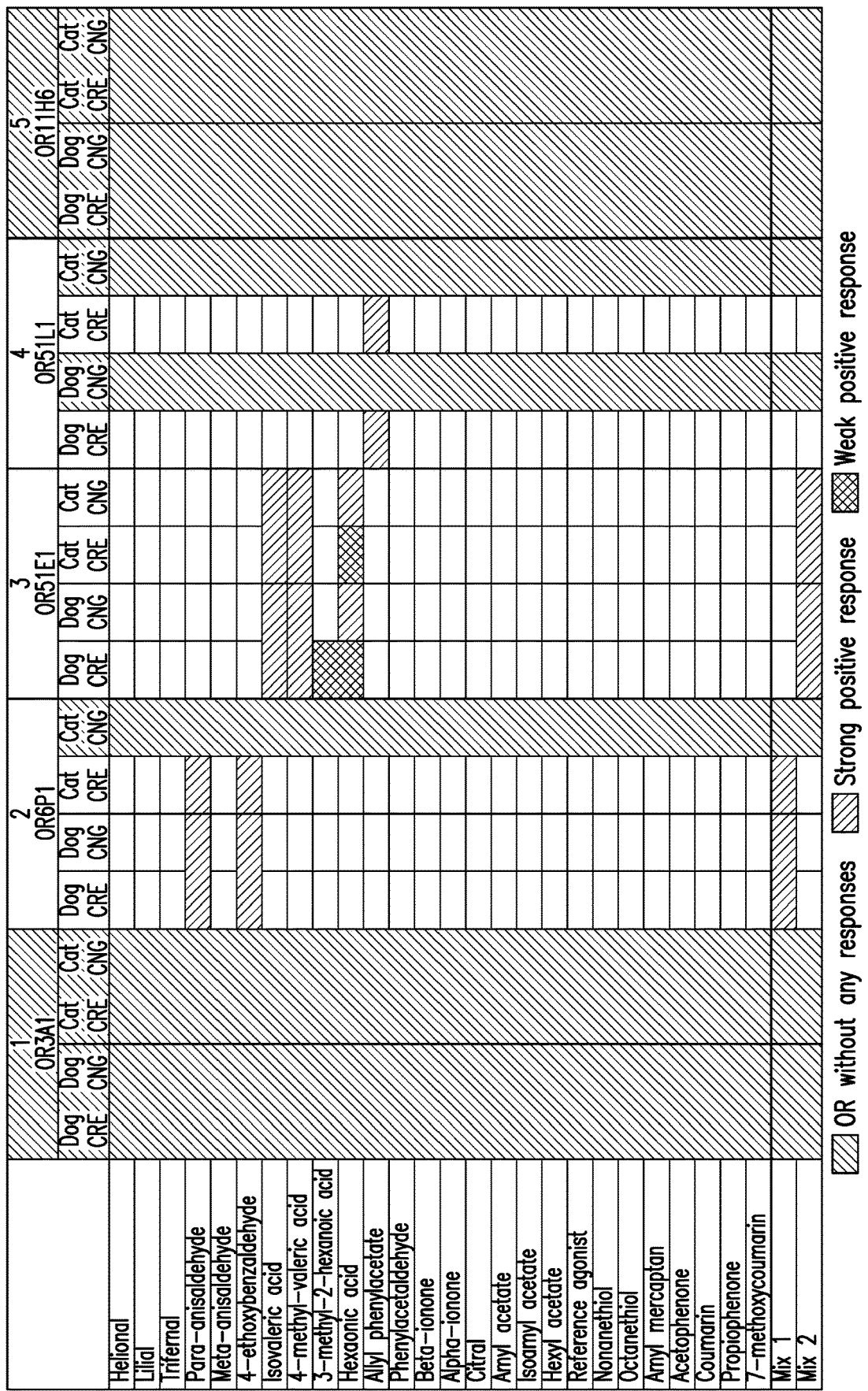

FIG. 14 shows the summarized results of phase 2 testing of OR_1 to OR_5 in Example 4.

Figure 15:
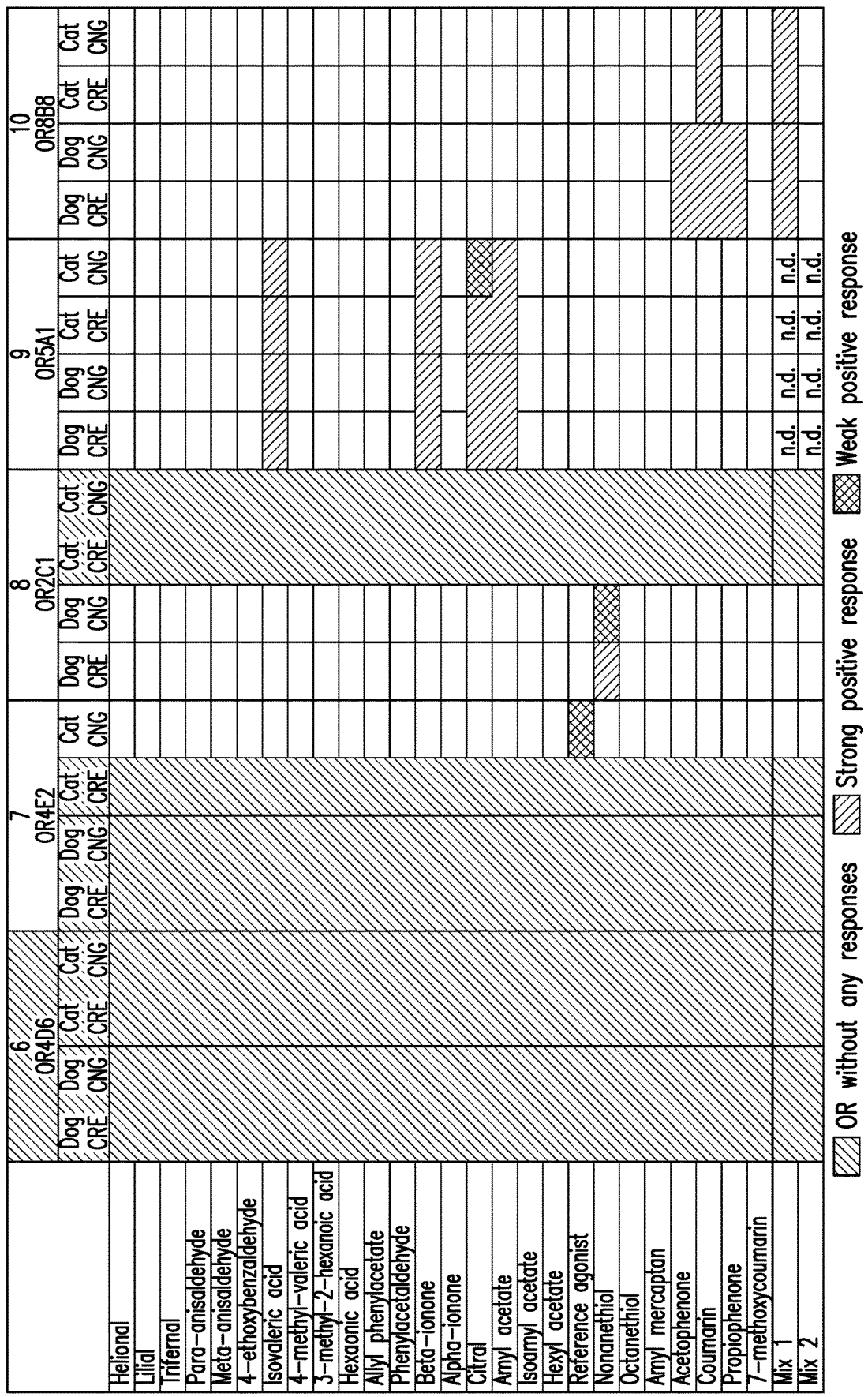

FIG. 15 shows the summarized results of phase 2 testing of OR_6 to OR_10 in Example 4.

FIG. 16 shows the summarized results of phase 3 testing of dog ORs in Example 4.

FIG. 17 shows the summarized results of phase 3 testing of cat ORs in Example 4.

Figure 18:
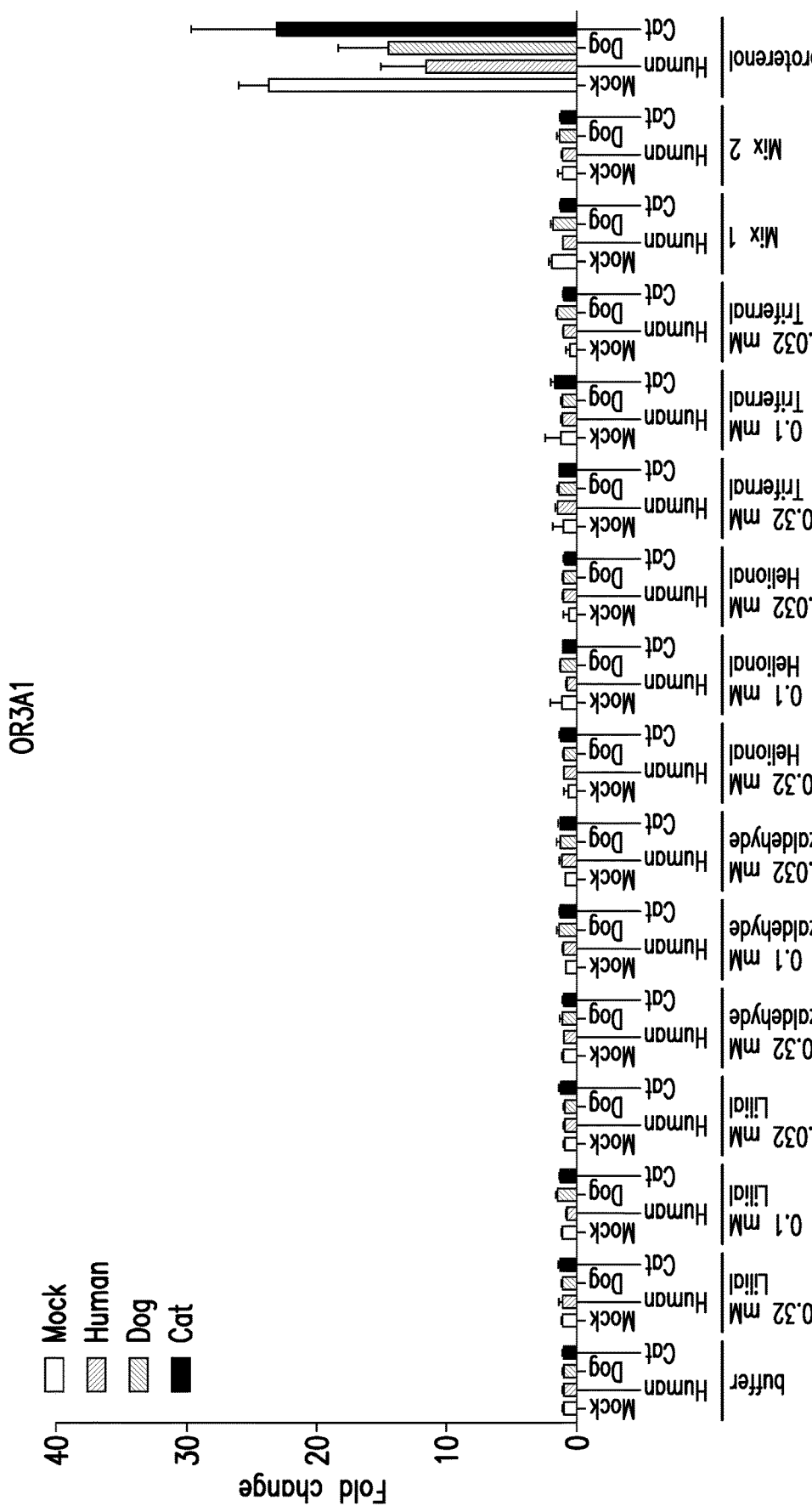

FIG. 18 shows the results of the CRE-NanoLuc luciferase assay using OR_1 (OR3A1).

Figure 19:
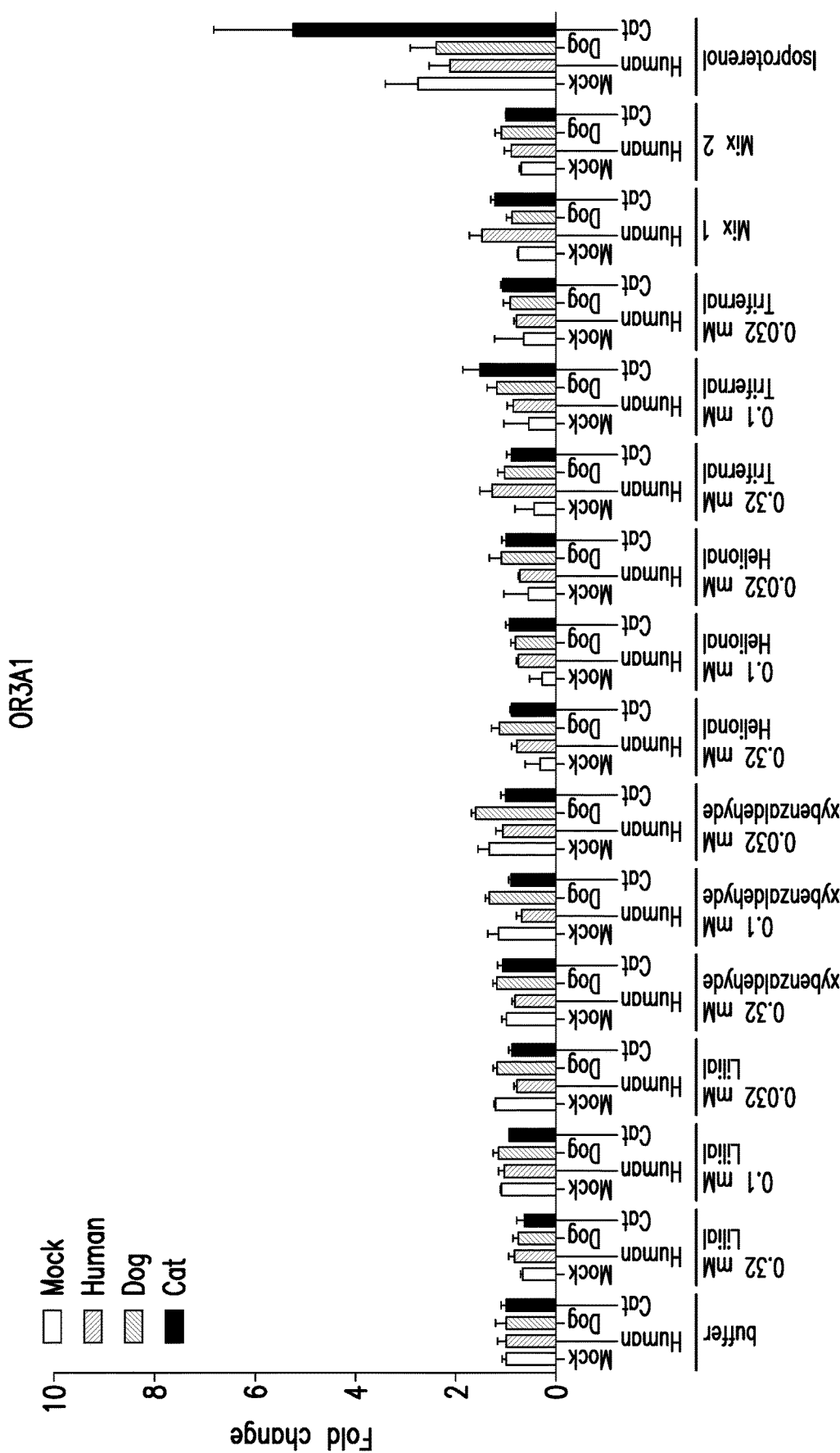

FIG. 19 shows the results of the chAMPion assay using OR_1 (OR3A1).

Figure 20:
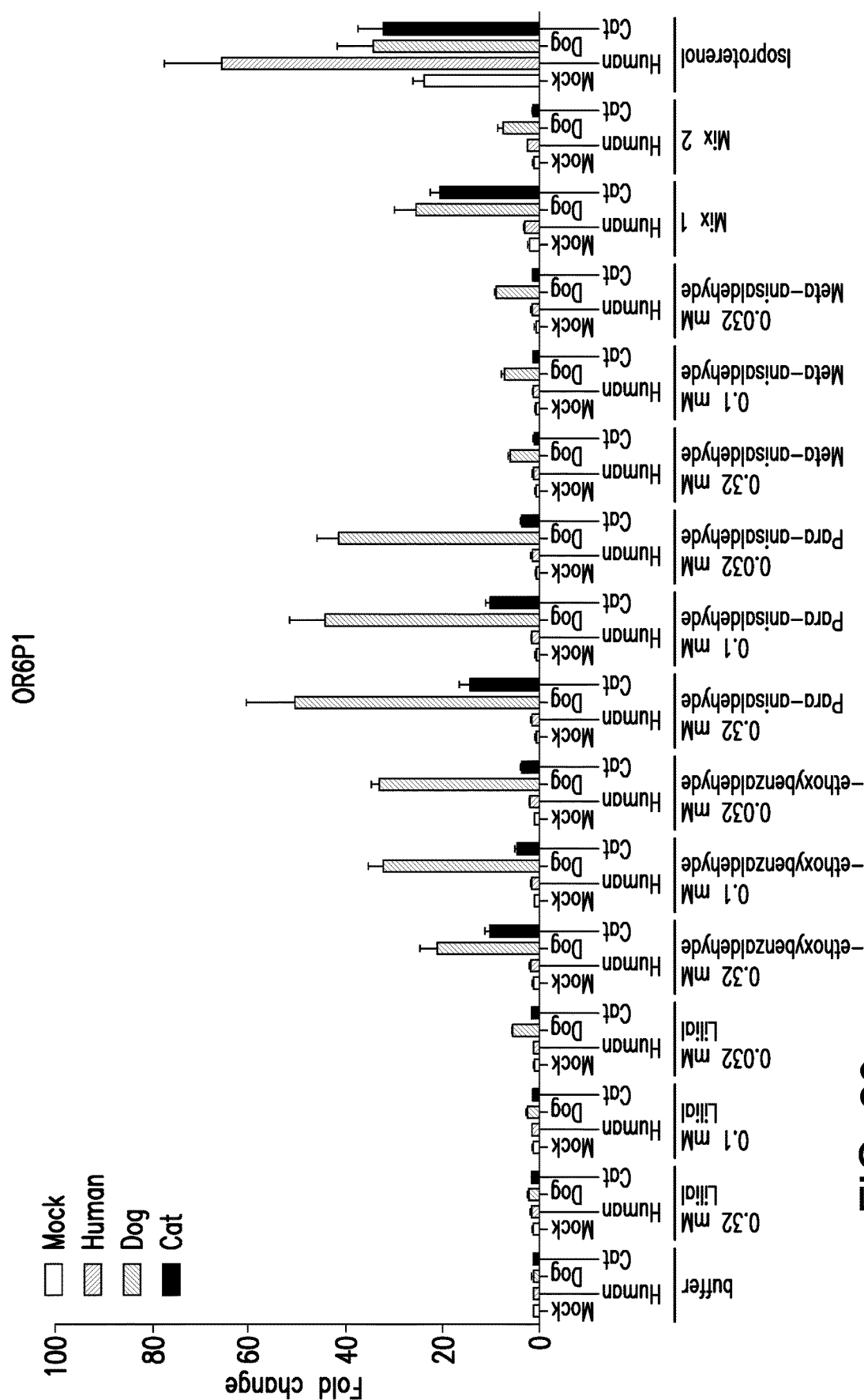

FIG. 20 shows the results of the CRE-NanoLuc luciferase assay using OR_2 (OR6P1).

Figure 21:
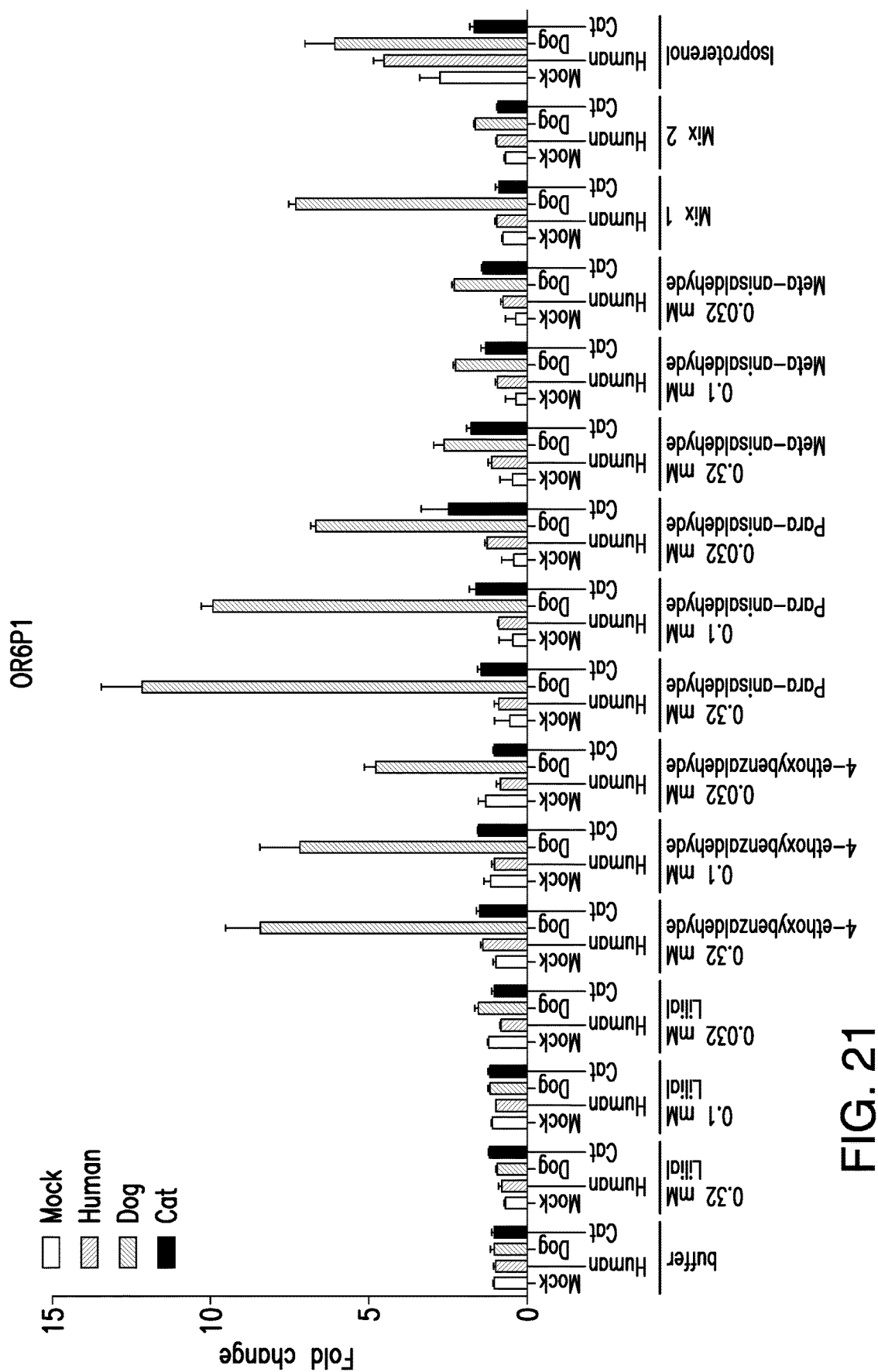

FIG. 21 shows the results of the chAMPion assay using OR_2 (OR6P1).

Figure 22:
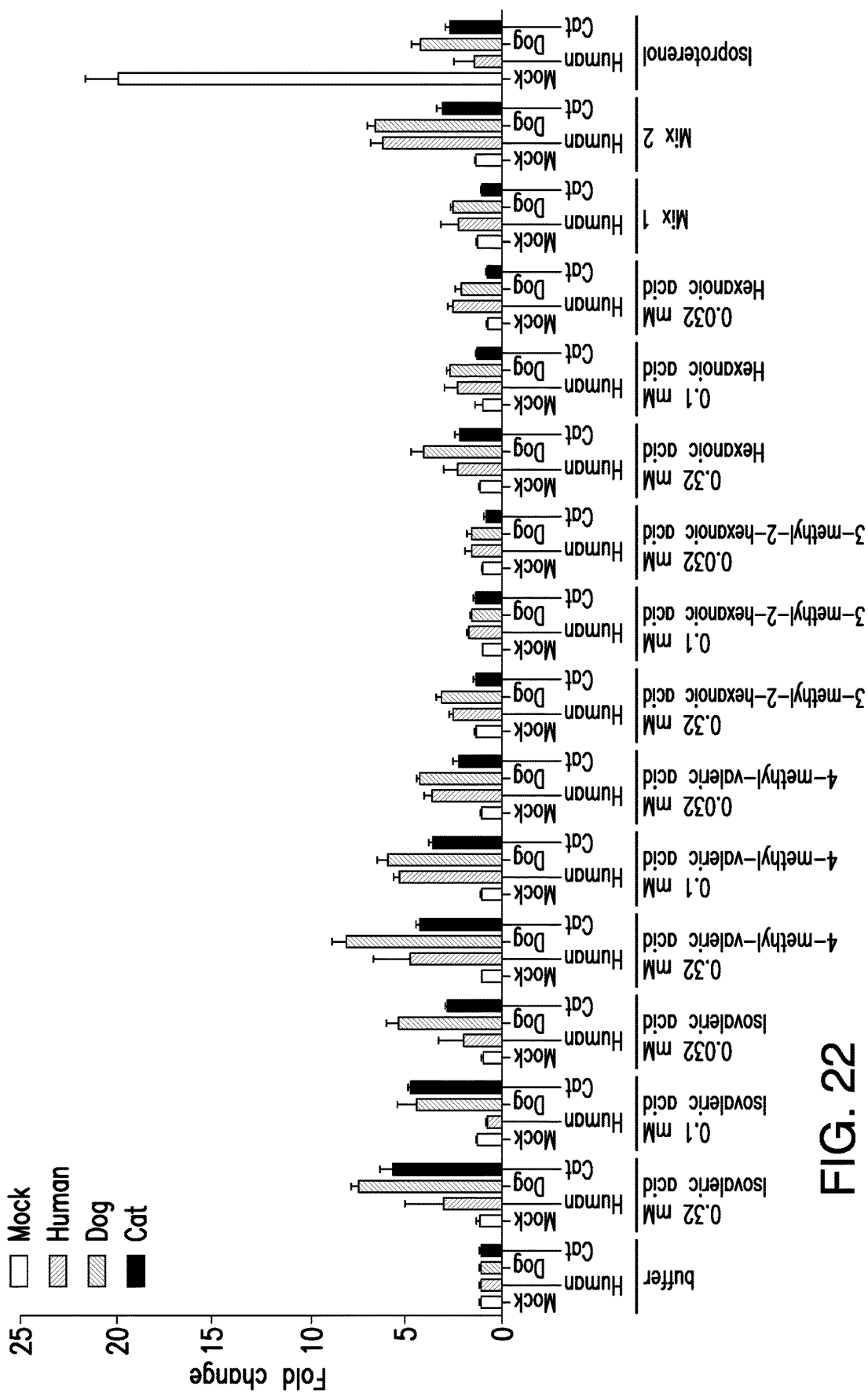

FIG. 22 shows the results of the CRE-NanoLuc luciferase assay using OR_3 (OR51E1).

Figure 23:
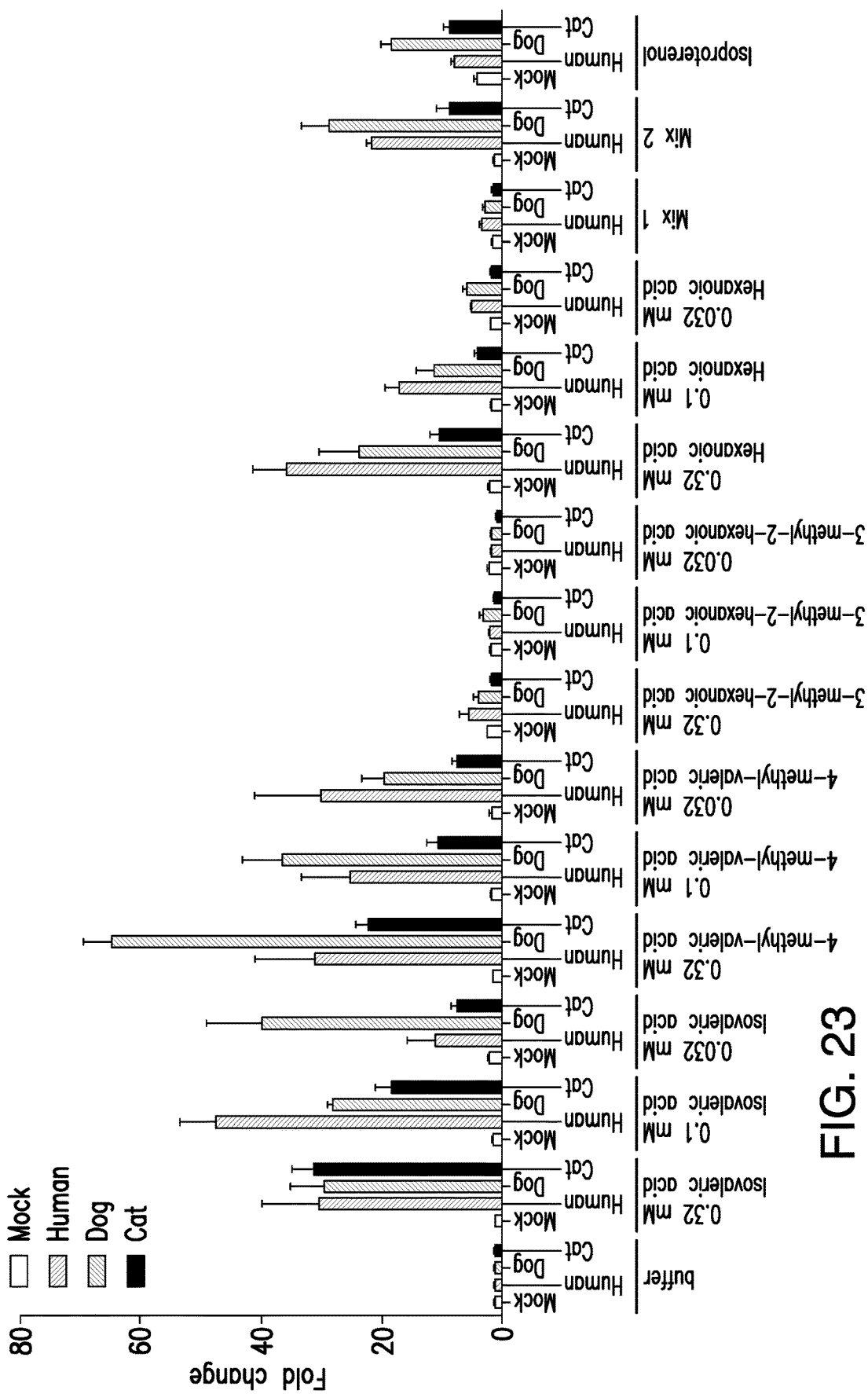

FIG. 23 shows the results of the chAMPion assay using OR_3 (OR51E1).

Figure 24:
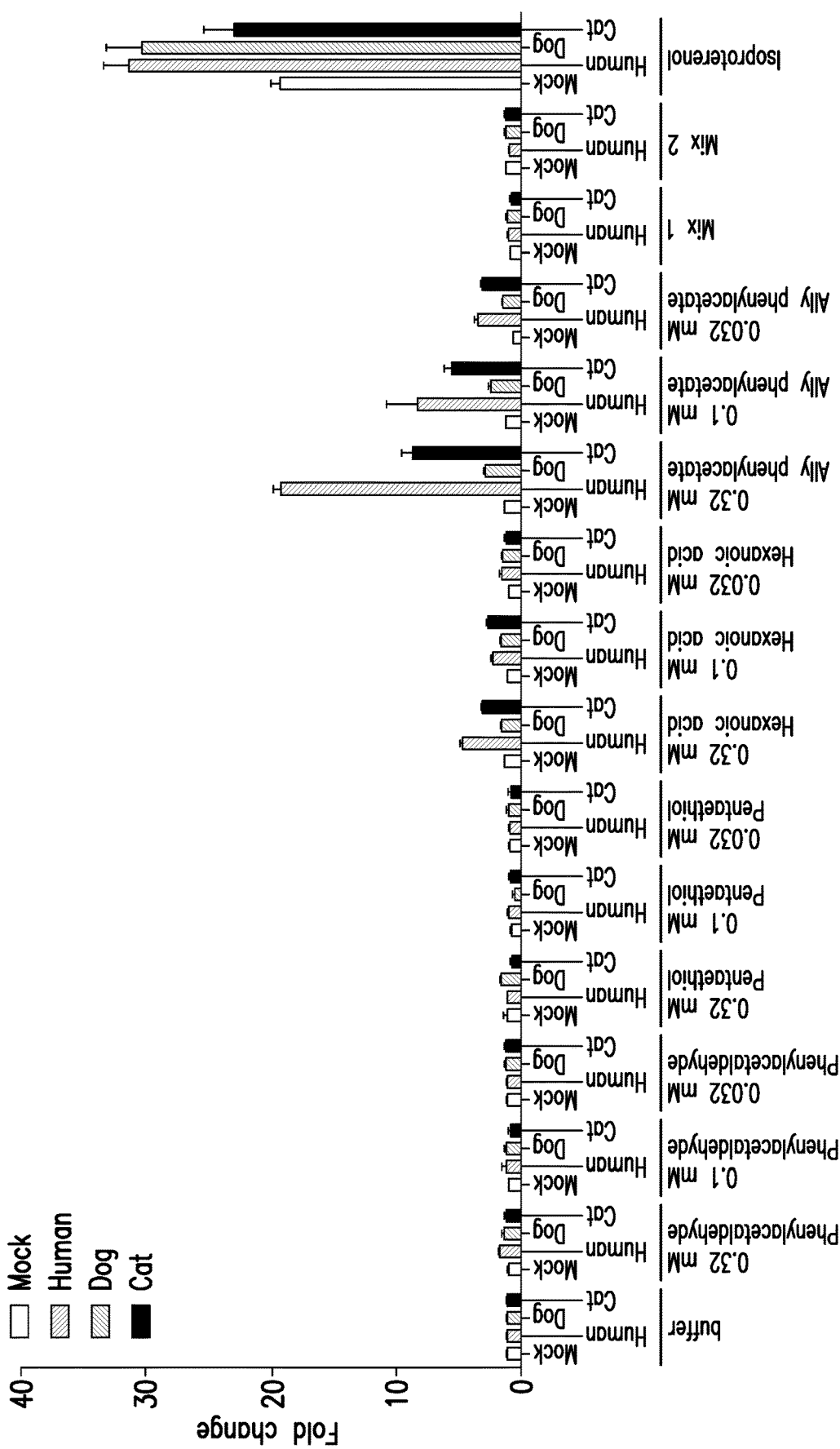

FIG. 24 shows the results of the CRE-NanoLuc luciferase assay using OR_4 (OR51L1).

Figure 25:
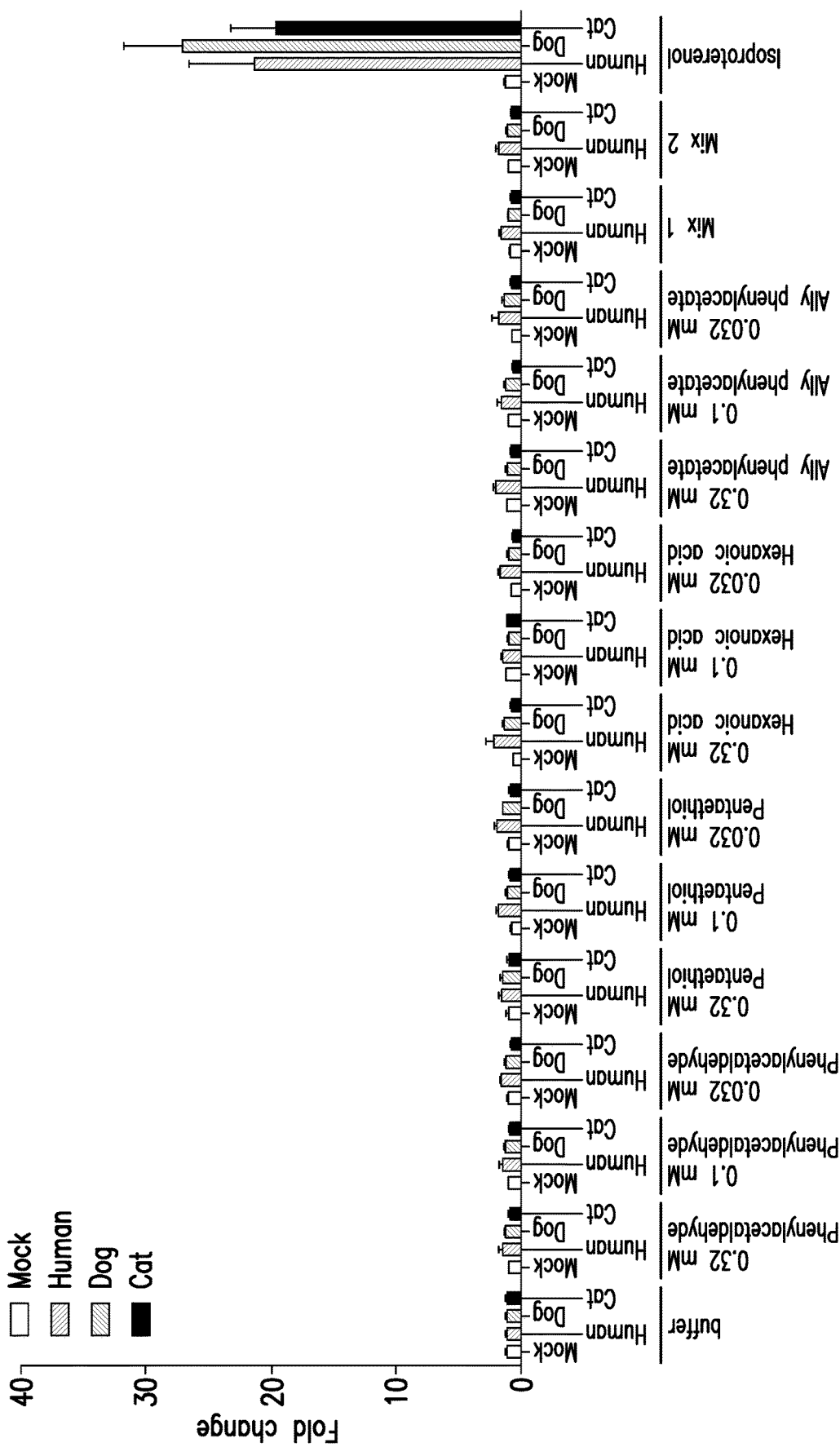

FIG. 25 shows the results of the chAMPion assay using OR_4 (OR51L1).

Figure 26:
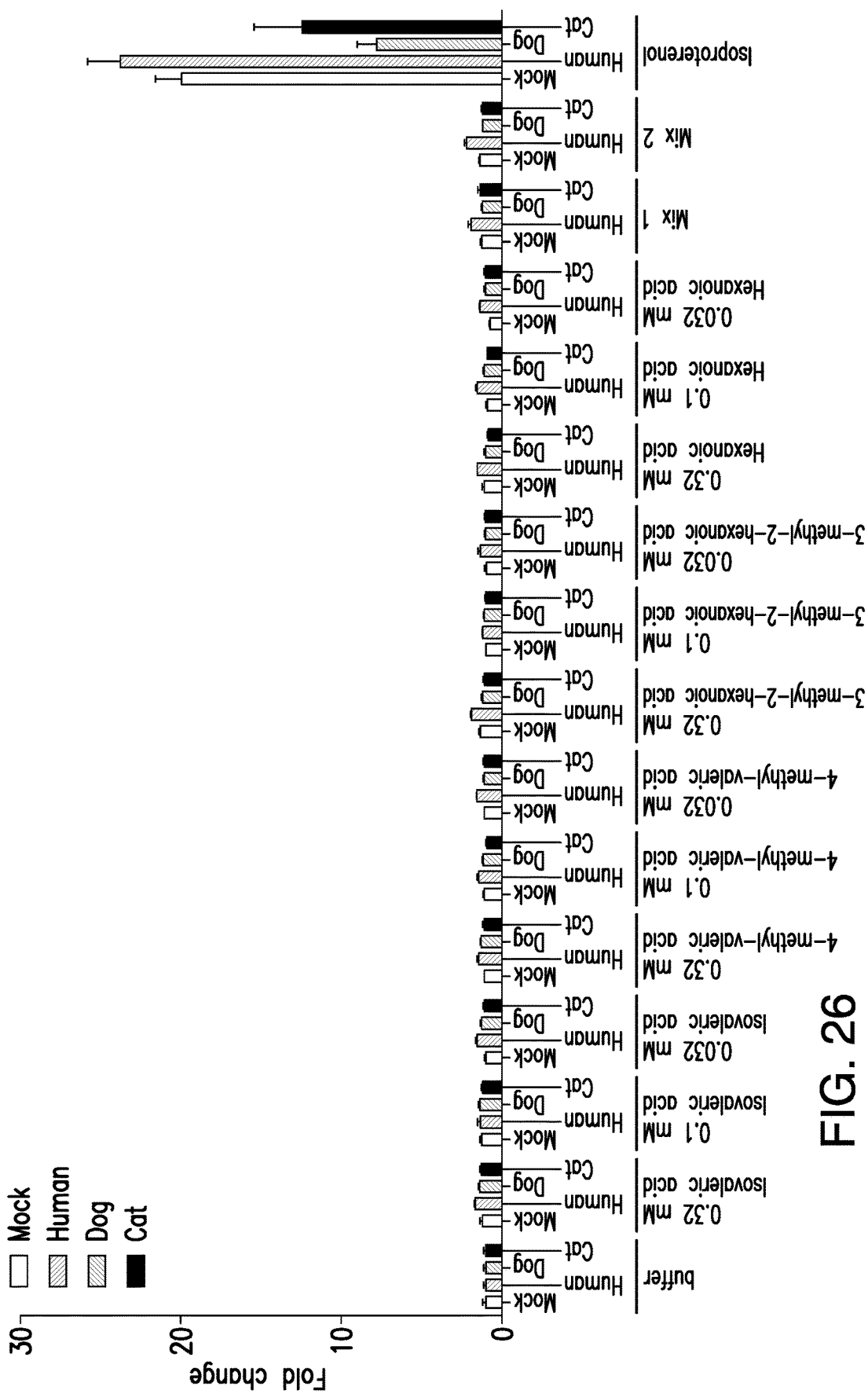

FIG. 26 shows the results of the CRE-NanoLuc luciferase assay using OR_5 (OR11H6).

Figure 27:
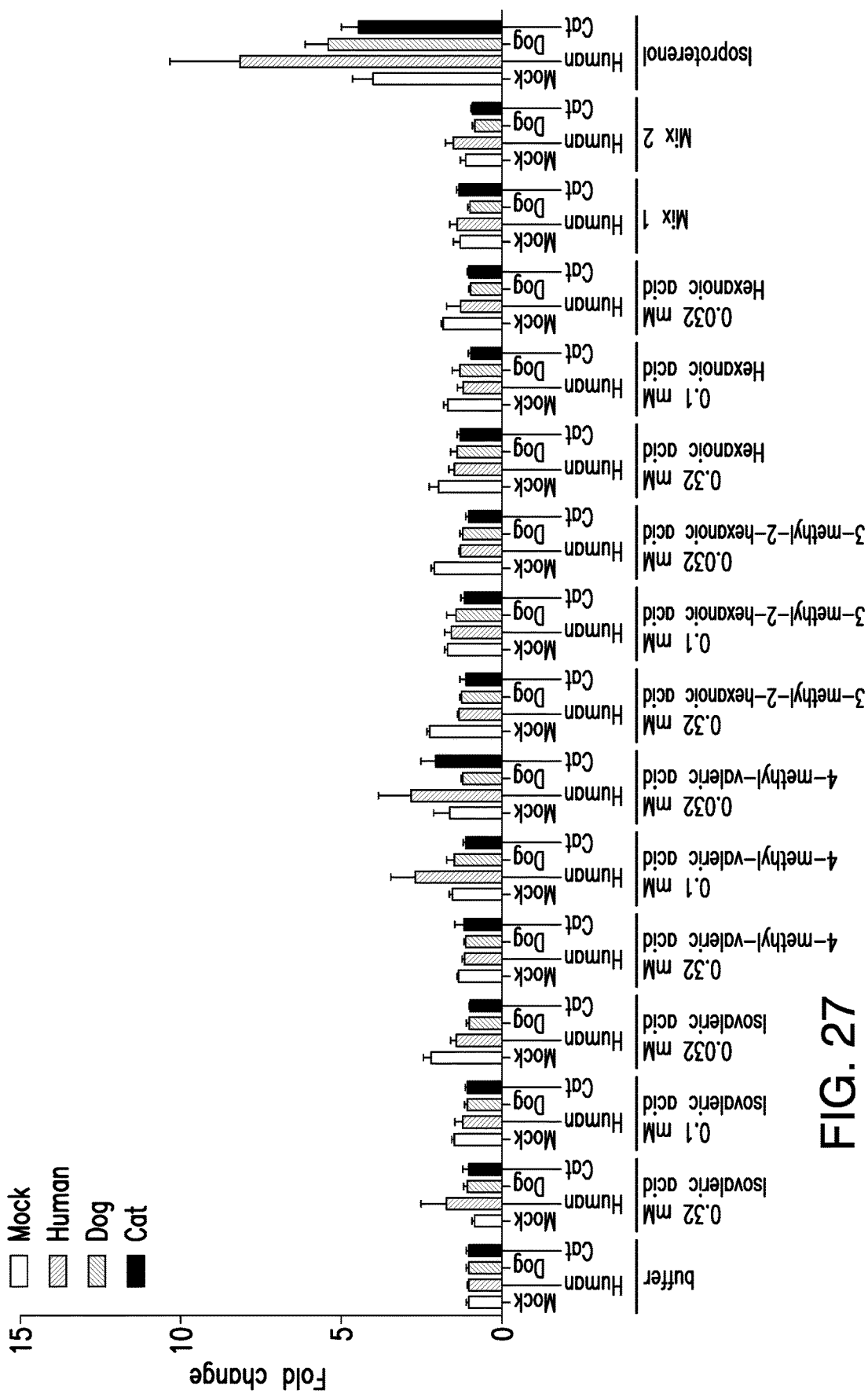

FIG. 27 shows the results of the chAMPion assay using OR_5 (OR11H6).

Figure 28:
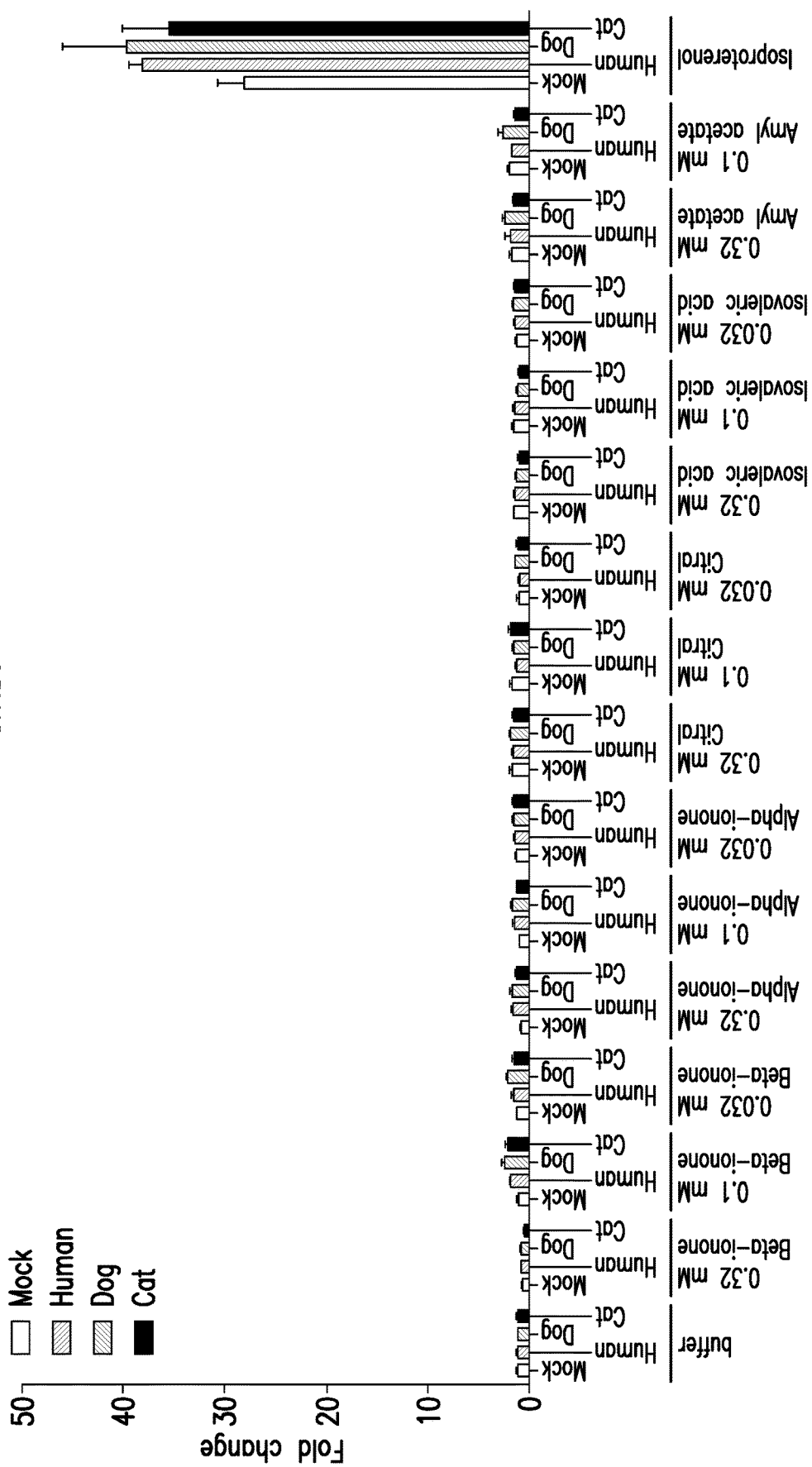

FIG. 28 shows the results of the CRE-NanoLuc luciferase assay using OR_6 (OR4D6).

Figure 29:
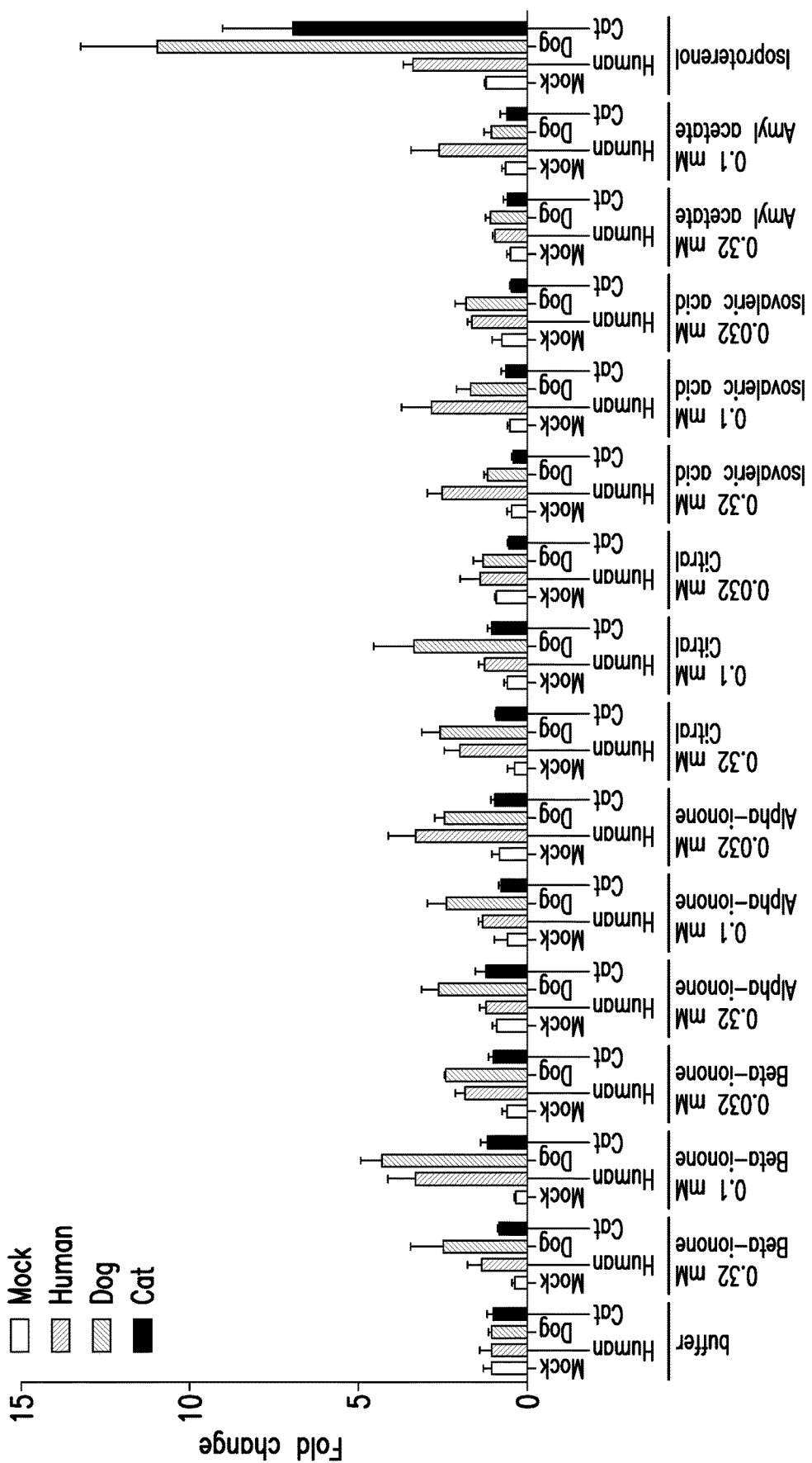

FIG. 29 shows the results of the chAMPion assay using OR_6 (OR4D6).

Figure 30:
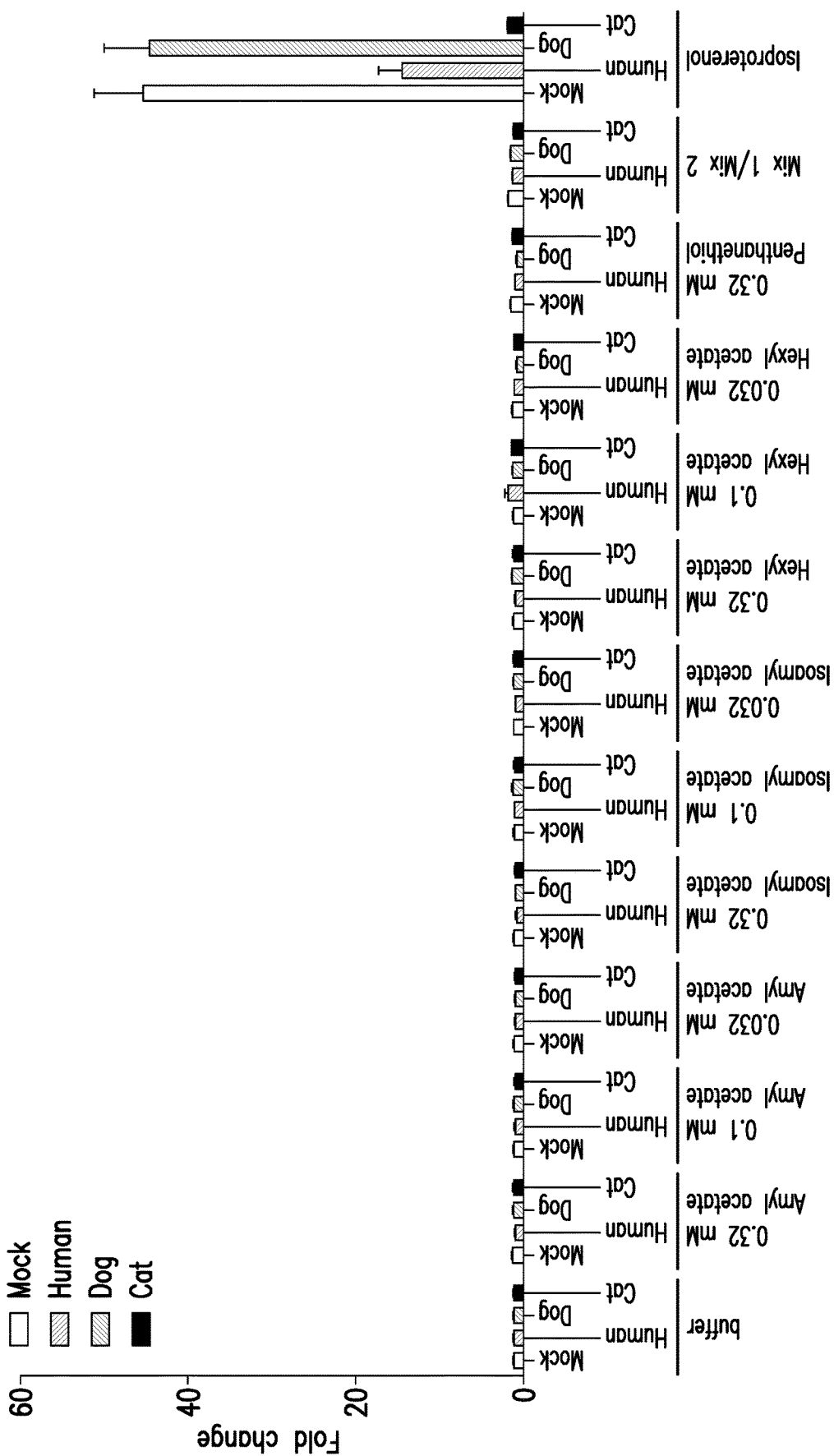

FIG. 30 shows the results of the CRE-NanoLuc luciferase assay using OR_7 (OR4E2).

Figure 31:
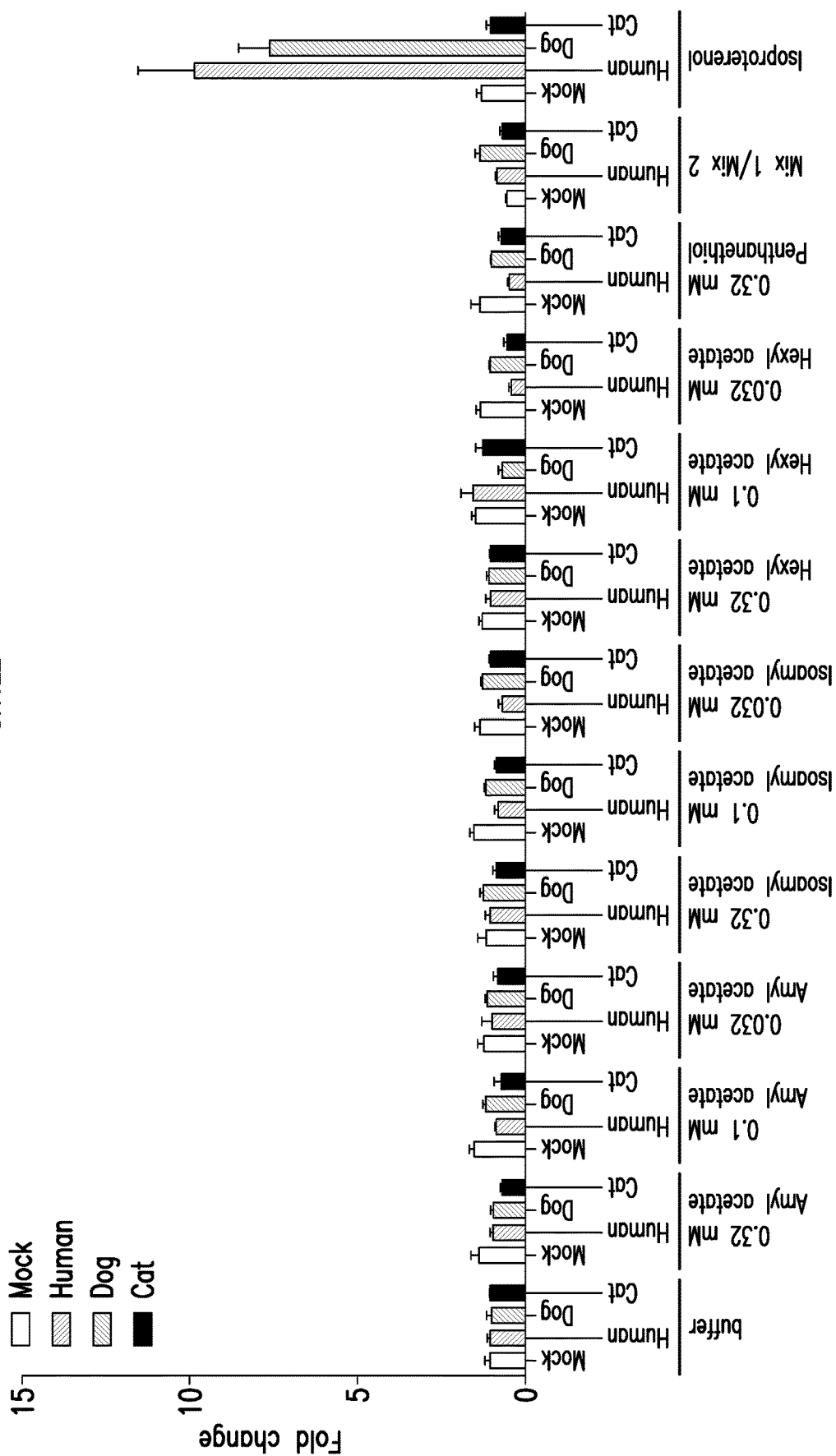

FIG. 31 shows the results of the chAMPion assay using OR_7 (OR4E2).

Figure 32:
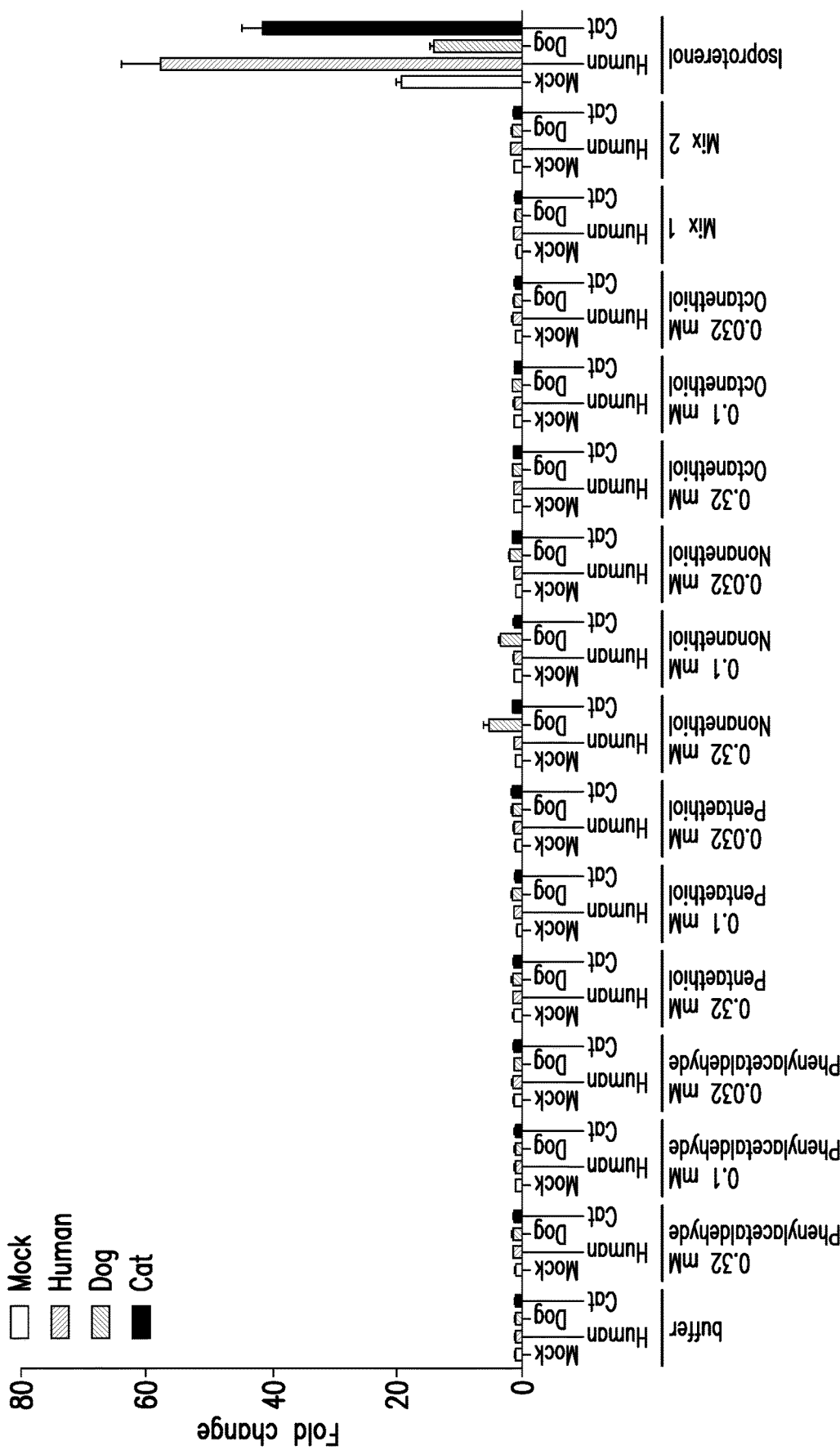

FIG. 32 shows the results of the CRE-NanoLuc luciferase assay using OR_8 (OR2C1).

Figure 33:
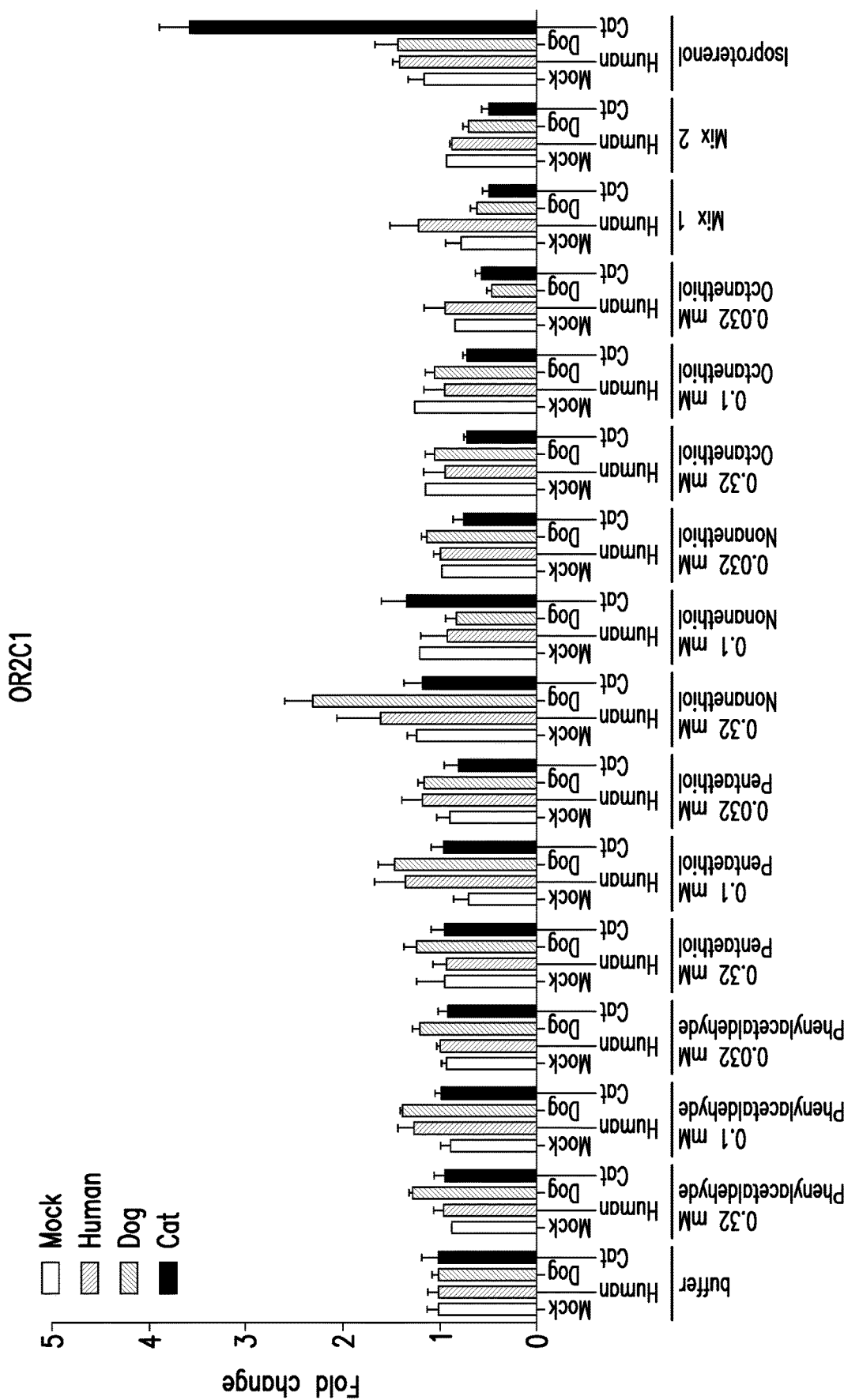

FIG. 33 shows the results of the chAMPion assay using OR_8 (OR2C1).

Figure 34:
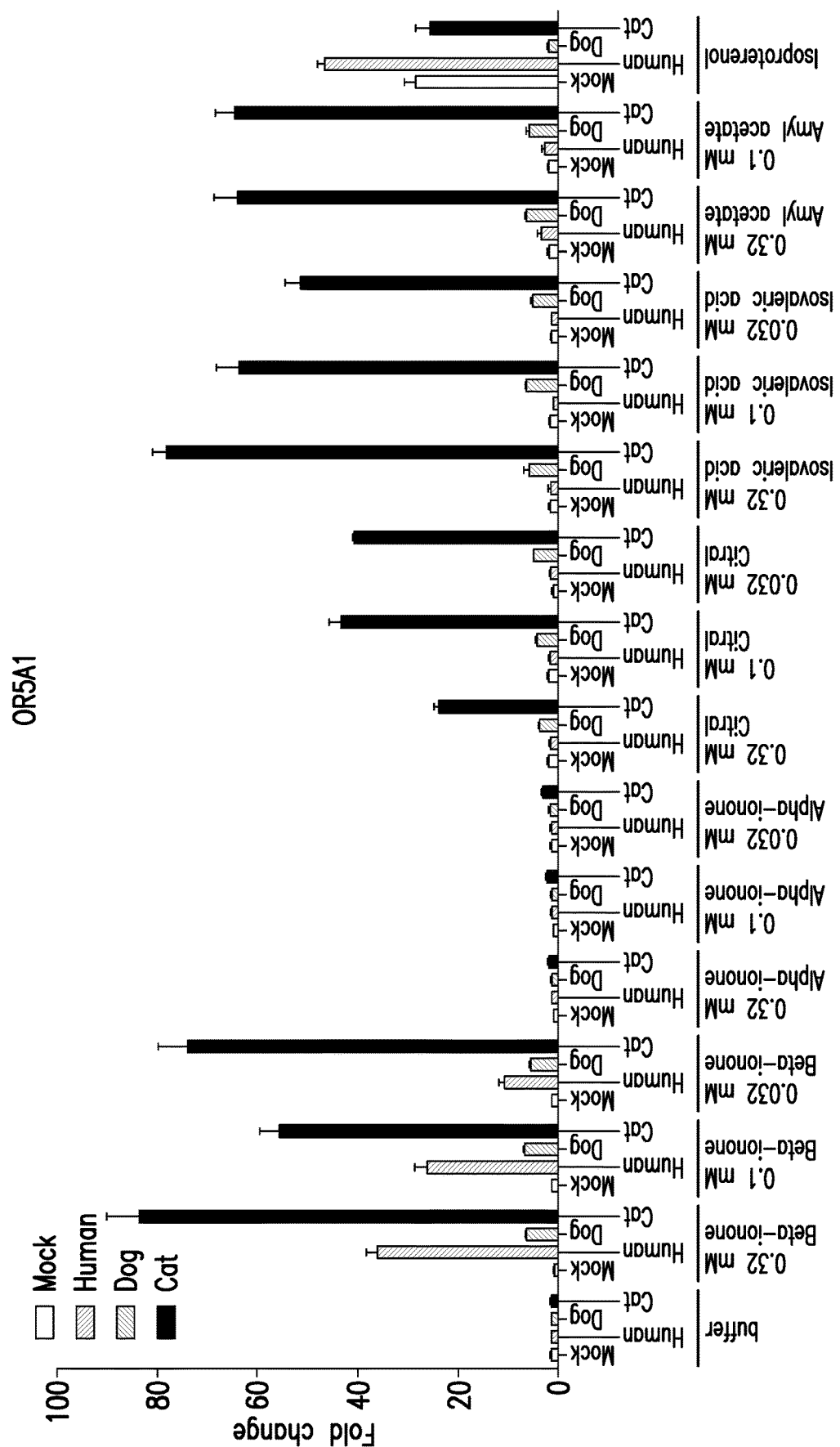

FIG. 34 shows the results of the CRE-NanoLuc luciferase assay using OR_9 (OR5A1).

Figure 35:
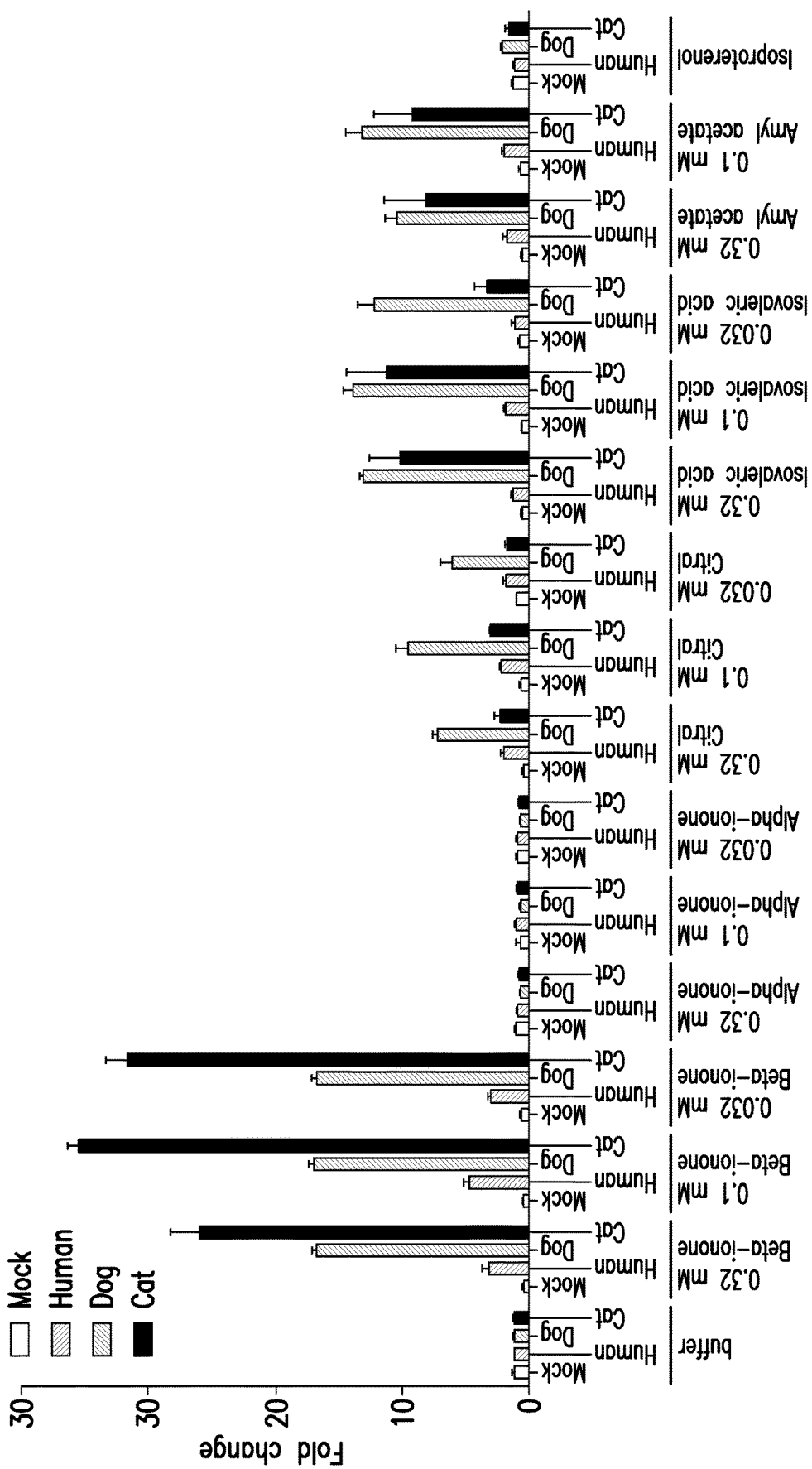

FIG. 35 shows the results of the chAMPion assay using OR_9 (OR5A1).

Figure 36:
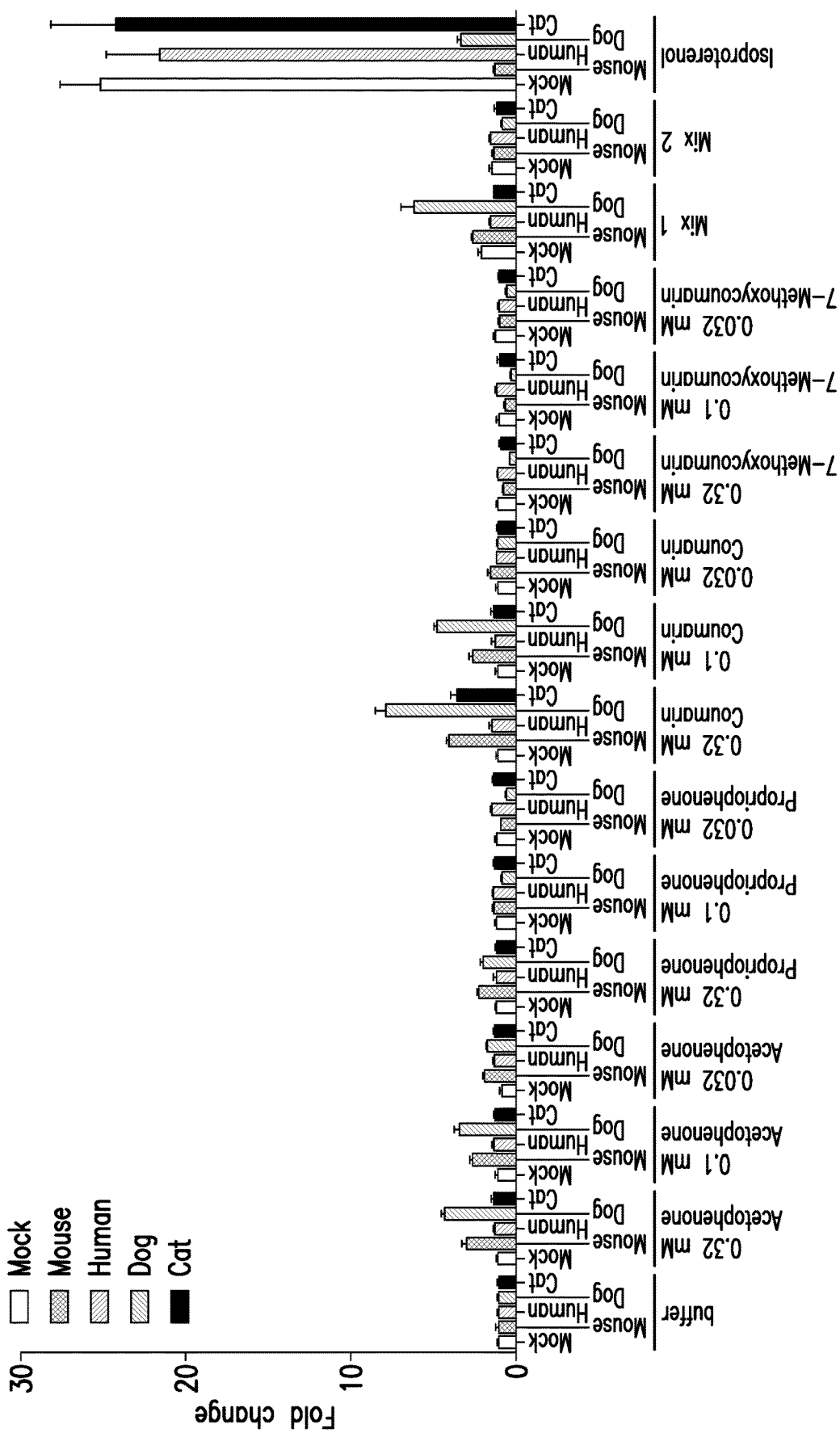

FIG. 36 shows the results of the CRE-NanoLuc luciferase assay using OR_10 (OR8B8).

Figure 37:
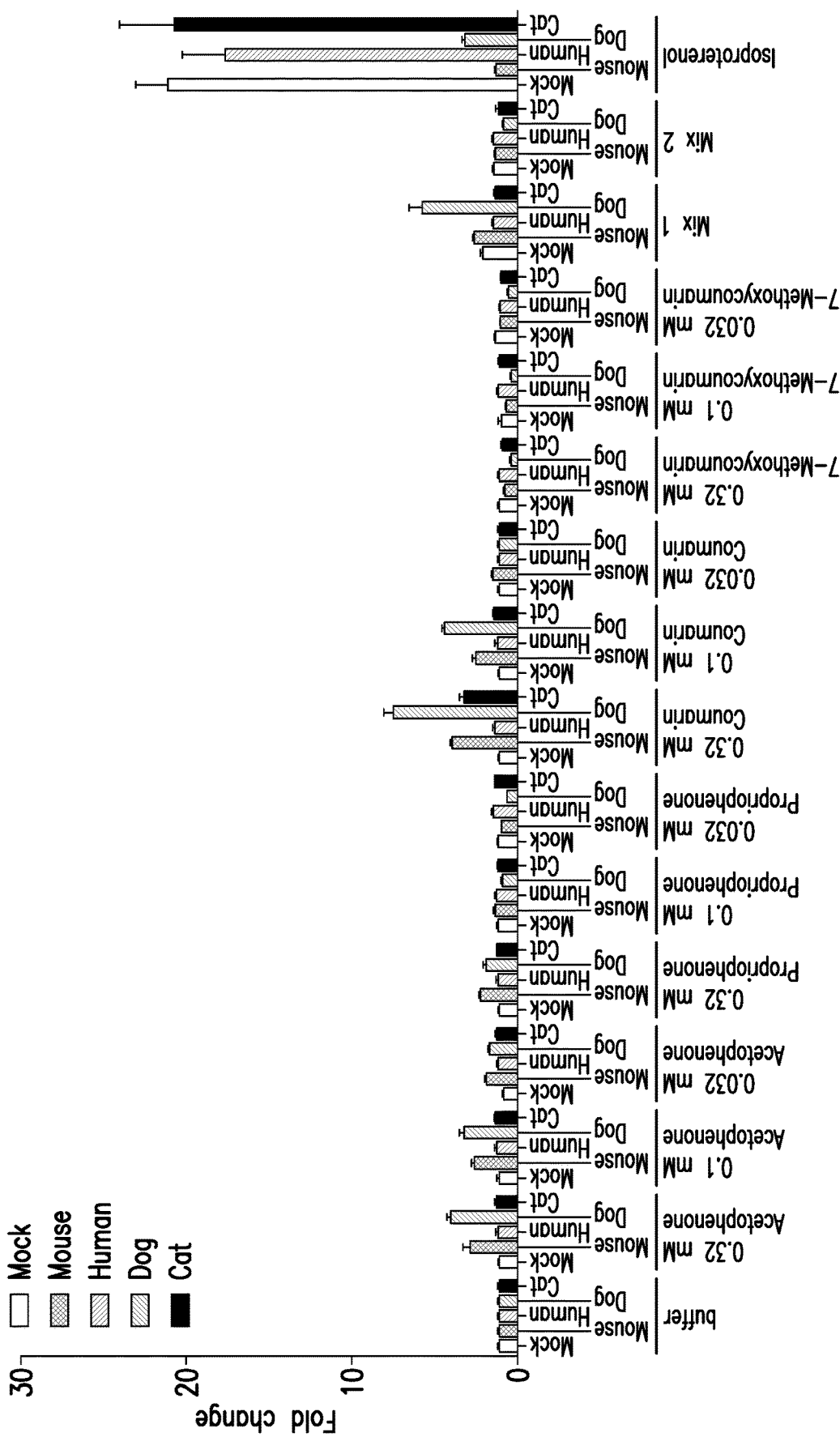

FIG. 37 shows the results of the chAMPion assay using OR_10 (OR8B8).

Figure 38A:
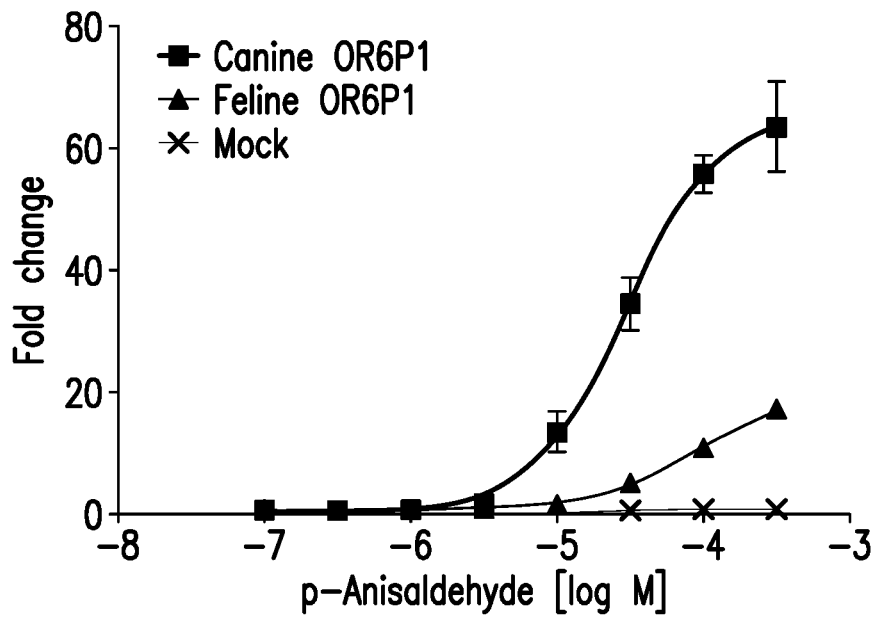
Figure 38B:
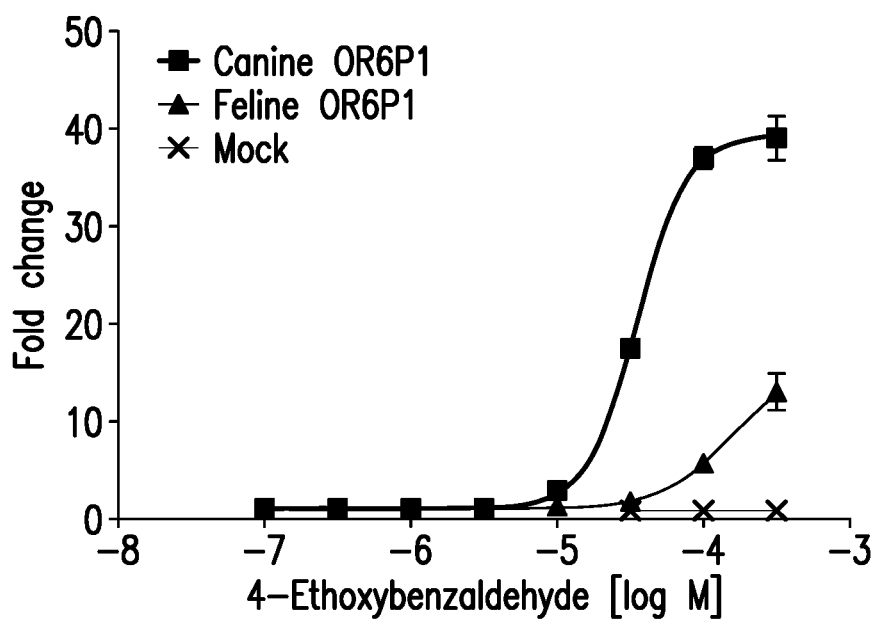
Figure 39A:
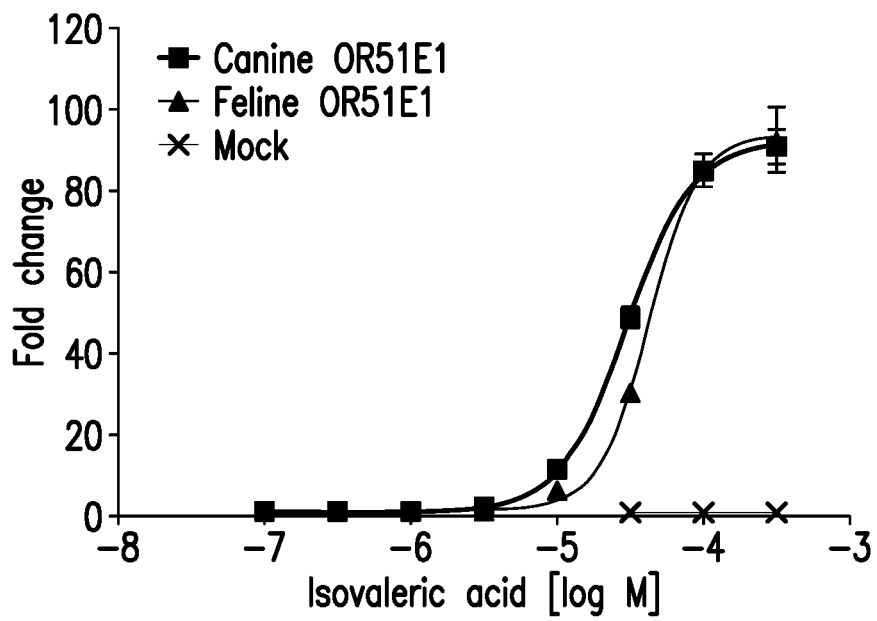
Figure 39B:
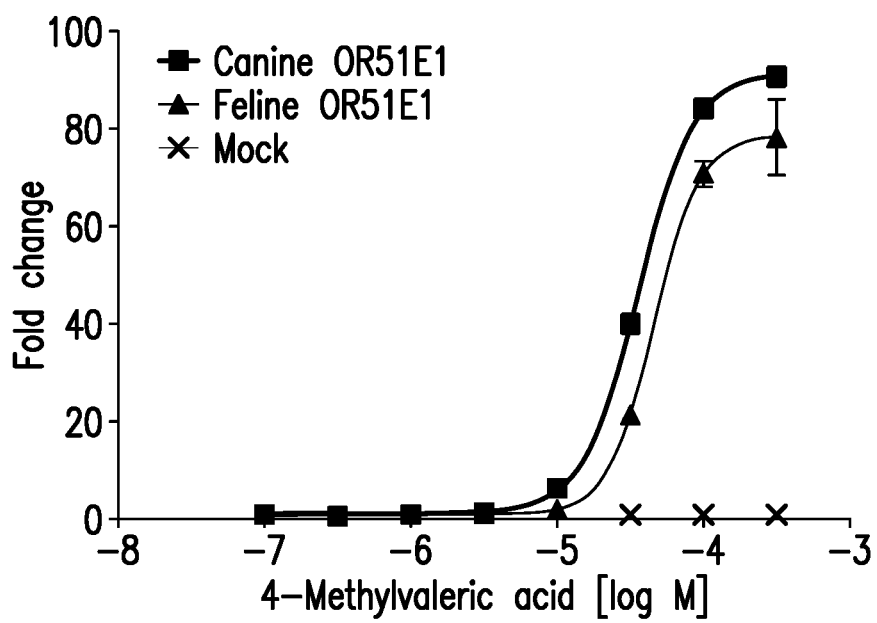
Figure 39C:
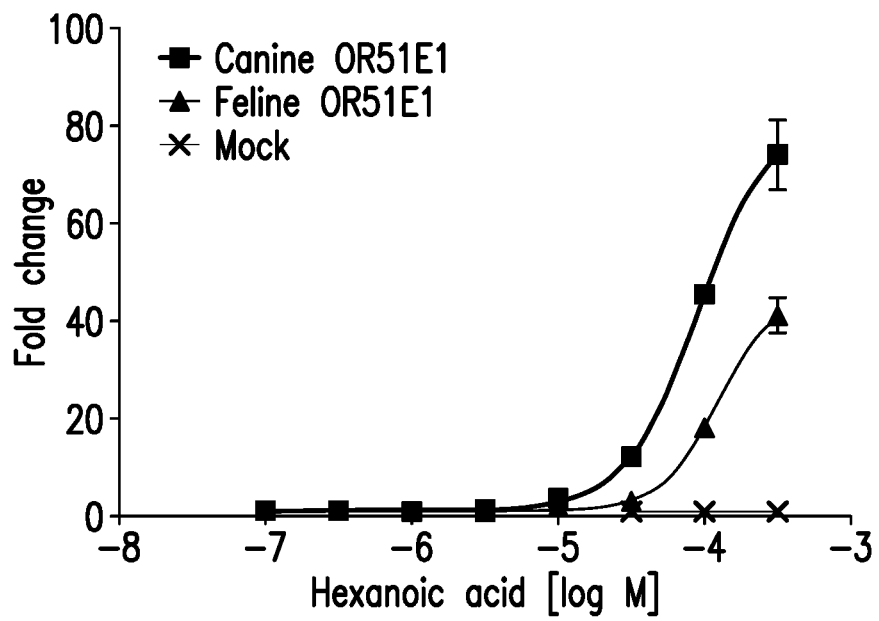
Figure 39D:
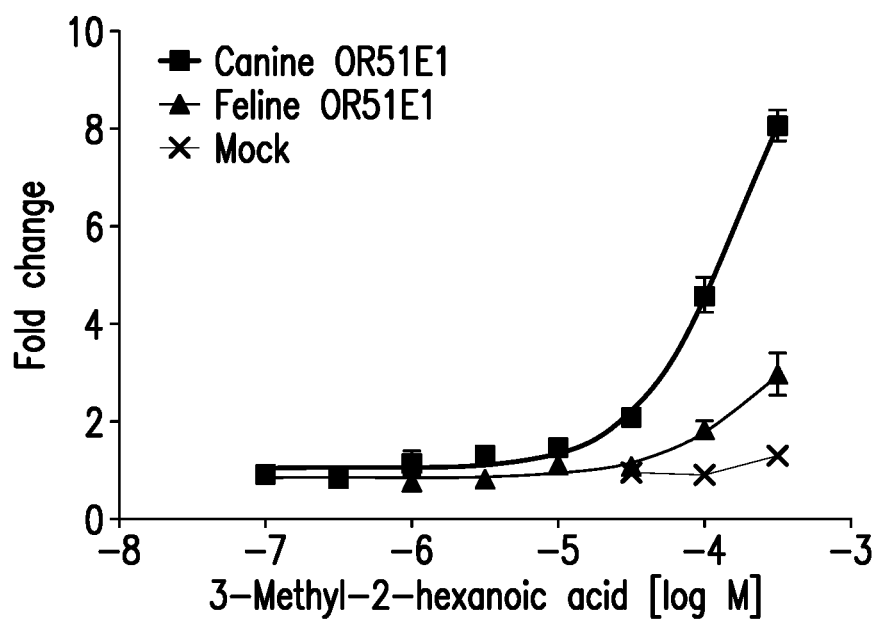

FIGS. 38A-38B show the dose-response curves of the positive ligands for OR_2 (OR6P1). A) The dose-response curves of para-anisaldehyde using mock, feline and canine receptors. B) The dose-response curves of 4-ethoxybenzaldehyde using mock, feline and canine receptors.

FIGS. 39A-39D show the dose-response curves of the positive ligands for OR_3 (OR51E1). A) The dose-response curves of isovaleric acid using mock, feline and canine receptors. B) The dose-response curves of 4-methyl-valeric acid using mock, feline and canine receptors. C) The dose-response curves of hexanoic acid using mock, feline and canine receptors. D) The dose-response curves of 3-methyl-2-hexanoic acid using mock, feline and canine receptors.

Figure 40A:
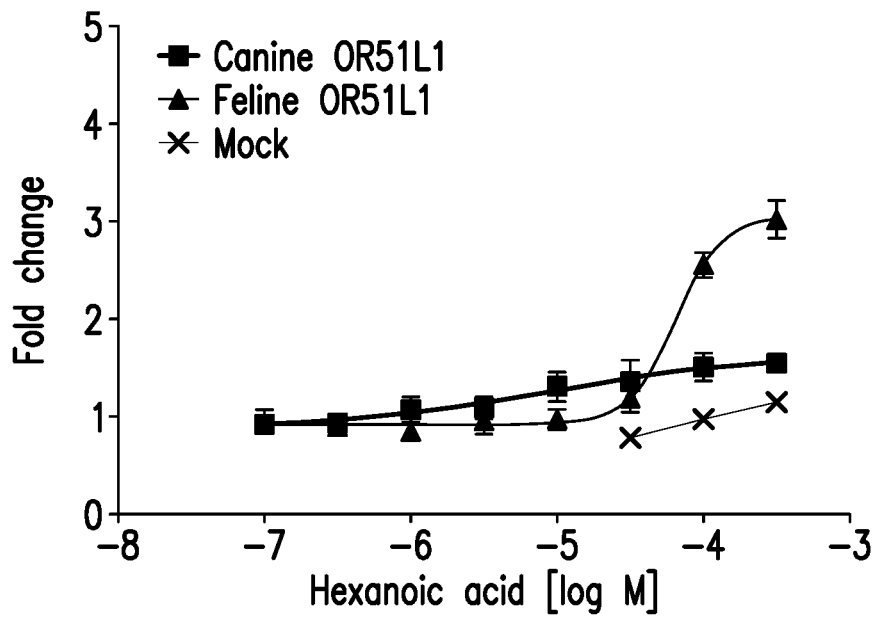
Figure 40B:
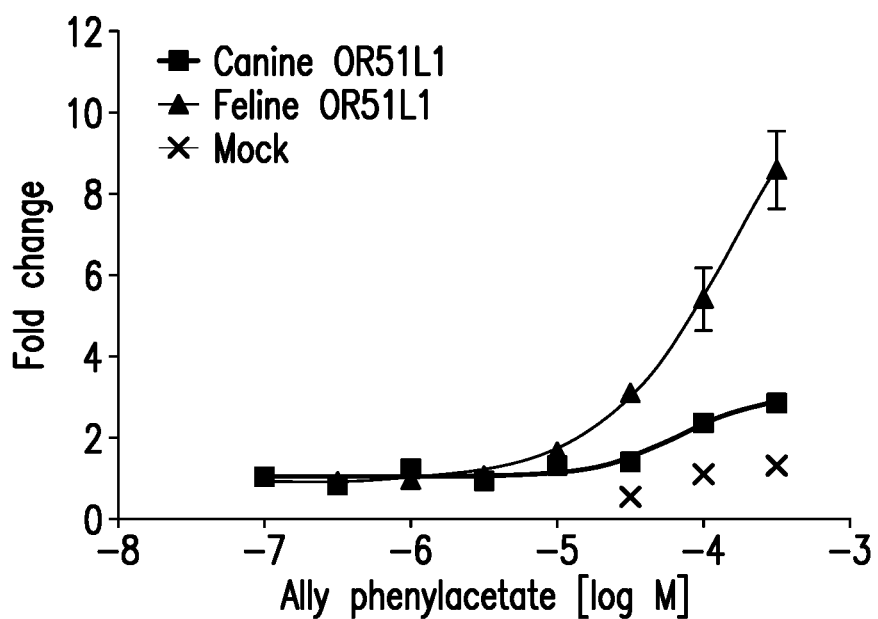

FIGS. 40A-40B show the dose-response curves of the positive ligands for OR_4 (OR51L1). A) The dose-response curves of hexanoic acid using mock, feline and canine receptors. B) The dose-response curves of allyl-phenylacetate using mock, feline and canine receptors.

Figure 41A:
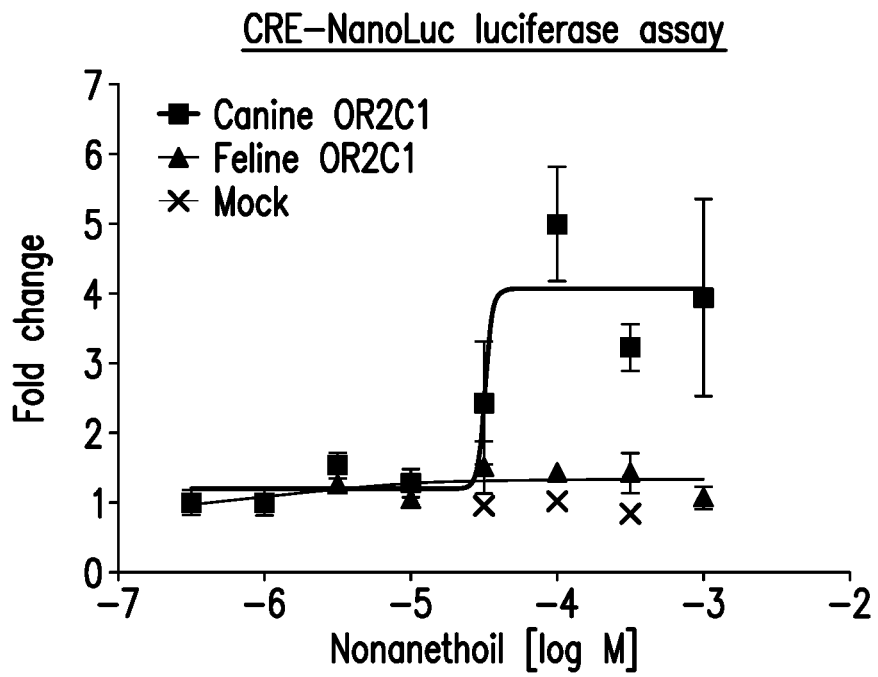
Figure 41B:
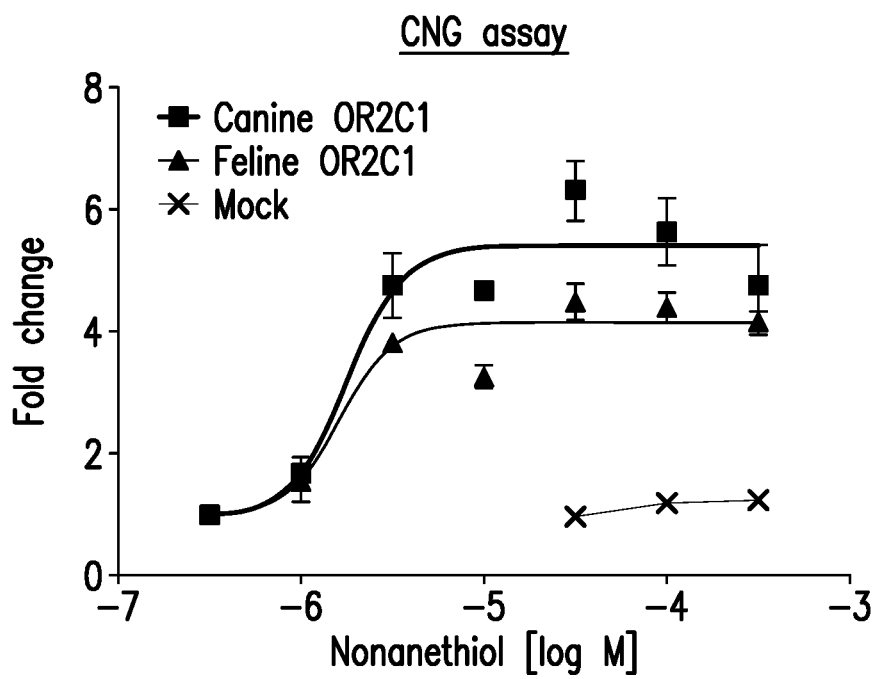
Figure 42A:
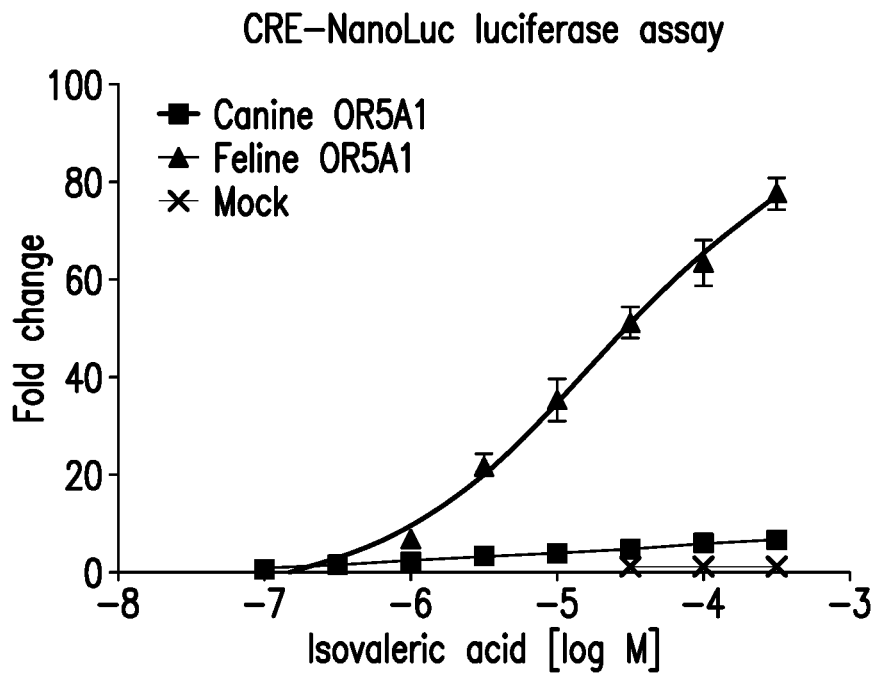
Figure 42B:
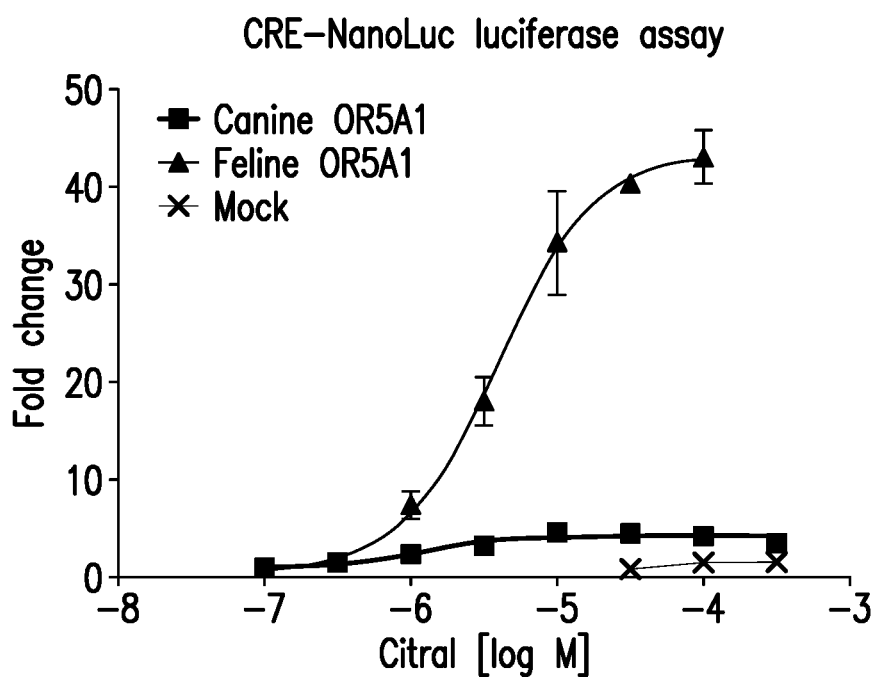
Figure 42C:
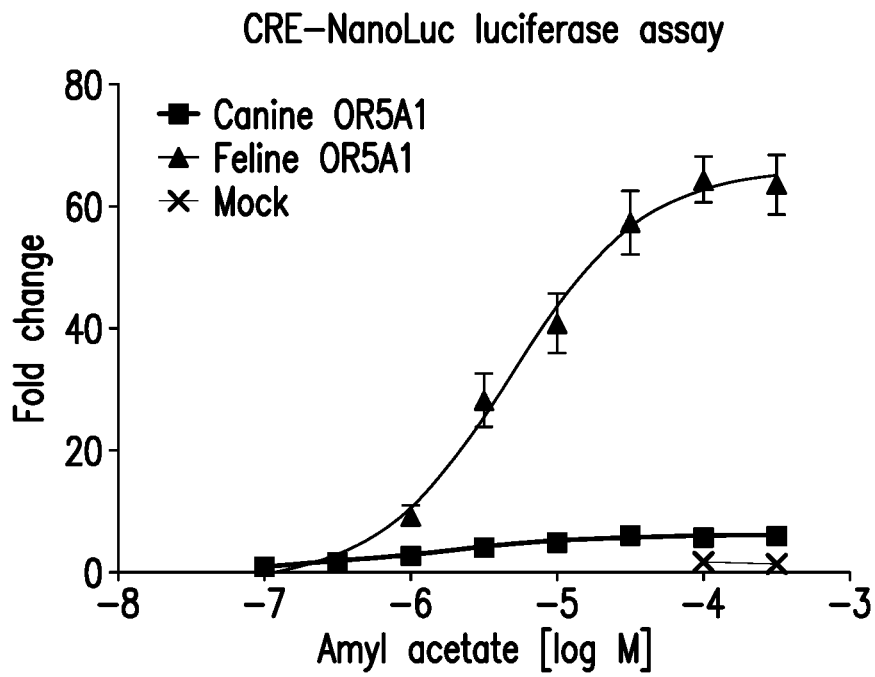
Figure 42D:
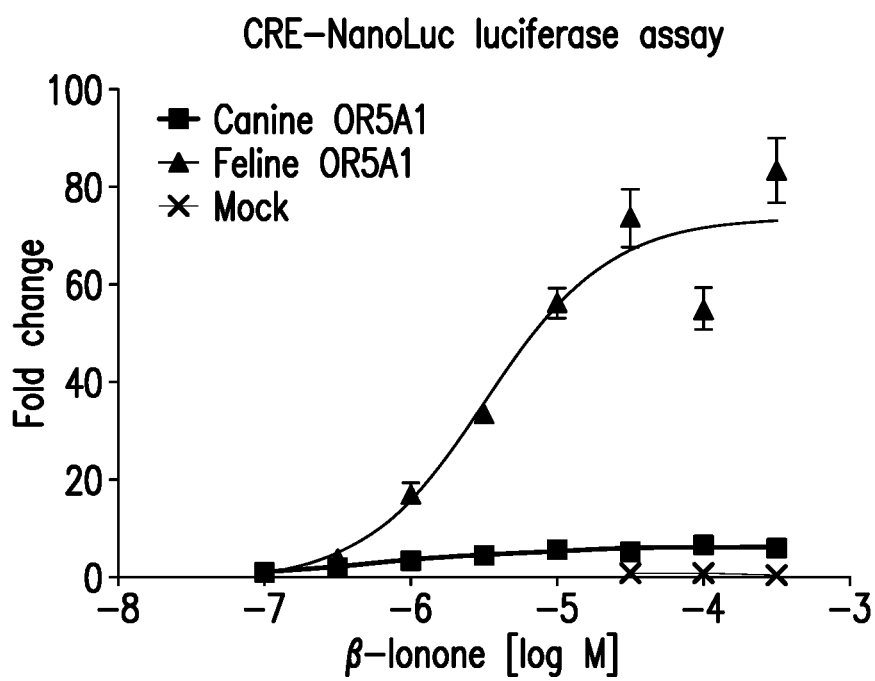
Figure 42E:
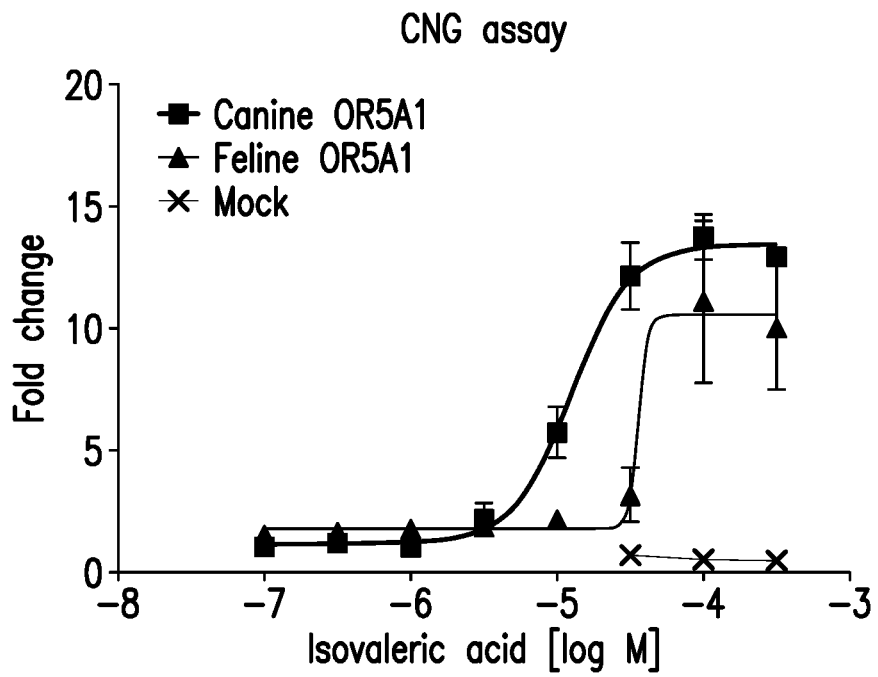
Figure 42F:
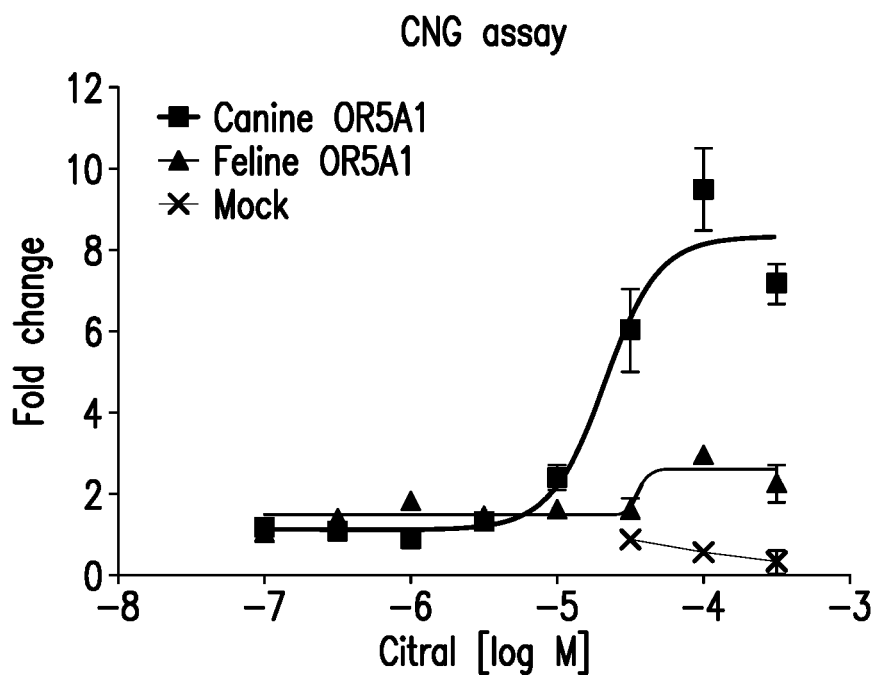
Figure 42G:
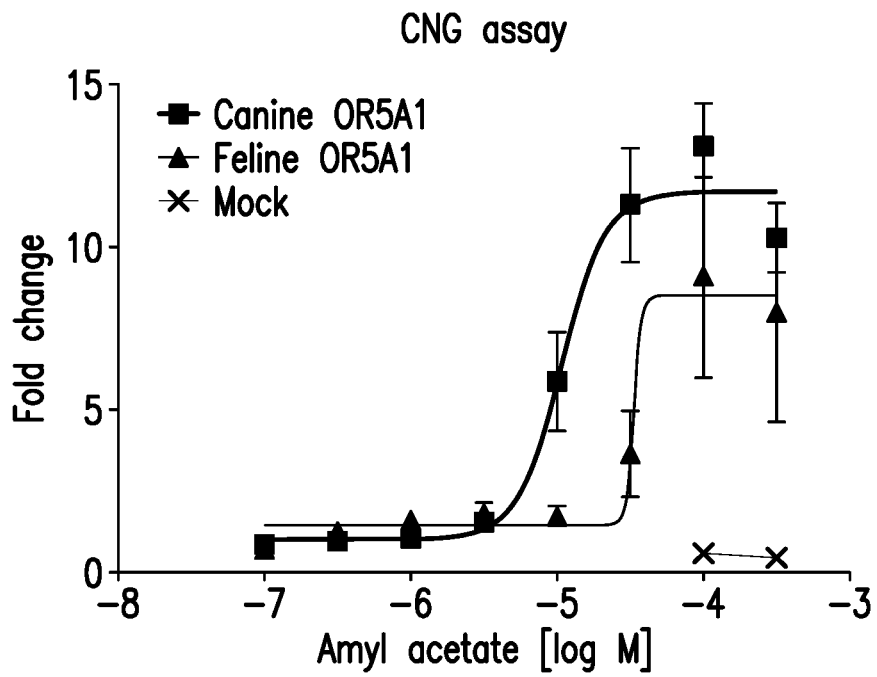
Figure 42H:
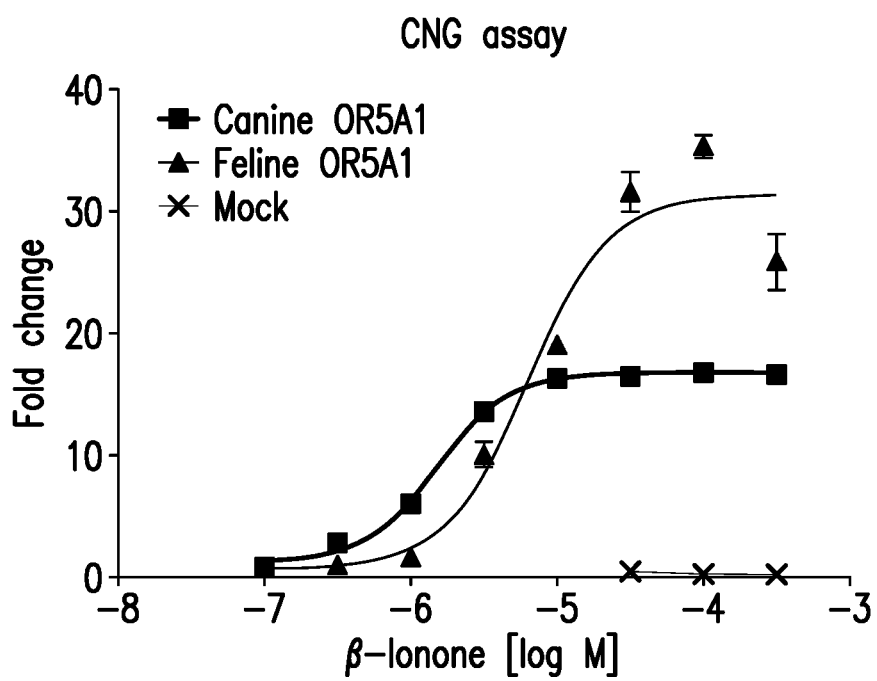

FIGS. 41A-41B show the dose-response curves of the positive ligands for OR_8 (OR2C1). A) The dose-response curves of nonanethiol using mock, feline and canine receptors and using the CRE-NanoLuc luciferase assay. B) The dose-response curves of nonanethiol using mock, feline and canine receptors and using the CNG assay.

FIGS. 42A-42H show the dose-response curves of the positive ligands for OR_9 (OR5A1). A) The dose-response curves of isovaleric acid using mock, feline and canine receptors and using the CRE-NanoLuc luciferase assay. B) The dose-response curves of citral using mock, feline and canine receptors and using the CRE-NanoLuc luciferase assay. C) The dose-response curves of amyl acetate using mock, feline and canine receptors and using the CRE-NanoLuc luciferase assay. D) The dose-response curves of beta-ionone using mock, feline and canine receptors and using the CRE-NanoLuc luciferase assay. E) The dose-response curves of isovaleric acid using mock, feline and canine receptors and using the CNG assay. F) The dose-response curves of citral using mock, feline and canine receptors and using the CNG assay. G) The dose-response curves of amyl acetate using mock, feline and canine receptors and using the CNG assay. H) The dose-response curves of beta-ionone using mock, feline and canine receptors and using the CNG assay. Human OR5A1 is only responsive in CRE-Nanoluc assay, which responds only to β-ionone. Dog OR5A1 has slightly different response profile in both assays: in CRE-NanoLuc assay the receptor responds to all four compounds with similar EC50 and Emax; in CNG assay the receptor responds to all four compounds, but the response to β-ionone has the lowest EC50 and the highest Emax. Cat OR5A1 has different response profile in both assays: in CRE-NanoLuc assay the receptor responds to all four compounds with similar EC50 and Emax; in CNG assay the receptor has strong response only to β-ionone, but has weaker responses for isovaleric acid and amyl acetate, and no response to citral. The difference in response profiles in both assays might be due to different assay protocols and longer incubation times in the CRE-NanoLuc assay.

Figure 43A:
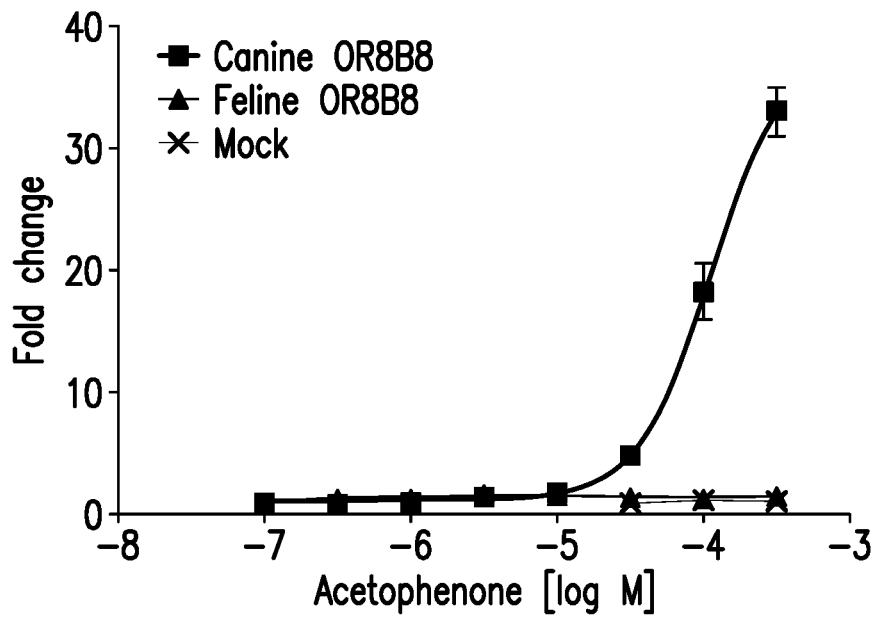
Figure 43B:
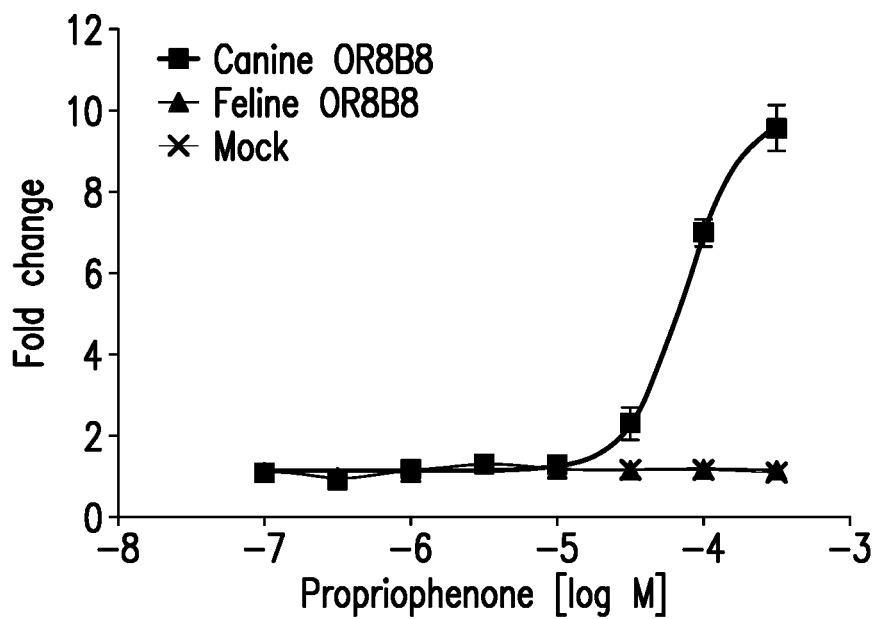
Figure 43C:
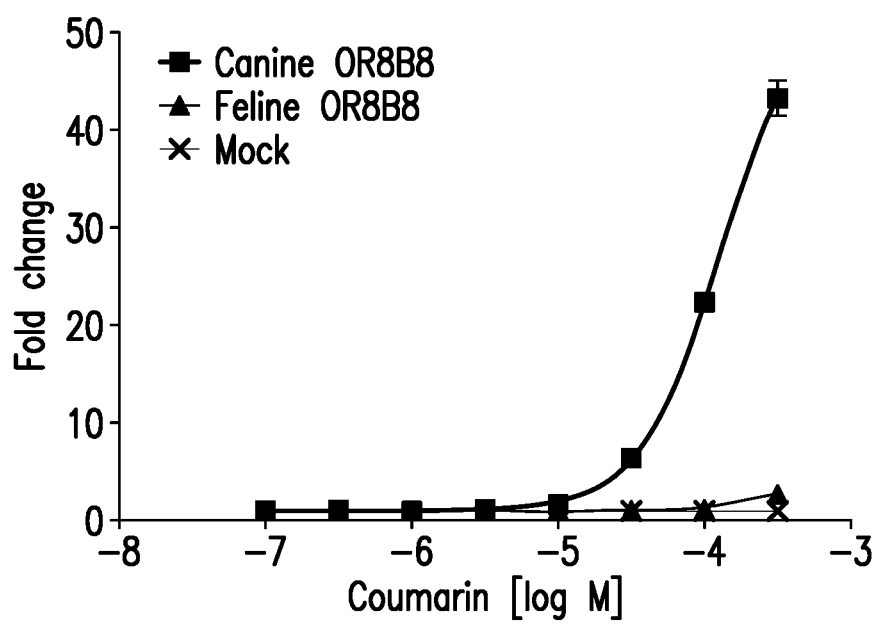

FIGS. 43A-43C show the dose-response curves of the positive ligands for OR_10 (OR8B8). A) The dose-response curves of acetophenone using mock, feline and canine receptors. B) The dose-response curves of propriophenone using mock, feline and canine receptors. C) The dose-response curves of coumarin using mock, feline and canine receptors.

DETAILED DESCRIPTION

The presently disclosed subject matter relates to methods for screening and identifying compounds that modulate the activity and/or expression of olfactory receptors. The presently disclosed subject matter further relates to making fragrant, palatable, nutritionally-complete pet food products, medicines, as well as non-nutritionally-complete pet food products (e.g., snack, care and treats), wherein the raw materials of the pet food and/or finalized pet food product or medicine is screened to determine if it contains compounds that modulate the olfactory receptors. Furthermore, such screening methods can be used to select raw materials and/or finalized pet food products that do not comprise repellant compounds. Compounds identified through said methods can be used to modify the fragrance and/or palatability of pet food products and medicines by increasing or decreasing an attractive or repellant odor. Said compounds can also be used to increase a repellant odor of an object, and thereby reduce contact, palatability and ingestion by a cat or a dog.

1. Definitions

The terms used in this specification generally have their ordinary meanings in the art, within the context of this invention and in the specific context where each term is used. Certain terms are discussed below, or elsewhere in the specification, to provide additional guidance to the practitioner in describing the methods and compositions of the invention and how to make and use them.

As used herein, the use of the word "a" or "an" when used in conjunction with the term "comprising" in the claims and/or the specification may mean "one," but it is also consistent with the meaning of "one or more," "at least one," and "one or more than one." Still further, the terms "having," "including," "containing" and "comprising" are interchangeable and one of skill in the art is cognizant that these terms are open ended terms.

The term "about" or "approximately" means within an acceptable error range for the particular value as determined by one of ordinary skill in the art, which will depend in part on how the value is measured or determined, i.e., the limitations of the measurement system. For example, "about" can mean within 3 or more than 3 standard deviations, per the practice in the art. Alternatively, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5-fold, and more preferably within 2-fold, of a value.

As used interchangeably herein, "odor", "smell" and "aroma" refer to a sensation caused by activation of receptor cells in a subject's olfactory system. In certain embodiments, odor can be characterized by a set of psychophysical descriptors, such as, for example, one or more of a fruity, floral, honey, fatty, minty and metallic smell. See, e.g., Dravnieks, Atlas of Odor Character Profiles, American Society for Testing and Materials, 1985; Castro et al., PLOS ONE, 0073289, 2014, the contents of which are incorporated herein by reference. In certain embodiments, an olfactory sense is elicited in a subject by an "odorant." In certain embodiments, combination of different odorants can be perceived as a new odor object. In certain embodiments, an odorant can be a synthetic odorant. In certain embodiments, the odorant is obtained or prepared from a natural source.

As used herein, "olfactory profile" refers to a combination of odor senses, each of which can be characterized by a set of psychophysical descriptors, such as, for example, one or more of a fruity, floral, honey, fatty, minty and metallic smell. In certain embodiments, a combination of different odorants can be perceived as a new odor sensory experience. In certain embodiments, an olfactory profile is produced by one or more odorant that is present in a composition at the same or different concentrations. In certain embodiments, an olfactory profile refers to the intensity of an odor or combination of odors, for example, a fruity, floral, honey, fatty, minty and metallic smell, as detected by a subject or any assay known in the art. In certain embodiments, modifying, changing or varying the combination of odorants in an olfactory profile can change the sensory experience of a subject.

As used herein, "flavor" refers to one or more sensory stimuli, such as, for example, one or more of taste (gustatory), smell (olfactory), touch (tactile) and temperature (thermal) stimuli. In certain non-limiting embodiments, the sensory experience of a subject exposed to a flavor can be classified as a characteristic experience for the particular flavor. For example, a flavor can be identified by the subject as being, but not limited to, a floral, citrus, berry, nutty, caramel, chocolate, peppery, smoky, cheesy, meaty, etc., flavor. As used herein, a flavor composition can be selected from a liquid, solution, dry powder, spray, paste, suspension and any combination thereof. The flavor can be a natural composition, an artificial composition, a nature identical, or any combination thereof.

As used herein, "flavor profile" refers to a combination of sensory stimuli, for example, tastes, olfactory, tactile and/or thermal stimuli. In certain embodiments, the flavor profile comprises one or more flavors which contribute to the sensory experience of a subject. In certain embodiments, modifying, changing or varying the combination of stimuli in a flavor profile can change the sensory experience of a subject.

As used herein "admixing," for example, "admixing the flavor composition or combinations thereof of the present application with a food product," refers to the process where the flavor composition, or individual components of the flavor composition, is mixed with or added to the completed product or mixed with some or all of the components of the product during product formation or some combination of these steps. When used in the context of admixing, the term "product" refers to the product or any of its components. This admixing step can include a process selected from the step of adding the flavor composition to the product, spraying the flavor composition on the product, coating the flavor composition on the product, suspending the product in the flavor composition, painting the flavor composition on the product, pasting the flavor composition on the product, encapsulating the product with the flavor composition, mixing the flavor composition with the product and any combination thereof. The flavor composition can be a solution, liquid, dry powder, spray, paste, suspension and any combination thereof.

As used herein, "palatability" can refer to the overall willingness of a human or non-human animal, for example, a companion animal, to eat a certain food product. Increasing the "palatability" of a food product can lead to an increase in the enjoyment and acceptance of the food by the human or non-human animal to ensure the human or non-human animal eats a "healthy amount" of the food. Decreasing the "palatability" of a food product can lead to a decrease in the enjoyment and acceptance of the food by the human or non-human animal. The term "healthy amount" of a food as used herein refers to an amount that enables the human or non-human animal to maintain or achieve an intake contributing to its overall general health in terms of micronutrients, macronutrients and calories, for example, such as set out in the "Mars Petcare Essential Nutrient Standards." In certain embodiments, "palatability" can mean a relative preference of a human or non-human animal for one food product over another. For example, when a human or non-human animal shows a preference for one of two or more food products, the preferred food product is more "palatable," and has "enhanced palatability." In certain embodiments, the relative palatability of one food product compared to one or more other food products can be determined, for example, in side-by-side, free-choice comparisons, e.g., by relative consumption of the food products, or other appropriate measures of preference indicative of palatability. Palatability can be determined by a standard testing protocol in which the animal has equal access to both food products such as a test called "two-bowl test" or "versus test." Such preference can arise from any of the animal's senses, but can be related to, inter alia, taste, aftertaste, smell, mouth feel and/or texture.

The term "pet food" or "pet food product" or "final pet food product" means a product or composition that is intended for consumption by a companion animal, such as cats, dogs, guinea pigs, rabbits, birds and horses. For example, but not by way of limitation, the companion animal can be a "domestic" dog, e.g., *Canis lupus familiaris*. In certain embodiments, the companion animal can be a "domestic" cat such as *Felis domesticus*. A "pet food" or "pet food product" includes any food, feed, snack, food supplement, liquid, beverage, treat, toy (chewable and/or consumable toys), meal substitute or meal replacement.

The term "human food" or "human food product" or "final human food product" means a product or composition that is intended for consumption by a human. A "human food" or "human food product" includes any food, feed, snack, food supplement, liquid, beverage, treat, meal substitute or meal replacement.

In certain embodiments, a "food product" includes human and/or pet food products.

As used herein "nutritionally-complete" refers to pet food product that contains all known required nutrients for the intended recipient of the pet food product, in appropriate amounts and proportions based, for example, on recommendations of recognized or competent authorities in the field of companion animal nutrition. Such foods are therefore capable of serving as a sole source of dietary intake to maintain life, without the addition of supplemental nutritional sources.

The term "raw material" means a plant and/or animal material before being processed or manufactured into a final pet food product. In certain embodiments, a "raw material" is not significantly processed in order to separate it into individual elements prior to analysis (e.g., by extraction, purification, fractionation and/or concentration). A "raw material" includes a protein source for a pet food product. In certain embodiments, the raw material is a novel protein source that does not compete with the human food sources (i.e., a protein source that is not commonly eaten by humans). In certain embodiments, the raw material is a by-product of the human food chain. In certain non-limiting embodiments, the "raw material" is processed, for example, in order to separate it into individual elements prior to analysis (e.g., by extraction, purification, fractionation and/or concentration), prior to being analyzed according to the methods described herein.

As used herein "flavor composition" refers to at least one compound or biologically acceptable salt thereof that modulates, including enhancing, multiplying, potentiating, decreasing, suppressing, or inducing, the tastes, smells, flavors and/or textures of a natural or synthetic tastant, flavoring agent, taste profile, flavor profile and/or texture profile in an animal or a human. In certain embodiments, the flavor composition comprises a combination of compounds or biologically acceptable salts thereof. In certain embodiments, the flavor composition includes one or more excipients.

As used herein, "odor deterrent," "odor deterrent product," or "odor deterrent composition" refers to a product or composition containing at least one compound or biologically acceptable salt thereof that provides a repellant odor to an object. In certain embodiments, the odor deterrent discourages an animal from contacting, approaching, chewing, licking, or consuming an object, for example, a food or liquid product. In certain embodiments, the object is, for example but not limited to, clothing, shoes, carpet, furniture, household items, pesticides, herbicides, or poisonous compounds. In certain embodiments, the object is another animal or the animal itself. In other embodiment, the object is toxic to the animal, or would be detrimental to the animal's health upon contact or ingestion.

As used herein, the terms "modulates" or "modifies" refers to an increase or decrease in the amount, quality or effect of a particular activity of a receptor and/or an increase or decrease in the expression, activity or function of a receptor. "Modulators," as used herein, refer to any inhibitory or activating compounds identified using in silico, in vitro and/or in vivo assays for, e.g., agonists, antagonists, allosteric modulators and their homologs, including fragments, variants and mimetics.

"Inhibitors" or "antagonists," as used herein, refer to modulating compounds that reduce, decrease, block, prevent, delay activation, inactivate, desensitize or down regulate the biological activity and/or expression of a receptor or pathway of interest. The term "antagonist" includes full, partial, and neutral antagonists as well as inverse agonists.

"Inducers," "activators" or "agonists," as used herein, refer to modulating compounds that increase, induce, stimulate, open, activate, facilitate, enhance activation, sensitize or upregulate a receptor or pathway of interest. The term "agonist" includes full and partial agonists.

"Allosteric modulators" as used herein, refer to "positive allosteric modulators" and "negative allosteric modulators." "Positive allosteric modulators" refer to modulating compounds that increase, induce, stimulate, open, activate, facilitate, enhance activation, sensitize or up regulate a receptor or pathway of interest caused by the binding of a different compound to the receptor. "Negative allosteric modulators" refer to modulating compounds that reduce, decrease, block, prevent, delay activation, inactivate, desensitize or down regulate the biological activity and/or expression of a receptor or pathway of interest caused by the binding of a different compound to the receptor.

As used herein, the terms "vector" and "expression vector" refer to DNA molecules that are either linear or circular, into which another DNA sequence fragment of appropriate size can be integrated. Such DNA fragment(s) can include additional segments that provide for transcription of a gene encoded by the DNA sequence fragment. The additional segments can include and are not limited to: promoters, transcription terminators, enhancers, internal ribosome entry sites, untranslated regions, polyadenylation signals, selectable markers, origins of replication and such like. Expression vectors are often derived from plasmids, cosmids, viral vectors and yeast artificial chromosomes. Vectors are often recombinant molecules containing DNA sequences from several sources.

The term "operably linked," when applied to DNA sequences, for example in an expression vector, indicates that the sequences are arranged so that they function cooperatively in order to achieve their intended purposes, i.e., a promoter sequence allows for initiation of transcription that proceeds through a linked coding sequence as far as the termination signal.

The term "nucleic acid molecule" and "nucleotide sequence," as used herein, refers to a single or double stranded covalently-linked sequence of nucleotides in which the 3' and 5' ends on each nucleotide are joined by phosphodiester bonds. The nucleic acid molecule can include deoxyribonucleotide bases or ribonucleotide bases, and can be manufactured synthetically in vitro or isolated from natural sources.

The terms "polypeptide," "peptide," "amino acid sequence" and "protein," used interchangeably herein, refer to a molecule formed from the linking of at least two amino acids. The link between one amino acid residue and the next is an amide bond and is sometimes referred to as a peptide bond. A polypeptide can be obtained by a suitable method known in the art, including isolation from natural sources, expression in a recombinant expression system, chemical synthesis or enzymatic synthesis. The terms can apply to amino acid polymers in which one or more amino acid residue is an artificial chemical mimetic of a corresponding naturally occurring amino acid, as well as to naturally occurring amino acid polymers and non-naturally occurring amino acid polymers.

The term "amino acid," as used herein, refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, gamma-carboxyglutamate and O-phosphoserine. Amino acid analogs and derivatives can refer to compounds that have the same basic chemical structure as a naturally occurring amino acid, i.e., a carbon that is bound to a hydrogen, a carboxyl group, an amino group and an R group, e.g., homoserine, norleucine, methionine sulfoxide and methionine methyl sulfonium. Such analogs can have modified R groups (e.g., norleucine) or modified peptide backbones, but retain the same basic chemical structure as a naturally occurring amino acid. Amino acid mimetics means chemical compounds that have a structure that is different from the general chemical structure of an amino acid, but that function in a manner similar to a naturally occurring amino acid.

The terms "isolated" or "purified", used interchangeably herein, refers to a nucleic acid, a polypeptide, or other biological moiety that is removed from components with which it is naturally associated. The term "isolated" can refer to a polypeptide that is separate and discrete from the whole organism with which the molecule is found in nature or is present in the substantial absence of other biological macromolecules of the same type. The term "isolated" with respect to a polynucleotide can refer to a nucleic acid molecule devoid, in whole or part, of sequences normally associated with it in nature; or a sequence, as it exists in nature, but having heterologous sequences in association therewith; or a molecule disassociated from the chromosome.

As used herein, the term "recombinant" can be used to describe a nucleic acid molecule and refers to a polynucleotide of genomic, RNA, DNA, cDNA, viral, semisynthetic or synthetic origin which, by virtue of its origin or manipulation is not associated with all or a portion of the polynucleotide with which it is associated in nature.

The term "fusion," as used herein, refers to joining of different peptide or protein segments by genetic or chemical methods wherein the joined ends of the peptide or protein segments may be directly adjacent to each other or may be separated by linker or spacer moieties such as amino acid residues or other linking groups.

2. Olfactory Receptors

The presently disclosed subject matter provides olfactory receptors for use in the disclosed methods. The olfactory receptors of the present disclosure can include mammalian olfactory receptors such as, but not limited to, human, canine and feline olfactory receptors.

In certain non-limiting embodiments, the olfactory receptor is a human olfactory receptor, for example, human olfactory receptor HsOR17.1.11 (hOR3A1), HsOR1.4.8 (hOR6P1), HsOR11.3.14 (hOR51E1), HsOR11.3.40 (hOR51L1), HsOR14.1.27 (hOR11H6), HsOR11.13.7 (hOR4D6), HsOR14.2.5 (hOR4E2), HsOR16.1.3 (hOR2C1), HsOR11.13.6 (hOR5A1), HsOR11.18.36 (hOR8B8), or combinations thereof.

In certain non-limiting embodiments, the olfactory receptor is a canine olfactory receptor, for example, canine olfactory receptor CafaOR9.2.9, CafaOR38.1.21, CafaOR21.2.15, CafaOR21.2.43, CafaOR15.2.20, CafaOR18.3.11, CafaOR15.3.1, CafaOR6.3.1, CafaOR18.3.12, CafaOR5.2.5, or combinations thereof. In certain non-limiting embodiments, the olfactory receptor is a canine olfactory receptor having a nucleotide sequence or an amino acid sequence set forth in SEQ ID NOs:61-2260.

In certain non-limiting embodiments, the olfactory receptor is a feline olfactory receptor, for example, feline olfactory receptor E1:13347030-13347977, F1:65134904-65135858, D1:62955839-62956792, D1:63312327-63313289, B3:72908295-72909287, D1:105486528-105487493, B3:74116955-74117893, E3:40237904-40238842, D1:105462554-105463512, D1:21266824-21267768, or combinations thereof. In certain non-limiting embodiments, the olfactory receptor is a feline olfactory receptor having a nucleotide sequence or an amino acid sequence set forth in SEQ ID NOs:2261-3808.

The olfactory receptors tested in the working examples, along with their synonyms and group designations are listed in Table 1.

TABLE 1

| OR Orthologue Group | OR Orthologue Name | Human OR | Canine OR | Feline OR |
|---|---|---|---|---|
| OR_1 | OR3A1 | HsOR17.1.11 (hOR3A1) (SEQ ID NOs: 1 and 31) | CafaOR9.2.9 (canine OR3A1) (SEQ ID NOs: 11 and 41) | E1: 13347030-13347977 (feline OR3A1) (SEQ ID NOs: 21 and 51) |
| OR_2 | OR6P1 | HsOR1.4.8 (11OR6P1) (SEQ ID NOs: 2 and 32) | CafaOR38.1.21 (canine OR6P1) (SEQ ID NOs: 12 and 42) | F1: 65134904-65135858 (feline OR6P1) (SEQ ID NOs: 22 and 52) |
| OR_3 | OR51E1 | HsOR11.3.14 (hOR51E1) (SEQ ID NOs: 3 and 33) | CafaOR21.2.15 (canine OR51E1) (SEQ ID NOs: 13 and 43) | D1: 62955839-62956792 (feline OR51E1) (SEQ ID NOs: 23 and 53) |
| OR_4 | OR51L1 | HsOR11.3.40 (hOR51L1) (SEQ ID NOs: 4 and 34) | CafaOR21.2.43 (canine OR51L1) (SEQ ID NOs: 14 and 44) | D1: 63312327-63313289 (feline OR51L1) (SEQ ID NOs: 24 and 54) |
| OR_5 | OR11H6 | HsOR14.1.27 (hOR11H6) (SEQ ID NOs: 5 and 35) | CafaOR15.2.20 (canine OR11H6) (SEQ ID NOs: 15 and 45) | B3: 72908295-72909287 (feline OR11H6) (SEQ ID NOs: 25 and 55) |
| OR_6 | OR4D6 | HsOR11.13.7 (hOR4D6) (SEQ ID NOs: 6 and 36) | CafaOR18.3.11 (canine OR4D6) (SEQ ID NOs: 16 and 46) | D1: 105486528-105487493 (feline OR4D6) (SEQ ID NOs: 26 and 56) |
| OR_7 | OR4E2 | HsOR14.2.5 (hOR4E2) (SEQ ID NOs: 7 and 37) | CafaOR15.3.1 (canine OR4E2) (SEQ ID NOs: 17 and 47) | B3: 74116955-74117893 (feline OR4E2) (SEQ ID NOs: 27 and 57) |
| OR_8 | OR2C1 | HsOR16.1.3 (hOR2C1) (SEQ ID NOs: 8 and 38) | CafaOR6.3.1 (canine OR2C1) (SEQ ID NOs: 18 and 48) | E3: 40237904-40238842 (feline OR2C1) (SEQ ID NOs: 28 and 58) |
| OR_9 | OR5A1 | HsOR11.13.6 (hOR5A1) (SEQ ID NOs: 9 and 39) | CafaOR18.3.12 (canine OR5A1) (SEQ ID NOs: 19 and 49) | D1: 105462554-105463512 (feline OR5A1) (SEQ ID NOs: 29 and 59) |
| or_10 | OR8B8 | HsOR11.18.36 (hOR8B8) (SEQ ID NOs: 10 and 40) | CafaOR5.2.5 (canine OR8B8) (SEQ ID NOs: 20 and 50) | D1: 21266824-21267768 (feline OR8B8) (SEQ ID NOs: 30 and 60) |

In certain embodiments, an olfactory receptor for use in the presently disclosed methods encompasses a canine olfactory receptor comprising a nucleotide sequence set forth in SEQ ID NO: 11, 12, 13, 14, 15, 16, 17, 18, 19, or 20, an amino acid sequence set forth in SEQ ID NO:41, 42, 43, 44, 45, 46, 47, 48, 49, or 50, and/or a nucleotide sequence or an amino acid sequence set forth in SEQ ID NOs:61-2260, including fragments thereof (e.g., functional fragments thereof) and variants thereof.

In certain embodiments, an olfactory receptor for use in the presently disclosed methods encompasses a feline olfactory receptor comprising a nucleotide sequence set forth in SEQ ID NO:21, 22, 23, 24, 25, 26, 27, 28, 29, or 30, an amino acid sequence set forth in SEQ ID NO:51, 52, 53, 54, 55, 56, 57, 58, 59, or 60, and/or a nucleotide sequence or an amino acid sequence set forth in SEQ ID NOs:2261-3808, including fragments thereof (e.g., functional fragments thereof) and variants thereof.

In certain embodiments, the olfactory receptor for use in the presently disclosed subject matter can include a receptor encoded by a nucleotide sequence that is at least 85%, at least 90%, at least 91%, at least 92%, at least 93%, at least 94%, at least 95%, at least 96%, at least 97%, at least 98% or at least 99% homologous to any one of SEQ ID NOs: 11-30 and/or a nucleotide sequence set forth in SEQ ID NOs:61-3808, (homology, as that term is used herein, may be measured using standard software such as BLAST or FASTA), including fragments thereof (e.g., functional fragments thereof).

In certain embodiments, the olfactory receptor for use in the presently disclosed methods can include a receptor comprising an amino acid sequence that is between about 33 and 99%, between about 34 and 99%, between about 35 and 99%, between about 40 and 99%, between about 45 and 99%, between about 50 and 99%, between about 55 and 99%, between about 60 and 99%, between about 61 and 99%, between about 65 and 99%, between about 70 and 99%, between about 72 and 99%, between about 75 and 99%, between about 79 and 99%, between about 80 and 99%, between about 84 and 99%, between about 85 and 99%, between about 87 and 99%, between about 89 and 99%, between about 90 and 99%, between about 95 and 99%, or between about 97 and 99% homologous to any one of SEQ ID NOs: 41-60 and/or an amino acid sequence set forth in SEQ ID NOs:61-3808, (homology, as that term is used herein, may be measured using standard software such as BLAST or FASTA), including fragments thereof (e.g., functional fragments thereof).

In certain embodiments, the olfactory receptor for use in the presently disclosed methods can include a receptor comprising an amino acid sequence that is at least about 33%, 34%, 35%, 40%, 45%, 50%, 55%, 60%, 61%, 65%, 70%, 72%, 75%, 79%, 80%, 84%, 85%, 87%, 89%, 90%, 91%, 92%, 93%, 94%, 95%, 96%, 97%, 98%, or 99% homologous to any one of SEQ ID NOs:41-60 and/or an amino acid sequence set forth in SEQ ID NOs:61-3808, (homology, as that term is used herein, may be measured using standard software such as BLAST or FASTA), including fragments thereof (e.g., functional fragments thereof).

In certain embodiments, the olfactory receptor is a canine CafaOR9.2.9 comprising an amino acid sequence as set forth in SEQ ID NO:41, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO: 11, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR38.1.21 comprising an amino acid sequence as set forth in SEQ ID NO:42, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO: 12, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR21.2.15 comprising an amino acid sequence as set forth in SEQ ID NO:43, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO: 13, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR21.2.43 comprising an amino acid sequence as set forth in SEQ ID NO:44, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO: 14, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR15.2.20 comprising an amino acid sequence as set forth in SEQ ID NO:45, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:15, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR18.3.11 comprising an amino acid sequence as set forth in SEQ ID NO:46, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO: 16, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR15.3.1 comprising an amino acid sequence as set forth in SEQ ID NO:47, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:17, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR6.3.1 comprising an amino acid sequence as set forth in SEQ ID NO:48, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO: 18, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR18.3.12 comprising an amino acid sequence as set forth in SEQ ID NO:49, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO: 19, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a canine CafaOR5.2.5 comprising an amino acid sequence as set forth in SEQ ID NO:50, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:20, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline E1:13347030-13347977 comprising an amino acid sequence as set forth in SEQ ID NO:51, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:21, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline F1:65134904-65135858 comprising an amino acid sequence as set forth in SEQ ID NO:52, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:22, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline D1:62955839-62956792 comprising an amino acid sequence as set forth in SEQ ID NO:53, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:23, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline D1:63312327-63313289 comprising an amino acid sequence as set forth in SEQ ID NO:54, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:24, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline B3:72908295-72909287 comprising an amino acid sequence as set forth in SEQ ID NO:55, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:25, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline D1:105486528-105487493 comprising an amino acid sequence as set forth in SEQ ID NO:56, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:26, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline B3:74116955-74117893 comprising an amino acid sequence as set forth in SEQ ID NO:57, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:27, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline E3:40237904-40238842 comprising an amino acid sequence as set forth in SEQ ID NO:58, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:28, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline D1:105462554-105463512 comprising an amino acid sequence as set forth in SEQ ID NO:59, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:29, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, the olfactory receptor is a feline D1:21266824-21267768 comprising an amino acid sequence as set forth in SEQ ID NO:60, or a sequence at least 99, 98, 97, 96, 95, 90, 85 or 80 percent homologous thereto (homology, as that term is used herein, may be measured using standard software such as BLAST or FASTA), and is encoded, for example, by a nucleic acid comprising a sequence as set forth in SEQ ID NO:30, or a sequence at least 99, 98, 97, 96, 95, 90, 85 or 80 percent homologous thereto (homology, as that term is used herein, may be measured using standard software such as BLAST or FASTA), including fragments thereof (e.g., functional fragments thereof).

In certain embodiments, homology is described as a percent identity between two sequences. The percent identity of two amino acid sequences or of two nucleotide sequences can be determined by aligning the sequences for optimal comparison purposes (e.g., gaps can be introduced in the first sequence for best alignment with the sequence) and comparing the amino acid residues or nucleotides at corresponding positions. The percent identity can be determined by the number of identical amino acid residues or nucleotides in the sequences being compared (e.g., % identity=number of identical positions/total number of positions ×100).

In certain embodiments, a fragment of an olfactory receptor (e.g., functional fragments thereof) comprises at least about 5, about 10, about 15, about 20, about 25, about 30, about 40, about 50, about 60, about 70, about 80, about 90, about 100, about 125, about 150, about 175, about 200, about 250, about 300 or more amino acid residues, or any intermediate value or range thereof. In certain embodiments, the fragment comprises between about 5 to about 10, about 5 to about 20, about 5 to about 30, about 5 to about 40, about 5 to about 50, about 10 to about 50, about 10 to about 60, about 10 to about 70, about 10 to about 80, about 10 to about 90, about 10 to about 100, about 20 to about 100, about 50 to about 100, about 50 to about 150, about 50 to about 200, about 50 to about 250, about 100 to about 250, or about 100 to about 300 amino acid residues, or any intermediate range thereof.

The determination of percent identity between two sequences can be determined using a mathematical algorithm known to those of skill in the art. A non-limiting example of a mathematical algorithm for comparing two sequences is the algorithm of Karlin and Altschul (1990) Proc. Natl. Acad. Sci. USA 87:2264-2268, modified as in Karlin and Altschul (1993) Proc. Natl. Acad. Sci. USA 90:5873-5877, the disclosures of which are incorporated herein by reference in their entireties. The NBLAST and XBLAST programs of Altschul, et al. (1990) J. Mol. Biol. 215:403-410 have incorporated such an algorithm. BLAST nucleotide searches can be performed with the NBLAST program, for example, score=100, word length=12, to obtain nucleotide sequences homologous to nucleotide sequences of the invention. BLAST protein searches can be performed with the XBLAST program, for example, score=50, word length=3, to obtain amino acid sequences homologous to amino acid sequence of the invention. To obtain gapped alignments for comparison purposes, Gapped BLAST can be utilized as described in Altschul et al. (1997) Nucleic Acids Res. 25:3389-3402, the disclosure of which is incorporated herein by reference in its entirety. Alternatively, PSI-Blast can be used to perform an iterated search, which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. An additional non-limiting example of a mathematical algorithm utilized for the comparison of sequences is the algorithm of Myers and Miller, CABIOS (1989), the disclosure of which is incorporated herein by reference in its entirety. The ALIGN program (version 2.0), which is part of the CGC sequence alignment software package, has incorporated such an algorithm. Other non-limiting examples of algorithms for sequence analysis known in the art include ADVANCE and ADAM as described in Torellis and Robotti (1994) Comput. Appl. Biosci., 10:3-5; and FASTA described in Pearson and Lipman (1988) Proc. Natl. Acad. Sci. 85:2444-8, the disclosures of which are incorporated herein by reference in their entireties. Within FASTA, ktup is a control option that sets the sensitivity and speed of the search.

In certain embodiments, the disclosed subject matter provides for the use of an isolated or purified olfactory receptor and/or variants and fragments thereof. The disclosed subject matter also encompasses the use of sequence variants. In certain embodiments, variation can occur in either or both the coding and non-coding regions of a nucleotide sequence of an olfactory receptor. Variants can include a substantially homologous protein encoded by the same genetic locus in an organism, i.e., an allelic variant. Variants also encompass proteins derived from other genetic loci in an organism, e.g., human, canine and feline but having substantial homology to the olfactory receptor, i.e., a homolog. Variants can also include proteins substantially homologous to the olfactory receptor but derived from another organism, i.e., an ortholog. Variants also include proteins that are substantially homologous to the olfactory receptor that are produced by chemical synthesis. Variants also include proteins that are substantially homologous to the olfactory receptor that are produced by recombinant methods.

Orthologs, homologs and allelic variants can be identified using methods well known in the art. These variants can include a nucleotide sequence encoding a receptor that is at least about 60-65%, about 65-70%, about 70-75, about 80-85%, about 90-95%, about 95-99% or more homologous to the nucleotide sequence shown in any one of SEQ ID NOs:11-30, or any one of nucleotide sequences in SEQ ID NOs:61-3808, or fragments thereof. Such nucleic acid molecules can readily be identified as being able to hybridize under stringent conditions, to the nucleotide sequence shown in any one of SEQ ID NOs:11-30, or any one of nucleotide sequences in SEQ ID NOs:61-3808, or a fragment thereof. In certain embodiments, two polypeptides (or regions thereof) are substantially homologous when the amino acid sequences are at least about 60-65%, about 65-70%, about 70-75, about 80-85%, about 90-95%, about 95-99% or more homologous to the amino acid sequences shown in any one of SEQ ID NOs:41-60, or any one of amino acid sequences in SEQ ID NOs:61-3808, or a fragment thereof. A substantially homologous amino acid sequence, according to the disclosed subject matter, will be encoded by a nucleic acid sequence hybridizing to the nucleic acid sequence, or portion thereof, of the nucleotide sequence shown in any one of SEQ ID NOs:41-60, or any one of amino acid sequences in SEQ ID NOs:61-3808, under stringent conditions.

The olfactory receptors for use in the methods of the disclosed subject matter include olfactory receptors having additions, deletions or substitutions of amino acid residues (variants) which do not substantially alter the biological activity of the receptor. Those individual sites or regions of the olfactory receptors which may be altered without affecting biological activity can be determined by examination of the structure of the olfactory receptor extracellular domain, for example. Alternatively and/or additionally, one can empirically determine those regions of the receptor which would tolerate amino acid substitutions by alanine scanning mutagenesis (Cunningham et al., Science 244, 1081-1085 (1989), the disclosure of which is hereby incorporated by reference in its entirety). In the alanine scanning mutagenesis method, selected amino acid residues are individually substituted with a neutral amino acid (e.g., alanine) in order to determine the effects on biological activity.

It is generally recognized that conservative amino acid changes are least likely to perturb the structure and/or function of a polypeptide. Accordingly, the disclosed subject matter encompasses one or more conservative amino acid changes within an olfactory receptor. Conservative amino acid changes generally involve substitution of one amino acid with another that is similar in structure and/or function (e.g., amino acids with side chains similar in size, charge and shape). Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). In certain embodiments, one or more amino acid residues within an olfactory receptor can be replaced with other amino acid residues from the same side chain family and the altered protein can be tested for retained function using the functional assays described herein. Modifications can be introduced into an olfactory receptor of the present disclosure by standard techniques known in the art, such as site-directed mutagenesis and PCR-mediated mutagenesis. If such substitutions result in retention in biological activity, then more substantial changes can be introduced and/or other additions/deletions may be made and the resulting products screened. In certain embodiments, deletions or additions can be from 5-10 residues, alternatively from 2-5 amino acid residues or from 1-2 residues, and values in between.

The presently disclosed subject matter also provides isolated nucleic acids encoding olfactory receptors, including fragments thereof (e.g., functional fragments thereof). The olfactory receptors of the present disclosure can include mammalian olfactory receptors such as, but not limited to, human, canine and feline olfactory receptors. The isolated nucleic acids can be genomic DNAs, cDNAs and RNAs (e.g., mRNAs)

In certain non-limiting embodiments, the olfactory receptor is a canine olfactory receptor, for example, canine olfactory receptor CafaOR9.2.9, CafaOR38.1.21, CafaOR21.2.15, CafaOR21.2.43, CafaOR15.2.20, CafaOR18.3.11, CafaOR15.3.1, CafaOR6.3.1, CafaOR18.3.12, CafaOR5.2.5, including fragments thereof (e.g., functional fragments thereof), or combinations thereof. In certain embodiments, the olfactory receptor comprises a nucleotide sequence set forth in SEQ ID NO: 11, 12, 13, 14, 15, 16, 17, 18, 19, or 20, including fragments thereof (e.g., functional fragments thereof). In certain embodiments, the olfactory receptor comprises a nucleotide sequence set forth in SEQ ID NOs:61-2260, including fragments thereof (e.g., functional fragments thereof).

In certain non-limiting embodiments, the olfactory receptor is a feline olfactory receptor, for example, feline olfactory receptor E1:13347030-13347977, F1:65134904-65135858, D1:62955839-62956792, D1:63312327-63313289, B3:72908295-72909287, D1:105486528-105487493, B3:74116955-74117893, E3:40237904-40238842, D1:105462554-105463512, D1:21266824-21267768, including fragments thereof (e.g., functional fragments thereof), or combinations thereof. In certain embodiments, the olfactory receptor comprises a nucleotide sequence set forth in SEQ ID NO: 21, 22, 23, 24, 25, 26, 27, 28, 29, or 30, including fragments thereof (e.g., functional fragments thereof). In certain embodiments, the olfactory receptor comprises a nucleotide sequence set forth in SEQ ID NOs:2261-3808, including fragments thereof (e.g., functional fragments thereof).

The disclosed subject matter also provides for fusion proteins that comprise an olfactory receptor, or fragment thereof. In certain embodiments, the disclosed subject matter provides for fusion proteins of an olfactory receptor, or functional fragments thereof, and an immunoglobulin heavy chain constant region. In certain embodiments, a fusion protein of the present disclosure can include a detectable marker, a functional group such as a carrier, a label, a stabilizing sequence or a mechanism by which olfactory receptor agonist binding can be detected. Non-limiting embodiments of a label include a FLAG tag, a His tag, a MYC tag, a maltose binding protein and others known in the art. The presently disclosed subject matter also provides nucleic acids encoding such fusion proteins, vectors containing fusion protein-encoding nucleic acids and host cells comprising such nucleic acids or vectors. In certain embodiments, fusions can be made at the amino terminus (N-terminus) of an olfactory receptor or at the carboxy terminus (C-terminus) of an olfactory receptor.

In certain embodiments, the olfactory receptors disclosed herein can contain additional amino acids at the N-terminus and/or at the C-terminus end of the sequences, e.g., when used in the methods of the disclosed subject matter. In certain embodiments, the additional amino acids can assist with immobilizing the polypeptide for screening purposes, or allow the polypeptide to be part of a fusion protein, as disclosed above, for ease of detection of biological activity.

3. Methods for Identifying Olfactory Receptor Modulating Compounds

The present disclosure further provides methods for identifying compounds that modulate the activity and/or expression of an olfactory receptor. For example, and not by way of limitation, the modulator can be an agonist (for example, a full or partial agonist), or an antagonist, or an inverse agonist, or an allosteric modulator. The presently disclosed subject matter provides in silico and in vitro methods for identifying compounds that modulate the activity and/or expression of an olfactory receptor, disclosed above.

3.1 in Silico Methods

The presently disclosed subject matter further provides in silico methods for identifying compounds that can potentially interact with an olfactory receptor and/or modulate the activity and/or expression of an olfactory receptor.

In certain embodiments, the method can include predicting the three-dimensional structure (3D) of an olfactory receptor and screening the predicted 3D structure with putative olfactory receptor modulating compounds (i.e., test compounds). The method can further include predicting whether the putative compound would interact with the binding site of the receptor by analyzing the potential interactions with the putative compound and the amino acids of the receptor. The method can further include identifying a test compound that can bind to and/or modulate the biological activity of the olfactory receptor by determining whether the 3D structure of the compound fits within the binding site of the 3D structure of the receptor.

In certain embodiments, the olfactory receptor for use in the disclosed method can be a canine receptor CafaOR9.2.9, CafaOR38.1.21, CafaOR21.2.15, CafaOR21.2.43, CafaOR15.2.20, CafaOR18.3.11, CafaOR15.3.1, CafaOR6.3.1, CafaOR18.3.12, CafaOR5.2.5, or combinations thereof. In certain non-limiting embodiments, the olfactory receptor is a canine olfactory receptor described in SEQ ID NOs:61-2260.

In certain embodiments, the olfactory receptor for use in the disclosed method can be a feline receptor E1:13347030-13347977, F1:65134904-65135858, D1:62955839-

62956792, D1:63312327-63313289, B3:72908295-72909287, D1:105486528-105487493, B3:74116955-74117893, E3:40237904-40238842, D1:105462554-105463512, and D1:21266824-21267768, or combinations thereof. In certain non-limiting embodiments, the olfactory receptor is a feline olfactory receptor described in SEQ ID NOs:2261-3808.

In other embodiments, the olfactory receptor for use in the disclosed method can have the amino acid sequence of any one of SEQ ID NO:41-60, or any one of amino acid sequences in SEQ ID NOs:61-3808, or a fragment or variant thereof. In certain embodiments, the olfactory receptor for use in the presently disclosed subject matter can include a receptor comprising an amino acid sequence having at least about 33%, 34%, 35%, 40%, 45%, 50%, 55%, 60%, 61%, 65%, 70%, 72%, 75%, 79%, 80%, 84%, 85%, 87%, 89%, 90%, 91%, 92%, 93%, 94%, 95%, 96%, 97%, 98%, or 99% identity to any one of SEQ ID NO:41-60, or any one of amino acid sequences in SEQ ID NOs:61-3808, or a fragment or variant thereof. In certain embodiments, the olfactory receptor for use in the disclosed method can be encoded by a nucleotide sequence of any one of SEQ ID NO: 11-30, or any one of nucleotide sequences in SEQ ID NOs:61-3808, or a fragment or variant thereof. In certain embodiments, the olfactory receptor for use in the presently disclosed subject matter can include a receptor encoded by a nucleotide sequence having at least 85%, at least 90%, at least 91%, at least 92%, at least 93%, at least 94%, at least 95%, at least 96%, at least 97%, at least 98% or at least 99% identity to any one of SEQ ID NO: 11-30, or any one of nucleotide sequences in SEQ ID NOs:61-3808, or a fragment or variant thereof.

Non-limiting examples of compounds (e.g., potential olfactory receptor modulators) that can be tested using the disclosed methods include any small chemical compound, or any biological entity, such as peptides, salts, amino acids and odor compound known in the art, e.g. androstenone. In certain embodiments, the test compound can be a small chemical molecule.

In certain embodiments, structural models of an olfactory receptor can be built using crystal structures of other GPCRs as templates for homology modeling. For example, and not by way of limitation, structural models can be generated using the crystal structures of GPCRs. In certain embodiments, a structural model of an olfactory receptor can be based on a known or a combination of known crystal structures of GPCRs. (See, e.g., Lee et al., Eur J Pharmacol. 2015 May 14. pii: S0014-2999(15)30012-1, which is incorporated by reference in its entirety herein). In certain embodiments, a structural model of an olfactory receptor can be generated based on the crystal structure of a P2 adrenergic receptor, 3SN6 from Protein Data Bank (PDB). (See, e.g., Rasmussen et al., Nature. 2011 Jul. 19; 477(7366):549-55, which is incorporated by reference in its entirety herein). In certain embodiments, a structural model of the 7 transmembrane domain (7TM) of an olfactory receptor can be generated based on the crystal structures of existing GPCR crystal structure 3SN6 from PDB. In certain embodiments structural models of an olfactory receptor can be built using the I-TASSER Suite of programs (Yang et al., Nat Methods, 12: 7-8 (2015), which is incorporated by reference in its entirety herein) and Modeller (Eswar et al., Curr Protoc Bioinformatics, 15:5.6.1-5.6.30 (2006), which is incorporated by reference in its entirety herein), which is part of the DiscoveryStudio (DS) suite of programs from Accelrys (DiscoveryStudio (DS) is a suite of interactive modeling and simulation programs from the Accelrys corporation).

Any suitable modelling software known in the art can be used. In certain embodiments, the Modeller software package can be used to generate the three-dimensional protein structure.

In certain embodiments, the in silico methods of identifying a compound that binds to an olfactory receptor comprises determining whether a test compound interacts with one or more amino acids of an olfactory receptor binding pocket, as described herein.

Compounds that are identified by the disclosed in silico methods can be further tested using the in vitro and in vivo methods disclosed herein.

3.2 Olfactory Receptor Transmembrane Compound Binding Site

The present application provides for methods of screening for compounds that modulate the activity of an olfactory receptor, for example, a canine or feline olfactory receptor, wherein the compounds interact with one or more amino acids of the olfactory receptor. In certain embodiments, the binding site of an olfactory receptor comprises amino acids within the 7TM domain of the receptor, and can be identified by generating an interaction map of the receptor using in silico modeling, as described herein. In one non-limiting example, the presence of an amino acid in the 7TM interaction map means that the residue is in the vicinity of the ligand binding environment, an interacts with the ligand.

In certain embodiments, the interaction between a compound and one or more amino acids of the olfactory receptor described herein can comprise one or more hydrogen bond, covalent bond, non-covalent bond, salt bridge, physical interaction, and combinations thereof. The interactions can also be any interaction characteristic of a ligand receptor interaction known in the art. Such interactions can be determined by, for example, site directed mutagenesis, x-ray crystallography, x-ray or other spectroscopic methods, Nuclear Magnetic Resonance (NMR), cross-linking assessment, mass spectroscopy or electrophoresis, cryo-microscopy, displacement assays based on known agonists, structural determination and combinations thereof. In certain embodiments, the interactions are determined in silico, for example, by theoretical means such as docking a compound into a feline or canine olfactory receptor binding pocket as described herein, for example, using molecular docking, molecular modeling, molecular simulation, or other means known to persons of ordinary skill in the art.

In certain embodiments, the interaction between an amino acid in the 7TM interaction map and the ligand is a pi-pi interaction.

In certain embodiments, the interaction between an amino acid in the 7TM interaction map and the ligand is a hydrogen bond interaction.

In certain embodiments, the interaction between an amino acid in the 7TM interaction map and the ligand is a hydrophobic interaction.

In certain embodiments, the interaction between an amino acid in the 7TM interaction map and the ligand is a van de Waals interaction.

In certain embodiments, the amino acid in the 7TM interaction map is a polar amino acid, wherein the amino acid interacts with the ligand as a hydrogen bond donor and/or acceptor.

In certain embodiments, the interaction between a compound and one or more amino acids of the olfactory receptors described herein can comprises one or more hydrogen bond, covalent bond, non-covalent bond, salt bridge, physical interaction, and combinations thereof. The interactions can also be any interaction characteristic of a ligand receptor interaction known in the art. Such interactions can be determined by, for example, site directed mutagenesis, x-ray crystallography, x-ray or other spectroscopic methods, Nuclear Magnetic Resonance (NMR), cross-linking assessment, mass spectroscopy or electrophoresis, cryo-microscopy, displacement assays based on known agonists, structural determination and combinations thereof. In certain embodiments, the interactions are determined in silico, for example, by theoretical means such as docking a compound into an olfactory receptor binding pocket using molecular docking, molecular modeling, molecular simulation, or other means known to persons of ordinary skill in the art.

In certain embodiments, the olfactory receptor is a canine olfactory receptor, for example, but not limited to, CafaOR9.2.9, CafaOR38.1.21, CafaOR21.2.15, CafaOR21.2.43, CafaOR15.2.20, CafaOR18.3.11, CafaOR15.3.1, CafaOR6.3.1, CafaOR18.3.12, or CafaOR5.2.5. In certain non-limiting embodiments, the olfactory receptor is a canine olfactory receptor described in SEQ ID NOs:61-2260.

In certain embodiments, the olfactory receptor is a feline olfactory receptor, for example, but not limited to, E1:13347030-13347977, F1:65134904-65135858, D1:62955839-62956792, D1:63312327-63313289, B3:72908295-72909287, D1:105486528-105487493, B3:74116955-74117893, E3:40237904-40238842, D1:105462554-105463512, or D1:21266824-21267768. In certain non-limiting embodiments, the olfactory receptor is a feline olfactory receptor described in SEQ ID NOs:2261-3808.

In certain embodiments, the compounds interact with one or more olfactory receptors described herein according to any combination of interactions described herein, for example, one, two, three or more of the interactions.

In certain embodiments, the compounds bind to at least one of the receptors described herein. In certain embodiment, the compounds bind selectively to only one of the receptors described herein.

In one embodiment, the olfactory receptor is a canine CafaOR9.2.9. In certain embodiments, the amino acid residues that the compounds interact with comprises CafaOR9.2.9 residue Gln103, for example, by hydrogen bonding or salt bridge interactions, as exemplified by in silico modeling of Lilial in CafaOR9.2.9 (FIG. 2). Alternatively, or in addition, in certain embodiments, the amino acids that the compounds interact with comprise CafaOR9.2.9 residues Leu104, Lys275, Arg87, Val81, Met84, Val279, Tyr262, Met209, Gly258, Val111, Tyr255, Thr282, Phe107 and/or Thr80, either alone or in conjunction with interactions to Gln103 listed above, for example, by polar, ring stacking, salt bridges, hydrogen bonding, pi interactions, charged interactions, van der Waals interactions, or hydrophobic interactions, as exemplified by in silico modeling of Lilial in CafaOR9.2.9 (FIG. 2). Alternatively, or in addition, in certain embodiments, the amino acids that the compounds interact with comprise any one, two, three or more of the CafaOR9.2.9 residues Gln103, Leu104, Lys275, Arg87, Val81, Met84, Val279, Tyr262, Met209, Gly258, Val111, Tyr255, Thr282, Phe107 and Thr80, for example, by polar, ring stacking, salt bridges, hydrogen bonding, pi interactions, or charged interactions, van der Waals, hydrophobic interaction or other interactions, as exemplified by in silico modeling of Lilial in CafaOR9.2.9 (FIG. 2).

In one embodiment, the olfactory receptor is a canine CafaOR38.1.21. In certain embodiments, the amino acid residues that the compounds interact with comprises CafaOR38.1.21 residue Lys273, for example, by hydrogen bonding or salt bridge interactions, as exemplified by in silico modeling of p-Anisaldehyde in CafaOR38.1.21 (FIG. 3). Alternatively, or in addition, in certain embodiments, the amino acids that the compounds interact with comprise CafaOR38.1.21 residues Thr78, Leu82, Tyr260, Thr256, Tyr253 and/or Phe105, either alone or in conjunction with interactions to Lys273 listed above, for example, by polar, ring stacking, salt bridges, hydrogen bonding, pi interactions, charged interactions, van der Waals interactions, or hydrophobic interactions, as exemplified by in silico modeling of p-Anisaldehyde in CafaOR38.1.21 (FIG. 3). Alternatively, or in addition, in certain embodiments, the amino acids that the compounds interact with comprise any one, two, three or more of the CafaOR38.1.21 residues Lys273, Thr78, Leu82, Tyr260, Thr256, Tyr253 and Phe105, for example, by polar, ring stacking, salt bridges, hydrogen bonding, pi interactions, or charged interactions, van der Waals, hydrophobic interaction or other interactions, as exemplified by in silico modeling of p-Anisaldehyde in CafaOR38.1.21 (FIG. 3).

In one embodiment, the olfactory receptor is a canine CafaOR21.2.15. In certain embodiments, the amino acids that the compounds interact with comprise CafaOR21.2.15 residues Met83, His107, Ile106, Leu182, Asn197, Gly201, Val204, Ser260, Phe256 and/or Leu273, for example, by polar, ring stacking, salt bridges, hydrogen bonding, pi interactions, charged interactions, van der Waals interactions, or hydrophobic interactions, as exemplified by in silico modeling of (+)-menthol in CafaOR21.2.15 (FIG. 4). Alternatively, or in addition, in certain embodiments, the amino acids that the compounds interact with comprise any one, two, three or more of the CafaOR21.2.15 residues Met103, Met83, His107, Ile106, Leu182, Asn197, Gly201, Val204, Ser260, Phe256 and Leu273, for example, by polar, ring stacking, salt bridges, hydrogen bonding, pi interactions, or charged interactions, van der Waals, hydrophobic interaction or other interactions, as exemplified by in silico modeling of (+)-menthol in CafaOR21.2.15 (FIG. 4).

In one embodiment, the olfactory receptor is a canine CafaOR21.2.43. In certain embodiments, the amino acids that the compounds interact with comprise CafaOR21.2.43 residues Met80, Met88, Leu108, Ile111, His112, Thr115, Val209, Val210, Thr213, Leu214, Val262, Ile263, Ser266, Ile281, Ala284, and/or Leu288, for example, by polar, ring stacking, salt bridges, hydrogen bonding, pi interactions, charged interactions, van der Waals interactions, or hydrophobic interactions, as exemplified by in silico modeling of Androstadienone in CafaOR21.2.43 (FIG. 5). Alternatively, or in addition, in certain embodiments, the amino acids that the compounds interact with comprise any one, two, three or more of the CafaOR21.2.43 residues Asp285, Met80, Met88, Leu108, Ile111, His112, Thr115, Val209, Val210, Thr213, Leu214, Val262, Ile263, Ser266, Ile281, Ala284, and Leu288, for example, by polar, ring stacking, salt bridges, hydrogen bonding, pi interactions, or charged interactions, van der Waals, hydrophobic interaction or other interactions, as exemplified by in silico modeling of Androstadienone in CafaOR21.2.43 (FIG. 5).

In one embodiment, the olfactory receptor is a feline catGr5 (B3:72908295-72909287). In certain embodiments, the amino acid residues that the compounds interact with comprises catGr5 (B3:72908295-72909287) residue Tyr277, for example, by hydrogen bonding or salt bridge interactions, as exemplified by in silico modeling of isobuteric acid in catGr5 (B3:72908295-72909287) (FIG. 6). Alternatively, or in addition, in certain embodiments, the amino acids that the compounds interact with comprise catGr5 (B3:72908295-72909287) residues Phe119, Pro177, Leu180, Ile181, Pro199, Cys217, and/or Phe220, either alone or in conjunction with interactions listed above, for example, by polar, ring stacking, salt bridges, hydrogen bonding, pi interactions, charged interactions, van der Waals interactions, or hydrophobic interactions, as exemplified by in silico modeling of isobuteric acid in catGr5 (B3: 72908295-72909287) (FIG. 6). Alternatively, or in addition, in certain embodiments, the amino acids that the compounds interact with comprise any one, two, three or more of the CafaOR9.2.9 residues Tyr277, Lys290, Phe119, Pro177, Leu180, Ile181, Pro199, Cys217, and Phe220, for example, by polar, ring stacking, salt bridges, hydrogen bonding, pi interactions, or charged interactions, van der Waals, hydrophobic interaction or other interactions, as exemplified by in silico modeling of isobuteric acid in catGr5 (B3:72908295-72909287) (FIG. 6).

In one embodiment, the olfactory receptor is a feline catGr6 (D1:105486528-105487493). In certain embodiments, the amino acid residues that the compounds interact with comprises catGr6 (D1:105486528-105487493) residue Tyr265, for example, by hydrogen bonding or salt bridge interactions, as exemplified by in silico modeling of β-ionone in catGr6 (D1:105486528-105487493) (FIG. 7). Alternatively, or in addition, in certain embodiments, the amino acids that the compounds interact with comprise catGr6 (D1:105486528-105487493) residues Phe88, Phe111, Met170, Met206, Cys261, Ile264, Ser279, Ile280, and/or Thr283, either alone or in conjunction with interactions listed above, for example, by polar, ring stacking, salt bridges, hydrogen bonding, pi interactions, charged interactions, van der Waals interactions, or hydrophobic interactions, as exemplified by in silico modeling of β-ionone in catGr6 (D1:105486528-105487493) (FIG. 7). Alternatively, or in addition, in certain embodiments, the amino acids that the compounds interact with comprise any one, two, three or more of the catGr6 (D1:105486528-105487493) residues His112, Asn209, Tyr265, Phe88, Phe111, Met170, Met206, Cys261, Ile264, Ser279, Ile280, and Thr283, for example, by polar, ring stacking, salt bridges, hydrogen bonding, pi interactions, or charged interactions, van der Waals, hydrophobic interaction or other interactions, as exemplified by in silico modeling of β-ionone in catGr6 (D1:105486528-105487493) (FIG. 7).

In one embodiment, the olfactory receptor is a feline catG7 (B3:74116955-74117893). In certain embodiments, the amino acid residues that the compounds interact with comprises catG7 (B3:74116955-74117893) residues Met81, Tyr258, and Gln100, for example, by hydrogen bonding or salt bridge interactions, as exemplified by in silico modeling of Amyl acetate in catG7 (B3:74116955-74117893) (FIG. 8). Alternatively, or in addition, in certain embodiments, the amino acids that the compounds interact with comprise catG7 (B3:74116955-74117893) residues Thr77, Lys269, Leu104, Thr276, Val277, His73, Val273 and/or Val78, either alone or in conjunction with interactions listed above, for example, by polar, ring stacking, salt bridges, hydrogen bonding, pi interactions, charged interactions, van der Waals interactions, or hydrophobic interactions, as exemplified by in silico modeling of Amyl acetate in catG7 (B3:74116955-74117893) (FIG. 8). Alternatively, or in addition, in certain embodiments, the amino acids that the compounds interact with comprise any one, two, three or more of the catG7 (B3:74116955-74117893) residues Met81, Tyr258, Gln100, Thr77, Lys269, Leu104, Thr276, Val277, His73, Val273 and Val78, for example, by polar, ring stacking, salt bridges, hydrogen bonding, pi interactions, or charged interactions, van der Waals, hydrophobic interaction or other interactions, as exemplified by in silico modeling of Amyl acetate in catG7 (B3:74116955-74117893) (FIG. 8).

In one embodiment, the olfactory receptor is a feline catG8 (E3:40237904-40238842). In certain embodiments, the amino acids that the compounds interact with comprise catG8 (E3:40237904-40238842) residues Leu101, Phe104, Leu105, Gly108, Glu180, Val202, Phe206, Tyr259, and/or Lys272, for example, by polar, ring stacking, salt bridges, hydrogen bonding, pi interactions, charged interactions, van der Waals interactions, or hydrophobic interactions, as exemplified by in silico modeling of 1-nonanethiol in catG8 (E3:40237904-40238842) (FIG. 9). Alternatively, or in addition, in certain embodiments, the amino acids that the compounds interact with comprise any one, two, three or more of the catG8 (E3:40237904-40238842) residues Met81, Leu101, Phe104, Leu105, Gly108, Glu180, Val202, Phe206, Tyr259, and Lys272, for example, by polar, ring stacking, salt bridges, hydrogen bonding, pi interactions, or charged interactions, van der Waals, hydrophobic interaction or other interactions, as exemplified by in silico modeling of 1-nonanethiol in catG8 (E3:40237904-40238842) (FIG. 9).

In one embodiment, the olfactory receptor is a feline catG9 (D1:105462554-105463512). In certain embodiments, the amino acid residues that the compounds interact with comprises catG9 (D1:105462554-105463512) residue Lys278, for example, by hydrogen bonding or salt bridge interactions, as exemplified by in silico modeling of β-ionone in catG9 (D1:105462554-105463512) (FIG. 10). Alternatively, or in addition, in certain embodiments, the amino acids that the compounds interact with comprise catG9 (D1:105462554-105463512) residues Phe110, Val111, Gly114, Val208, Ile212, Phe258, Ala261, Leu262, Tyr265, Val282, and/or Ser285, either alone or in conjunction with interactions listed above, for example, by polar, ring stacking, salt bridges, hydrogen bonding, pi interactions, charged interactions, van der Waals interactions, or hydrophobic interactions, as exemplified by in silico modeling of β-ionone in catG9 (D1:105462554-105463512) (FIG. 10). Alternatively, or in addition, in certain embodiments, the amino acids that the compounds interact with comprise any one, two, three or more of the catG9 (D1:105462554-105463512) residues Tyr79, Lys278, Phe110, Val111, Gly114, Val208, Ile212, Phe258, Ala261, Leu262, Tyr265, Val282, and Ser285, for example, by polar, ring stacking, salt bridges, hydrogen bonding, pi interactions, or charged interactions, van der Waals, hydrophobic interaction or other interactions, as exemplified by in silico modeling of β-ionone in catG9 (D1:105462554-105463512) (FIG. 10).

In one embodiment, the olfactory receptor is a canine CafaOR5.2.5. In certain embodiments, the amino acids that the compounds interact with comprise CafaOR5.2.5 residues Tyr77, Phe108, Val112, Ser116, Val206, Asp210, Phe256, and/or Thr283, for example, by polar, ring stacking, salt bridges, hydrogen bonding, pi interactions, charged interactions, van der Waals interactions, or hydrophobic interactions, as exemplified by in silico modeling of Coumarin in CafaOR5.2.5 (FIG. 11). Alternatively, or in addition, in certain embodiments, the amino acids that the compounds interact with comprise any one, two, three or more of the CafaOR5.2.5 residues Tyr263, Tyr77, Phe108, Val112, Ser116, Val206, Asp210, Phe256, and Thr283, for example, by polar, ring stacking, salt bridges, hydrogen bonding, pi interactions, or charged interactions, van der Waals, hydrophobic interaction or other interactions, as exemplified by in silico modeling of Coumarin in CafaOR5.2.5 (FIG. 11).

In certain embodiments, the compounds interact with any one or more of the human, canine, or feline olfactory receptors described herein, wherein the compounds interact with one or more amino acid residues present in the 7TM domains of said receptors. The EC2 loop of said receptors is at the entrance to the active site pocket of the receptors. In certain embodiments, amino acid residues present in the EC2 loop of the olfactory receptors interact with the compounds described herein.

3.3 In Vitro Methods

The presently disclosed subject matter further provides in vitro methods for identifying raw materials for generating pet food, food products, or compounds that can modulate the activity and/or expression of an olfactory receptor.

Olfactory receptors for use in the presently disclosed methods can include isolated or recombinant olfactory receptors or cells expressing an olfactory receptor, disclosed herein. In certain embodiments, the olfactory receptor for use in the disclosed methods can comprise the amino acid sequence of any one of SEQ ID NO:41-60, or any one of amino acid sequences in SEQ ID NOs:61-3808, or a fragment or variant thereof. In certain embodiments, the olfactory receptor for use in the disclosed method can have at least about 33%, 34%, 35%, 40%, 45%, 50%, 55%, 60%, 61%, 65%, 70%, 72%, 75%, 79%, 80%, 84%, 85%, 87%, 89%, 90%, 91%, 92%, 93%, 94%, 95%, 96%, 97%, 98%, or 99% identity to the amino acid sequence of any one of SEQ ID NO:41-60, or any one of amino acid sequences in SEQ ID NOs:61-3808, or a fragment or variant thereof. In certain embodiments, the olfactory receptor for use in the disclosed method can be encoded by a nucleotide sequence comprising any one of SEQ ID NO: 11-30, or any one of nucleotide sequences in SEQ ID NOs:61-3808, or a fragment or variant thereof. In certain embodiments, the olfactory receptor for use in the presently disclosed subject matter can include a receptor encoded by a nucleotide sequence having at least 85%, at least 90%, at least 91%, at least 92%, at least 93%, at least 94%, at least 95%, at least 96%, at least 97%, at least 98% or at least 99% identity to any one of SEQ ID NO: 11-30, or any one of nucleotide sequences in SEQ ID NOs:61-3808, or a fragment or variant thereof.

In certain embodiments, the method for identifying compounds that modulate the activity and/or expression of an olfactory receptor comprises measuring the biological activity of an olfactory receptor in the absence and/or presence of a test compound. In certain embodiments, the method can include measuring the biological activity of an olfactory receptor in the presence of varying concentrations of the test compound. The method can further include identifying the test compounds that result in a modulation of the activity and/or expression of the olfactory receptor compared to the activity and/or expression of the olfactory receptor in the absence of the test compound.

In certain embodiments, the method can further include analyzing two or more, three or more or four or more test compounds in combination. In certain embodiments, the two or more, three or more or four or more test compounds can be from different classes of compounds, e.g., amino acids and small chemical compounds. For example, and not by way of limitation, the method can include analyzing the effect of one or more small chemical test compounds on the biological activity and/or expression of an olfactory receptor in the presence of one or more amino acid test compounds. In certain embodiments, the method for identifying the effect of a compound on the activity and/or expression of an olfactory receptor comprises analyzing the effect of a test compound on the biological activity and/or expression of an olfactory receptor in the presence of an olfactory receptor ligand, for example, an odorant or olfactory receptor agonist/antagonist.

In certain embodiments, the method for identifying compounds that can modulate the activity and/or expression of an olfactory receptor comprises expressing an olfactory receptor in a cell line and measuring the biological activity of the receptor in the presence and/or absence of a test compound. The method can further comprise identifying test compounds that modulate the activity of the receptor by determining if there is a difference in receptor activation in the presence of a test compound compared to the activity of the receptor in the absence of the test compound. In certain embodiments, the method can include measuring the biological activity of the olfactory receptor in the presence of varying concentrations of the test compound. In certain embodiments, the selectivity of the putative olfactory receptor modulator can be evaluated by comparing its effects on other GPCRs or olfactory receptors.

In certain embodiments, the compounds identified according to the methods described herein increase or decrease the biological activity of an olfactory receptor by at least about 5%, 10%, 15%, 20%, 25%, 30%, 35%, 40%, 45%, 50%, 55%, 60%, 65%, 70%, 75%, 80%, 85%, 90%, 95%, 100%, or more, compared to the biological activity of the olfactory receptor when the compound is not present.

In certain embodiments, the method for identifying compounds that modulate the activity and/or expression of an olfactory receptor comprises determining whether a compound modulates the receptor directly, for example, as an agonist or antagonist. In certain embodiments, the method comprises determining whether a compound indirectly modulates the activity of the receptor (e.g., as an allosteric modulator), for example, by enhancing or decreasing the effect of other compounds on activating or inhibiting receptor activity.

In certain embodiments, the test agent that can modulate the activity and/or expression of an olfactory receptor has an EC50 value of no more than about 200 PM. In certain embodiments, the test agent has an EC50 value of no more than about 1 µM, 2 µM, 3 µM, 4 µM, 5 µM, 6 µM, 7 µM, 8 µM, 9 µM, 10 µM, 20 µM, 30 µM, 40 µM, 50 µM, 60 µM, 70 µM, 80 µM, 90 µM, 100 µM, 110 µM, 120 µM, 130 µM, 140 µM, 150 µM, 160 µM, 170 µM, 180 µM, 190 µM or 200 µM. In certain embodiments, the test agent has an EC50 value of no more than about 250 µM, 300 µM, 400 µM, 500 µM, 600 µM, 700 µM, 800 µM, 900 µM or 1 M. In certain embodiments, the test agent has an EC50 value of at least 1 µM, 10 µM, 100 µM, 1 nM, 10 nM, or 100 nM, but no more than about 1 µM, 2 µM, 3 µM, 4 µM, 5 µM, 6 µM, 7 µM, 8 µM, 9 µM, 10 µM, 20 µM, 30 M, 40 µM, 50 M, 60 µM, 70 M, 80 M, 90 M, 100 µM, 110 µM, 120 µM, 130 µM, 140 µM, 150 µM, 160 µM, 170 µM, 180 µM, 190 µM or 200 µM.

In certain embodiments, the test agent that can modulate the activity and/or expression of an olfactory receptor has an Emax value of no less than about 2.0. In certain embodiments, the test agent has an Emax value of no less than about 1.5, 1.6, 1.7, 1.8, 1.9, 2.0, 2.5, 3.0, 3.5, 4.0, 4.5, 5.0, 5.5, 6.0, 6.5, 7.0, 7.5, 8.0, 8.5, 9.0, 9.5, 10, 15, 20, 25, 30, 40, 50, 60, 70, 80, 90, 100, 110, 120, 130, 140. 150 or 200. In certain embodiments, the test agent has an Emax value of more than about 200.

Activation of the receptor in the presently disclosed methods can be detected through the use of a labelling compound and/or agent. In certain embodiments, the activity of the olfactory receptor can be determined by the detection of secondary messengers such as, but not limited to, cAMP, cGMP, IP3, DAG or calcium. In certain embodiments, the activity of the olfactory receptor can be determined by the detection of the intracellular calcium levels. Monitoring can be by way of, but not limited to, luminescence or fluorescence detection, such as by a calcium sensitive fluorescent dye or luminescent photoprotein. In certain embodiments, monitoring can be by way of luminescence. In certain embodiments, the intracellular calcium levels can be determined using a cellular dye, e.g., a fluorescent calcium indicator such as Calcium 4. In certain embodiments, the intracellular calcium levels can be determined by measuring the level of calcium binding to a calcium-binding protein, for example, calmodulin. Alternatively and/or additionally, the activity of the olfactory receptor can be determined by the detection of the phosphorylation, transcript levels and/or protein levels of one or more downstream protein targets of the olfactory receptor. In certain embodiments, the GloSensor™ and/or protein kinase A (PKA)-NanoBiT™ technologies are used to determine the activity of an olfactory receptor. In certain embodiments, chAMPion assay system are used to determine the activity of an olfactory receptor, which measures cAMP levels indirectly via calcium influx through cyclic nucleotide gated (CNG) channels. In certain embodiments, GloSensor assay comprises transient co-transfection of OR plasmid and GloSensor plasmid and detection of cAMP by GloSensor (permutated luciferase, luminescence activity depends on binding of cAMP); luminescence read-out. In certain embodiments, PKA-NanoBiT assay comprises transient co-transfection of OR plasmid with PKA-NanoBiT plasmids and detection of a decrease of fluorescence and/or luminescence read-out (OFF signal) resulting from cAMP-dependent dissociation of PKA subunits which disrupts split-luciferase complementation. In certain embodiments, chAMPion assay comprises transient transfection of OR plasmid and detection of calcium through photoprotein or fluorescent dye, resulting from increased cAMP level which leads to opening of CNG channel and calcium influx.

The cell line used in the presently disclosed methods can include any cell type that is capable of expressing an olfactory receptor (e.g., stable or transient expression). Non-limiting examples of cells that can be used in the disclosed methods include HeLa cells, Chinese hamster ovary cells (CHO cells), African green monkey kidney cells (COS cells), *Xenopus* oocytes, HEK-293 cells and murine 3T3 fibroblasts. In certain embodiments, the method can include expressing an olfactory receptor in HEK-293 cells. In certain embodiments, the method can include expressing an olfactory receptor in COS cells. In certain embodiments, the cells constitutively express the olfactory receptor. In certain embodiments, the cells transiently express the olfactory receptor. In another embodiment, expression of the olfactory receptor by the cells is inducible.

In certain embodiments, the cell expresses a calcium-binding photoprotein, a cyclic nucleotide gated (CNG) channel, a cAMP response element (CRE)-containing luciferase reporter, a GloSensor luciferase, or a PKA-NanoBiT system. In certain embodiments, the cell expresses a calcium-binding photoprotein, wherein the photoprotein luminesces upon binding calcium. In certain embodiments, the calcium-binding photoprotein comprises a compound selected from the group consisting of clytin, aequorin, obelin, any recombinant or isolated versions thereof, and combinations thereof. In certain embodiments, the calcium binding photoprotein comprises the protein clytin. In certain embodiments the clytin is a recombinant clytin. In certain embodiments, the clytin comprises an isolated clytin, for example, a clytin isolated from *Clytia gregarium*. In certain embodiments, the calcium-binding photoprotein comprises the protein aequorin, for example, a recombinant aequorin or an isolated aequorin, such as an aequorin isolated from *Aequorea victoria*. In certain embodiments, the calcium-binding photoprotein comprises the protein obelin, for example, a recombinant obelin or an isolated obelin, such as an obelin isolated from *Obelia longissima*.

In certain embodiments, an intracellular calcium level is monitored by luminescence detection or fluorescence detection. In certain embodiments, the fluorescence detection comprises a calcium sensitive fluorescent dye selected from the group consisting of Fura-2 AM, Fura-2 pentapotassium, Fura Red AM, Indo-1 AM, Indo-1 pentapotassium, Fluo-3, Fluo-4, Fluo-8, Calcium Green-1, Calcium 3, Calcium 4, Calcium 5, Rhod-2, derivatives thereof and combinations thereof.

In certain embodiments, expression of an olfactory receptor in a cell can be performed by introducing a nucleic acid encoding an olfactory receptor into the cell. For example, and not by way of limitation, a nucleic acid having the nucleotide sequence set forth in any one of SEQ ID NO: 11-30, or any one of nucleotide sequences in SEQ ID NOs:61-3808, or a fragment thereof, can be introduced into a cell. In certain embodiments, the introduction of a nucleic acid into a cell can be carried out by any method known in the art, including but not limited to transfection, electroporation, microinjection, infection with a viral or bacteriophage vector containing the nucleic acid sequences, cell fusion, chromosome-mediated gene transfer, microcell-mediated gene transfer, spheroplast fusion, etc. Numerous techniques are known in the art for the introduction of foreign genes into cells (see, e.g., Loeffler and Behr, Meth. Enzymol. 217:599-618 (1993); Cohen et al., Meth. Enzymol. 217:618-644 (1993); Cline, Pharmac. Ther. 29:69-92 (1985), the disclosures of which are hereby incorporated by reference in their entireties) and can be used in accordance with the disclosed subject matter. In certain embodiments, the technique can provide for the stable transfer of the nucleic acid to the cell, so that the nucleic acid is expressible by the cell and inheritable and expressible by its progeny. In certain embodiments, the technique can provide for a transient transfer of the nucleic acid to the cell, so that the nucleic acid is expressible by the cell, wherein the concentration of the nucleic acid and the expression decrease in subsequent generations of the cell's progeny.

In certain embodiments, the methods can include identifying compounds that bind to an olfactory receptor. The methods can comprise contacting an olfactory receptor with a test compound and measuring binding between the compound and the olfactory receptor. For example, and not by way of limitation, the methods can include providing an isolated or purified olfactory receptor in a cell-free system, and contacting the receptor with a test compound in the cell-free system to determine if the test compound binds to the olfactory receptor. In certain embodiments, the method can comprise contacting an olfactory receptor expressed on the surface of a cell with a candidate compound and detecting binding of the candidate compound to the olfactory receptor. The binding can be measured directly, e.g., by using a labeled test compound, or can be measured indirectly. In certain embodiments, the detection comprises detecting a physiological event in the cell caused by the binding of the compound to the olfactory receptor, e.g., an increase in the intracellular calcium levels. For example, and not by way of limitation, detection can be performed by way of fluorescence detection, such as a calcium sensitive fluorescent dye, by detection of luminescence, or any other method of detection known in the art.

In other non-limiting embodiments, the in vitro assay comprises cells expressing an olfactory receptor that is native to the cells. Examples of such cells expressing a native olfactory receptor include, for example but not limited to, human, dog and/or cat olfactory cells (e.g., olfactory receptor cells). In certain embodiments, the human, dog and/or cat olfactory cells expressing an olfactory are isolated from a human dog and/or cat and cultured in vitro. In certain embodiments, the olfactory receptor cells can be immortalized, for example, such that the cells isolated from a human, dog and/or cat can be propagated in culture.

In certain embodiments, expression of an olfactory receptor in a cell can be induced through gene editing, for example, through use of the CRISPR gene editing system to incorporate an olfactory receptor gene into the genome of a cell, or to edit or modify an olfactory receptor gene native to the cell.

In certain embodiments, the in vitro methods of identifying a compound that binds to an olfactory receptor comprises determining whether a test compound interacts with one or more amino acids of an olfactory receptor binding pocket, as described herein.

In certain embodiments, compounds identified as modulators of an olfactory receptor can be further tested in other analytical methods including, but not limited to, in vivo assays, to confirm or quantitate their modulating activity.

In certain embodiments, the methods of identifying an olfactory receptor modulator can comprise comparing the effect of a test compound to an olfactory receptor agonist or antagonist. For example, a test compound that increases or decreases the activity of the receptor in the presence of an agonist when compared to the activity of the receptor when contacted with an olfactory receptor agonist alone can be selected as an olfactory receptor modulating compound.

Olfactory receptor agonists that can be used according to said methods can comprise one or more compounds described by Table 1.

TABLE 2

Compounds for Human (H) or Mouse (M) Olfactory Receptors

| Olfactory Receptor Orthologues | | | |
|---|---|---|---|
| Human | Canine | Feline | Compounds |
| HsOR17.1.11 (hOR3A1) | CafaOR9.2.9 | E1: 13347030-13347977 (CatG1) | aldehyde TPM (H), cyclosa (H), foliaver (H), helional (H), lilial (H), methyl-hydrocinnamaldehyde (H), methyl-phenyl-pentanal (H), trifemal (H) |
| HsOR1.4.8 (hOR6P1) | CafaOR38.1.21 | F1: 65134904-65135858 (CatG2) | anisaldehyde (H) |
| HsOR11.3.14 (hOR51E1) | CafaOR21.2.15 | D1: 62955839-62956792 (CatG3) | (+)-menthol (H), 2,4-DNT (H), 3-methyl-valeric acid (H), 4-methyl-valeric acid (H), butyl butyryl lactate (H), butyl butyryllactate (H), butyric acid (H), DMDS (H), eugenol methyl (H), eugenyl acetate (H), isovaleric acid (H), methyl furfuryl disulfide (H), methyl salicylate (H), nonanoic acid (H), pentanol (H), propanal (H), pyrazine (H) |
| HsOR11.3.40 (hOR51L1) | CafaOR21.2.43 | D1: 63312327-63313289 (CatG4) | allyl phenylacetate (H), androstadienone (H), caproic acid (H), hexanoic acid (H), phenyl acetaldehyde (H) |
| HsOR14.1.27 (hOR11H6) | CafaOR15.2.20 | B3: 72908295-72909287 (CatG5) | isovaleric acid (H) |
| HsOR11.13.7 (hOR4D6) | CafaOR18.3.11 | D1: 105486528-105487493 (CatG6) | beta-ionone (H) |
| HsOR14.2.5 (hOR4E2) | CafaOR15.3.1 | B3: 74116955-74117893 (CatG7) | amyl acetate (H) |
| HsOR16.1.3 (hOR2C1) | CafaOR6.3.1 | E3: 40237904-40238842 (CatG8) | nonanethiol (H), octanethiol (H) |
| HsOR11.13.6 (hOR5A1) | CafaOR18.3.12 | D1: 105462554-105463512 (CatG9) | beta-ionone (H) |
| HsOR11.18.36 (hOR8B8) | CafaOR5.2.5 | D1: 21266824-21267768 (CatG10) | acetophenone (M), coumarin (M) |

In certain embodiments, the olfactory receptor agonist is selected from the group consisting of trifernal, isovaleric acid, 3-methyl-2-hexanoic acid, alpha-ionone, hexyl acetate, amyl mercaptan, helional, para-anisaldehyde, 4-ethoxybenzaldehyde, menthol, methyl-eugenol, methyl-salicylate, phenylacetaldehyde, beta-ionone, amyl acetate, nonanethiol, acetophenone, coumarin, lilial, meta-anisaldehyde, 4-methyl-valeric acid, pentanol, allyl-phenylacetate, hexanoic acid, alpha-ionone, citral, isoamylacetate, octanethiol, propiophenone, 7-methoxycoumarin and combinations thereof.

In certain embodiments, the olfactory receptor modulators of the present disclosure comprise a salt of the olfactory receptor modulator, for example, but not limited to, an acetate salt or a formate salt. In certain embodiments, the olfactory receptor modulator salt comprises an anion (−) (for example, but not limited to, $Cl^-$, $O^{2-}$, $CO_3^{2-}$, $HCO_3^-$, $OH^-$, $NO_3^-$, $PO_4^{3-}$, $SO_4^{2-}$, $CH_3COO^-$, $HCOO^-$ and $C_2O_4^{2-}$) bonded via an ionic bond with a cation (+) (for example, but not limited to, $Al^{3+}$, $Ca^{2+}$, $Na^+$, $K^+$, $Cu^{2+}$, $H^+$, $Fe^{3+}$, $Mg^{2+}$, $NH_4^+$ and $H_3O^+$). In other embodiments, the olfactory receptor agonist salt comprises a cation (+) bonded via an ionic bond with an anion (−).

In certain embodiments, the olfactory receptor modulators of the present application are identified through in silico modeling of an olfactory receptor, e.g., a canine and/or feline olfactory receptor, wherein the olfactory receptor modulators of the present application comprise a structure that fits within a binding site of the olfactory receptor. In certain embodiments, the in silico method comprises the in silico methods described above and in the Examples section of the present application.

In certain embodiments, the olfactory receptor modulators of the present application are identified through an in vitro method, wherein the olfactory receptor modulator compounds modulate an olfactory receptor, disclosed herein, expressed by cells in vitro. In certain embodiments, the in vitro method comprises the in vitro methods described above and in the Examples section of the present application.

4. Pet Food Products

The present application provides for screening methods that can be used to identify suitable raw materials to produce a palatable and nutritious pet food product. The presently disclosed screening methods can also be used to determine if a finished pet food product would be palatable to the pet (e.g., a dog or a cat). For example, the in vitro methods described herein can be used to screen raw materials and finished pet food products to identify whether the raw materials or finished pet food products comprise compounds that increase, decrease, or modulate olfactory receptor activity and/or expression. In certain embodiments, raw materials and finished pet food products that do not increase the activity and/or expression of an olfactory receptor can be selected for use in, or as, a pet food product for consumption. In certain embodiments, raw materials and finished pet food products that do increase the activity and/or expression of an olfactory receptor can be selected for use in, or as, a pet food product for consumption.

Non-limiting examples of suitable pet food products include wet food products, dry food products, moist food products, pet food supplements (e.g., vitamins), pet beverage products, snack and treats and pet food categories described herein.

One of the goals of the pet care industry is to identify sustainable protein sources for pets that do not compete with the human food chain. As such, there is an ongoing search for novel protein sources that fit these criteria. The presently disclosed screening method can be used to identify which of the novel protein sources would be considered palatable to the pet, or at least have no effect on the palatability of the other ingredients of the pet food. In certain embodiments, the novel protein source (i.e., raw material) is meat, fish, cheese, beans, yeast, yeast extracts, bacteria, algae, fungi, nuts, seeds or other plant material, or combinations thereof. In certain embodiments, the raw material is meat.

In certain embodiments, the protein source can be derived from a variety of plant sources. Non-limiting examples of plant sources include corn, maize, rice, soy, wheat, etc. For example, and not by way of limitation, the plant-derived protein can include lupin protein, wheat protein, soy protein and combinations thereof. Alternatively or additionally, the protein source can be derived from a variety of animal sources, for example, a multicellular eukaryotic organism from the kingdom animalia. Non-limiting examples of animal protein include beef, pork, poultry, lamb or fish including, for example, muscle meat, meat byproduct, meat meal or fish meal. Other non-limiting examples of animal sources include insects, or other organism from the phylum arthropoda.

In certain embodiments, the protein source can be derived from yeast or any other single-cell eukaryotic organisms, mold, mushroom or fungi.

In certain embodiments, the protein source can be derived from bacteria, archaea, or any other archaebacteria, eubacteria, or prokaryotic organism.

In certain embodiments, the protein source can be derived from algae, kelp, seaweed, or any other single or multicellular photosynthetic organism or protist.

In certain embodiments, the presently disclosed subject matter includes accepting or rejecting a raw material for the production of pet food based on the raw material's ability to enhance, increase, decrease and/or modulate the activity and/or expression of an olfactory receptor.

In certain embodiments, the raw material is rejected if the raw material results in the enhancement or increase in the activity and/or expression of at least one olfactory receptor. In certain embodiments, the raw material is rejected if the raw material results in the enhancement or increase in the activity and/or expression of at least two, at least three, at least four, at least five, at least six, at least seven, at least eight, at least nine, at least ten, at least eleven, at least twelve, at least thirteen, at least fourteen, at least fifteen, and/or at least sixteen olfactory receptors.

In certain embodiments, the raw material is accepted if the raw material results in the enhancement or increase in the activity and/or expression of at least one olfactory receptor. In certain embodiments, the raw material is accepted if the raw material results in the enhancement or increase in the activity and/or expression of at least two, at least three, at least four, at least five, at least six, at least seven, at least eight, at least nine, at least ten, at least eleven, at least twelve, at least thirteen, at least fourteen, at least fifteen, and/or at least sixteen olfactory receptors.

In certain embodiments, the raw material is accepted if it does not modulate the activity of at least one olfactory receptor. In certain embodiments, the raw material is selected if it inhibits or blocks the activity and/or expression of at least one olfactory receptor.

In certain embodiments, the raw material is rejected if it does not modulate the activity of at least one olfactory receptor. In certain embodiments, the raw material is rejected if it inhibits or blocks the activity and/or expression of at least one olfactory receptor.

In certain embodiments, the olfactory receptor is selected from any one or more of canine receptors CafaOR9.2.9, CafaOR38.1.21, CafaOR21.2.15, CafaOR21.2.43, CafaOR15.2.20, CafaOR18.3.11, CafaOR15.3.1, CafaOR6.3.1, CafaOR18.3.12, and/or CafaOR5.2.5. In certain non-limiting embodiments, the olfactory receptor is selected from one or more of canine olfactory receptors described in SEQ ID NOs:61-2260.

In certain embodiments, the olfactory receptor is selected from any one or more of feline receptors E1:13347030-13347977, F1:65134904-65135858, D1:62955839-62956792, D1:63312327-63313289, B3:72908295-72909287, D1:105486528-105487493, B3:74116955-74117893, E3:40237904-40238842, D1:105462554-105463512, and/or D1:21266824-21267768. In certain non-limiting embodiments, the olfactory receptor is selected from one or more of feline olfactory receptors described in SEQ ID NOs:2261-3808.

In certain non-limiting embodiments, a raw material that results in the enhancement or increase in the activity and/or expression of at least one olfactory receptor can be admixed with a compound that inhibits or reduces the activity and/or expression of the at least one olfactory receptor, wherein the admixture is accepted for the production of pet food.

During the production of pet food, some of the materials may change form due to mechanical forces, thermal forces, or chemical reactions. The presently disclosed screening method can be used to identify pet food products that form compounds that are unpalatable to an animal, for example, a canine or a feline, for example, a compound that enhances or increases the activity and/or expression of an olfactory receptor.

In certain embodiments, the presently disclosed subject matter includes accepting or rejecting a pet food product based on the product's ability to enhance, increase, decrease and/or modulate the activity and/or expression of an olfactory receptor.

In certain embodiments, the pet food product is rejected if the product results in the enhancement or increase in the activity and/or expression of at least one olfactory receptor. In certain embodiments, the pet food product is rejected if the product results in the enhancement or increase in the activity and/or expression of at least two, at least three, at least four, at least five, at least six, at least seven, at least eight, at least nine, at least ten, at least eleven, at least twelve, at least thirteen, at least fourteen, at least fifteen, and/or at least sixteen olfactory receptors. In certain embodiments, the pet food product is accepted if it does not modulate the activity of at least one olfactory receptor. In certain embodiments, the pet food product is selected if it inhibits or blocks the activity and/or expression of at least one olfactory receptor.

In certain embodiments, the pet food product is accepted if the product results in the enhancement or increase in the activity and/or expression of at least one olfactory receptor. In certain embodiments, the pet food product is accepted if the product results in the enhancement or increase in the activity and/or expression of at least two, at least three, at least four, at least five, at least six, at least seven, at least eight, at least nine, at least ten, at least eleven, at least twelve, at least thirteen, at least fourteen, at least fifteen, and/or at least sixteen olfactory receptors. In certain embodiments, the pet food product is rejected if it does not modulate the activity of at least one olfactory receptor. In certain embodiments, the pet food product is rejected if it inhibits or blocks the activity and/or expression of at least one olfactory receptor.

The flavor compositions of the present disclosed subject matter can also be used in a wide variety of pet food products. The combination of the flavoring composition(s) of the presently disclosed subject matter together with a pet food product and optional ingredients, when desired, provides a flavoring agent that possesses unexpected odor and imparts, for example, a desirable olfactory sensory experience. The flavor compositions disclosed herein can be added prior to, during or after formulation processing or packaging of the pet food product, and the components of the flavor composition can be added sequentially or simultaneously.

In certain embodiments, the pet food product is a nutritionally complete dry, wet or semi-moist food product. A dry or low moisture-containing nutritionally-complete pet food product can comprise less than about 15% moisture. A wet or high moisture-containing nutritionally-complete pet food product can comprise greater than about 50% moisture. Such food products can include from about 10% to about 90% fat, from about 10% to about 70% protein and from about 5% to about 80% carbohydrates, e.g., dietary fiber and ash, on a percent energy basis.

In certain embodiments, the pet food product is a nutritionally complete dry, wet or semi-moist food product. In certain embodiments, the pet food product includes from about 60% fat, from about 30% protein and from about 10% carbohydrates, e.g., dietary fiber and ash, on a percent energy basis.

In certain embodiments, the pet food product is a nutritionally complete moist food product. A moist, e.g., semi-moist or semi-dry or soft dry or soft moist or intermediate or medium moisture containing nutritionally-complete pet food product comprises from about 15 to about 50% moisture.

In certain embodiments, the pet food product is a non-nutritionally-complete pet food products (e.g., snack, care and treats). In certain embodiments, the pet food product is a pet food snack product. Non-limiting examples of pet food snack products include snack bars, pet chews, crunchy treats, cereal bars, snacks, biscuits and sweet products.

In certain embodiments of the present disclosure, the odor and/or palatability attributes of a pet food product or medicine prepared according to the methods described herein can be measured by an in vivo smelling method that uses a panelist of odor testers. For example, but not by way of limitation, the panel can contain canine and/or feline panelists. In certain embodiments, the palatability of a pet food product containing, for example, a screened raw material or a screened pet food product can be determined by the consumption of the pet food product alone (e.g., the one bowl test, monadic ranking). In certain embodiments, the palatability of a screened raw material or a screened pet food product can be determined by the preferential consumption of the pet food product or raw material, versus a pet food product that is known to be palatable to the animal (e.g., the two bowl test for testing preference, difference and/or choice).

In certain embodiments, the palatability and/or repellant blocking odor of a compound identified according to the methods described herein can be determined by the preferential consumption of a water solution containing said compound versus a water solution that does not contain the compound or contains a different flavor composition, for example, an olfactory receptor agonist (e.g., the two bottle test). The intake ratio for each pet food product or water solution can be determined by measuring the amount of one ration consumed divided by the total consumption. The consumption ratio (CR) can then be calculated to compare the consumption of one ration in terms of the other ration to determine the preferential consumption of one food product or water solution over the other. Alternatively or additionally, the difference in intake (g) can be used to assess the average difference in intake between the two solutions in a two bottle test or between two pet food products in a two bowl test at a selected significance level, for example, at the 5% significance level to determine an average difference in intake with a 95% confidence interval. In certain embodiments, the confidence interval can be about 90%. However, any significance level may be used, for example, a 1, 2, 3, 4, 5, 10, 15, 20, 25 or 50% significance level.

In certain embodiments, percentage preference scores, e.g., the percentage preference for one solution or food product by an animal, is the percentage of the total liquid or food product ingested during the test that that solution or food product accounts for, can also be calculated.

5. Odor Deterrents

The present disclosure provides methods for maintaining the health of an animal by imparting a repellant odor and/or decreasing the palatability of an object or surface. In certain embodiments, the method comprises applying, coating or contacting an odor deterrent product comprising a compound identified according to the methods described herein to the object or surface, and thereby preventing contact and/or ingestion of said object or surface by an animal. Accordingly, detrimental effects on the animal's health that could result from contact and/or ingestion of said object or surface are avoided. In certain embodiments, the object or surface is harmful to the health of the animal or toxic to the animal.

EXAMPLES

The presently disclosed subject matter will be better understood by reference to the following Examples, which are provided as exemplary of the invention, and not by way of limitation.

Example 1—In Silico Model of Interactions Between Olfactory Receptors and Putative Binding Compounds The present example describes the computational modeling of canine/feline olfactory receptors (ORs) to identify putative olfactory receptor modulators.

Homology models of canine/feline olfactory receptors were based on crystal structure of 3SN6 from Protein Data Bank (PDB). 3SN6 is the crystal structure of β2 adrenergic receptor from Group A GPCR with bound agonist (BI-167107 from Boehringer Ingelheim). (Rasmussen et al., Nature, 477: 549-555 (2011)). The models were built using the I-TASSER Suite of programs (Yang et al., Nat Methods, 12: 7-8 (2015)) and Modeller (Eswar et al., Curr Protoc Bioinformatics, 15:5.6.1-5.6.30 (2006)), which is part of the DiscoveryStudio (DS) suite of programs from Accelrys (DiscoveryStudio (DS) is a suite of interactive modeling and simulation programs from the Accelrys corporation).

The odor compounds were docked into the active site of canine/feline olfactory receptors. The docking program Bio-Dock from BioPredict, Inc., was used but other state of the art docking programs could be used for this purpose.

The results of in silico modeling are presented in FIGS. 2-11. FIG. 13 shows a phylogenetic tree for multi-species (human/canine/feline) covering the olfactory genetic space. The phylogenetic tree shows all olfactory receptors, and that the 30 selected olfactory receptors (10 human receptors, 10 canine receptors, 10 feline receptors, highlighted, SEQ ID NO: 1-60) are evenly distributed around the olfactory genetic space. FIG. 13 further shows the 10 pairs of canine/feline olfactory receptors (SEQ ID NO: 11-30 and SEQ ID NO:41-60) were chosen because they cover an optimal breadth and range of the potential OR receptors.

Example 2—Identification of Canine and Feline Olfactory Receptors

The dog olfactory receptor sequences and methods for detection were previously described by Niimura & Nei (2007) from which the 1,100 dog olfactory receptor sequences were obtained. The 774 putative cat olfactory receptor sequences were identified using a combination of previous annotations and similarity searches. The sequences for gene annotations containing "olfactory receptor" were extracted from the ensemble cat genome (Felis_catus_6.2 (GCA 000181335.2)). In addition Dog, Human, Mouse, Elephant, Cow, Horse, Rabbit and Guinea Pig nucleotide sequences (Niimura et al., 2015) were used to search against the cat genome. The cat reference sequence was extracted for all unique alignments with >=65 percent identity and >=650 bp length. Redundant sequences (>=95% identity) were removed using longest first sequence clustering (Fu et al., 2012) retaining only representatives. The amino acid translations for these representatives were identified using sixpack from the emboss package (Rice et al., 2000), selecting the longest amino acid sequence within an open reading frame.

The nucleic acid and amino acid sequences of the 1,100 dog olfactory receptors and 774 putative cat olfactory receptors are set forth in SEQ ID NOs:61-3808.

Example 3—Identification of Canine and Feline Olfactory Receptor Modulators Using In Vitro Assays This example refers to the functional expression of different feline and canine olfactory receptors (ORs). 20 OR sequences were selected, where 10 sequences have feline origins and the remaining 10 have canine origins. These ORs were subcloned into a modified expression vector suitable for the transient, functional expression of ORs. The transiently expressed receptors were then stimulated with various concentrations of different odorants aiming to deorphanize the feline and canine ORs. As illustrated in FIG. 12, OR responsiveness was detected in either one or both of the following cell lines and assays: 1) HEK293 PEAKrapid/RTP1s endo (reporter cell line A) and a CRE-NanoLuc luciferase reporter assay; and 2) HEK293/NatClytin/CNG/RTPIs (reporter cell line B) endo and a CNG chAMPion assay. Functional expression of the different OR sets were transient in reporter cell line A or B. The transiently transfected ORs were stimulated with 3 concentrations (n=4) of different odorants (at least 3).

Material and Methods

Cell lines. The following cell lines were used for this project:
- Reporter cell line A (for CRE-Luciferase, GloSensor, and PKA-NanoBiT assays): HEK293 PEAKrapid/RTP1s endo
- Reporter cell line B (for chAMPion assay): HEK293/CNG/nat-Clytin/RTP1s endo Cell culture media. Cells were maintained in DMEM High Glucose (Lonza BioWhittaker cat. BE12-604F/U1; 500 mL) supplemented with fetal bovine serum (Sigma cat. F7524; final concentration 10%), penicillin-streptomycin (BioWhittaker cat. DE17-602E; 5 mL of 100× solution) and the following selection antibiotics:
- HEK293 PEAKrapid/RTP1s endo: 0.1 mg/mL G418, 0.2 mg/mL hygromycin, 0.1 mg/mL zeocin.
- HEK293/CNG/nat-Clytin/RTP1s endo: 0.8 mg/mL G418, 50 μg/mL zeocin, 0.6 μg/mL puromycin.

Cell culture conditions. Cell lines were maintained in their respective complete culture media at 37° C., 5% $CO_2$, and 90% humidity. Cells were split twice a week. Under standard propagation conditions, approx. $4 \times 10^6$ cells were seeded in a T225 flask recovering about $30 \times 10^6$ cells/flask. For splitting, cells were gently washed with PBS and then incubated with trypsin for 5 min at RT or 37° C. Media were added and cells were resuspended.

Buffers. Tyrode buffer with 0 mM calcium: in-house solution (130 mM NaCl, 5 mM KCl, 1 mM $MgCl_2$, 5 mM $NaHCO_3$, 20 mM HEPES in water at pH 7.4; sterile filtered and autoclaved). Tyrode buffer: in-house solution (130 mM NaCl, 5 mM KCl, 1 mM $MgCl_2$, 5 mM $NaHCO_3$, 2 mM $CaCl_2$, 20 mM HEPES in water at pH 7.4; sterile filtered and autoclaved). Tyrode buffer with 10 mM calcium: Tyrode buffer 0 mM calcium plus 10 mM $CaCl_2$. Calcium chloride (dihydrate): Sigma, 223506, 1 M stock solution, prepared in water and stored at RT. Coelenterazine: stock solution: 5 mg/mL in DMSO (11.8 mM) with 30 μM glutathione; aliquoted and stored at −20° C.; diluted 1:1000 in tyrode buffer for experiments (final concentration: 11.8 μM).

OR sequences. The canine OR sequences SEQ ID NOs: 11-20 and the feline OR sequences SEQ ID NOs: 21-30 were used. These sequences were synthesized and cloned into a pcDNA5 expression vector with an N-terminal SSTR3 transport tag.

OR ligands. OR and odorant combinations test in phase 2 are provided in Table 3.

TABLE 3

| ORs - human, dog, cat, (mouse) | Odorant | Structure |
|---|---|---|
| OR_1 (OR3A1) | Helional | 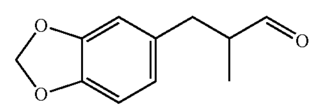 |
| | Lilial | |
| | Trifernal | |
| OR_2 (OR6P1) | para-Anisaldehyde | 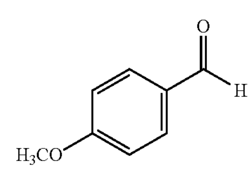 |
| | meta-Anisaldehyde | |

TABLE 3-continued

| ORs - human, dog, cat, (mouse) | Odorant | Structure |
|---|---|---|
| | 4-Ethoxybenzaldehyde | |
| OR_3 (OR51E1) (Odorants in gray shade were present in mixes but not tested individually) | Isovaleric acid | 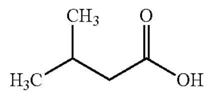 |
| | 4-Methyl-valeric acid | |
| | 3-Methyl-2-hexanoic acid | |
| | Hexaonic acid | |
| | (+)-Menthol | |
| | Methyl eugenol | |
| | Methyl salicylate | |
| | Pentanol | $CH_3(CH_2)_3CH_2OH$ |
| OR_4 (OR51L1) | Allyl phenylacetate | 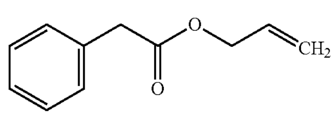 |
| | Hexanoic acid | |

TABLE 3-continued

| ORs - human, dog, cat, (mouse) | Odorant | Structure |
|---|---|---|
| | Phenylacetaldehyde | benzyl-CH$_2$-CHO |
| OR_5 (OR11H6) | Isovaleric acid | (CH$_3$)$_2$CHCH$_2$COOH |
| | 4-Methyl-valeric acid | CH$_3$(CH$_2$)$_3$CH$_2$COOH |
| | 3-Methyl-2-hexanoic acid | CH$_3$CH$_2$CH=CH-CH(CH$_3$)COOH |
| OR_6 (OR4D6), OR_9 (OR5A1) | beta-Ionone | (structure shown) |
| | alpha-Ionone | (structure shown) |
| | Citral | (CH$_3$)$_2$C=CHCH$_2$CH$_2$C(CH$_3$)=CHCHO |
| OR_7 (OR4E2) | Amyl acetate | CH$_3$COO-C$_5$H$_{11}$ |
| | Isoamyl acetate | CH$_3$COOCH$_2$CH$_2$CH(CH$_3$)$_2$ |
| | Hexyl acetate | CH$_3$COO-C$_6$H$_{13}$ |
| OR_8 (OR2C1) | Nonanethiol | CH$_3$(CH$_2$)$_7$CH$_2$SH |
| | Octanethiol | CH$_3$(CH$_2$)$_6$CH$_2$SH |
| | Amyl mercaptan | CH$_3$(CH$_2$)$_3$CH$_2$SH |
| OR_10 (OR8B8) | Acetophenone | C$_6$H$_5$COCH$_3$ |

TABLE 3-continued

| ORs - human, dog, cat, (mouse) | Odorant | Structure |
|---|---|---|
| | Coumarin | (structure) |
| | Propiophenone | (structure) |
| | 7-Methoxycoumarin | (structure) |

Four of the compounds for OR_3 (highlighted in bold) were not tested individually on the receptors but were included in the mixes. All compounds were purchased from Sigma-Aldrich. In addition to individual compounds, mixes were tested in phase 2 of the project on some ORs. The composition of the mixes tested on some ORs in phase 2 are provided in Table 4.

TABLE 4

| Mix 1 | Mix 2 |
|---|---|
| Helional | Lilial |
| para-Anisaldehyde | meta-Anisaldehyde |
| 4-Ethoxybenzaldehyde | 4-Methyl-valeric acid |
| Menthol | Pentanol |
| Methyl-eugenol | Allyl-phenylacetate |
| Methyl-salicylate | Hexanoic acid |
| Phenylacetaldehyde | alpha-Ionone |
| beta-Ionone | Citral |
| Amyl acetate | Isoamylacetate |
| Nonanethiol | Octanethiol |
| Acetophenone | Propiophenone |
| Coumarin | 7-Methoxycoumarin |

In phase 3, all positive combinations of ORs (always including human, dog, and cat ORs) and odorants were tested in full dose-response curves. OR and odorant combinations tested in phase 3 are provided in Table 5.

TABLE 5

| OR | Odorant |
|---|---|
| OR_2 OR6P1 | p-Anisaldehyde |
| | 4-Ethoxybenzaldehyde |
| OR_3 OR51E1 | Isovaleric acid |
| | 4-Methylvaleric acid |
| | Hexanoic acid |
| | 3-Methyl-2-hexanoic acid |
| OR_4 OR51L1 | Hexanoic acid |
| | Allyl phenylacetate |
| OR_8 OR2C1 | Nonanethiol |
| OR_9 OR5A1 | Isovaleric acid |
| | Citral |
| | Amyl acetate |
| | β-Ionone |
| OR_10 OR8B8 | Acetophenone |
| | Propriophenone |
| | Coumarin |

Assay kits. The following kit were used according to the manufacterer's instructions:
nano-Glo® Luciferase Assay System (Promega) for the CRE-NanoLuc luciferase assay.

Assay Protocols

CRE-NanoLuc luciferase assay. HEK293 PEAKrapid/RTP1s endo cells were transiently transfected with plasmids encoding the respective OR together with a CRE-NanoLuc luciferase plasmid (Promega) in a 1:1 ratio and were seeded at 20,000 cells/well in 25 µL/well complete growth medium in poly-D-lysine coated black, clear-bottom 384 MTPs.

Twenty-four hours later, the cell medium was removed manually and cells were incubated with 20 µL/well Tyrode buffer. Compounds prepared in Tyrode buffer with 0 mM calcium were added to cells (10 µL/well of 3× solutions). Cells were then incubated at 37° C. for 3-4 h. The plates were read in a luminescence plate reader (FLIPR$^{TETRA}$, Molecular Devices). Luminescence (camera settings: exposure time: 0.99 s; maximum gain) was recorded for 90 s after addition of 20 µL/well of the NanoGlo reagent.

Data were analyzed with the Screenworks® software (Molecular Devices, version 4.0.0.30). Luminescence values (in RLU) were exported as averages from 20 s-75 s. In addition to using raw values, the data were also normalized to background signals (wells containing buffer only) and expressed as "Fold change" (mean value (n=2)/mean value of buffer wells (n=2)). Data analysis and plotting of graphs was carried out using Excel (Microsoft) and GraphPad Prism (GraphPad Software, Inc.).

chAMPion (CNG channel) assay. HEK293/CNG/nat-Clytin/RTP1 s endo cells were transiently transfected with plasmids encoding the respective OR and were seeded at 20,000 cells/well in 25 µL/well complete growth medium in poly-D-lysine coated black, clear-bottom 384 MTPs.

Twenty-four hours later, the cell medium was removed manually and cells were incubated in 20 µL/well coelenterazine (11 µM) in Tyrode buffer with 0 mM calcium for 3.5 h at 37° C. Plates were then read in a luminescence plate reader (FLIPR$^{TETRA}$, Molecular Devices) with the following camera settings: exposure time: 0.533 s, maximum gain. Luminescence was recorded for 1 min after addition of 10 µL/well compounds (3× solutions prepared in Tyrode buffer with 0 mM calcium), followed by an incubation period of 30 min at 37° C. Luminescence was again recorded for 1 min after addition of 20 µL/well Tyrode buffer with 10 mM CaCl$_2$. The first reading after compound addition monitors the receptor-Gα$_q$ signaling pathway—as expected, no signals were observed here. The second reading after addition of calcium monitors OR-Gas signaling; these data were analyzed.

Data were analyzed with the Screenworks® software (Molecular Devices, version 4.0.0.30). Luminescence values (in RLU) were exported as maximum RLU between 10 s and 40 s. In addition to using raw values, the data were also normalized to background signals (wells containing buffer only) and expressed as "Fold change" (mean value (n=2)/mean value of buffer wells (n=2)). Data analysis and plotting of graphs was carried out using Excel (Microsoft) and GraphPad Prism (GraphPad Software, Inc.).

Results

In phase 1 of the project, twenty OR sequences, ten canine and ten feline sequences, to be analyzed in this project, were submitted by Mars Petcare. The OR sequences were synthesized and subcloned into an expression vector adding a transport epitope tag to the N-terminus of the OR proteins to facilitate their expression and plasma membrane localization.

A first functional test of the canine and feline ORs was carried out in phase 2. Sets of ORs, each consisting of human, cat, and dog orthologs (and in case of OR_10, OR8B8, also the mouse ortholog), were tested with three concentrations of a minimum of three odorants, pre-selected on the basis of published activity on the human ortholog or predicted potential activity. Most sets of ORs were also challenged with two mixes consisting of 12 odorants each. All sets of ORs were tested in parallel in two cell-based assays, CRE-NanoLuc luciferase assay and CNG chAMPion assay. These two assays were found to be the two best assays for the ten human ORs, which were tested in a previous study.

Of the ten sets of ORs that were tested in phase 2, seven sets showed responses of at least one receptor ortholog to at least one compound (FIGS. 14 and 15). Several ORs responded to more than one compound. For four sets of ORs, both dog and cat ORs showed activity; these include the set of OR_2 (OR6P1) for which the human ortholog did not respond to the same set of ligands as did the dog and cat receptors. For three other sets of ORs only the dog ortholog or the cat ortholog, respectively, responded.

In phase 3 of the project, six positive OR sets, including all available orthologs, were re-tested with their positive ligands in eight concentrations and dose-response curves were calculated. The results of phase 3 are summarized FIGS. 16 and 17. Briefly, six dog ORs were shown to be active (with numbers of ligands): OR6P1 (2); OR51E1 (3-4); OR51L1 (1); OR2C1 (1); OR5A1 (4); OR8B8 (3). In addition, six cat ORs showed activity: OR6P1 (2); OR51E1 (3-4); OR51L1 (2); OR4E2 (1); OR2C1 (1); OR5A1 (4); OR8B8 (1).

All data are presented in full detail in FIGS. 18-43. FIGS. 18-37 represent the results obtained in phase 2 assays. FIGS. 38-43 represent the dose-response curves of the positive ligands in phase 3 assays. The following data were exported: CRE-Luciferase: Average 15 s-60 s; chAMPion assay: Maximum 10 s-30 s. Data were normalized as "Fold Change" (compared to mean of buffer values). The base of all logarithm is 10.

Example 4—Identification of Canine and Feline Olfactory Receptor Modulators Using In Vitro Assays The present example describes an in vitro assay for identifying compounds that modulate the activation of a canine or feline olfactory receptor by an olfactory receptor ligand.

Compounds identified by in silico modeling with an olfactory receptor, as detailed above in Example 1, as putative olfactory receptor modulators are selected for further testing in vitro. In vitro functional characterization of the selected modulators is used to evaluate the effectiveness of a putative modulator compound in modulating the activation of the olfactory receptor by an olfactory receptor ligand.

HEK293 cells (or other suitable expression system) that stably or transiently express a canine or feline olfactory receptor (e.g., canine CafaOR9.2.9, CafaOR38.1.21, CafaOR21.2.15, CafaOR21.2.43, CafaOR15.2.20, CafaOR18.3.11, CafaOR15.3.1, CafaOR6.3.1, CafaOR18.3.12, CafaOR5.2.5, or feline E1:13347030-13347977, F1:65134904-65135858, D1:62955839-62956792, D1:63312327-63313289, B3:72908295-72909287, D1:105486528-105487493, B3:74116955-74117893, E3:40237904-40238842, D1:105462554-105463512, D1:21266824-21267768, or any one of the receptors having a nucleotide sequence or an amino acid sequence set forth in SEQ ID NOs:61-3808) are exposed to putative modulator compounds and an olfactory receptor ligand (e.g., an agonist) to modulate the activity and/or expression of the olfactory receptor.

An exemplary method of an in vitro assay is as follows. All transient transfections are performed with, for example, Lipofectamine2000 (Invitrogen) according to the manufactures protocol. 10 µl Lipofectamine2000 is diluted in 500 µl DMEM (Life Technologies) and incubated for 5 minutes at room temperature. 3 µg of plasmid DNA (1 µg/µl) is diluted in 500 µl DMEM and added to the Lipofectamine2000 mix to obtain a final volume of 1000 µl. After additional 30 minutes of incubation at room temperature, the DNA-Lipofectamine complex is added to 1000 µl of a cell suspension containing 1,400,000 cells/ml. Subsequently, 25 µl of the complete mixture is seeded into each well of a black 384 well polystyrene assay plate. At 3 hours post-transfection the transfection mix is removed from the cells and fresh DMEM containing 10% FBS and 1% P/S is added. At 27 to 30 hours post-transfection the medium is removed from the cells and 20 µl loading buffer that includes a calcium sensitive fluorescent dye or luminescent substrate (Tyrode's buffer+2 µM Fluo4-AM (Invitrogen)+2.5 mM probenecid (Invitrogen) for fluorescence or Coelenterazine (Biosynth)+Tyrode's buffer for luminescence) is added for 1 hour (fluorescence) or 3 hours (luminescence) at 37° C. The cells are then washed 2 times every 20 minutes with Tyrode's buffer using an automated plate washer (Biochrom Asys Plate Washer) for the fluorescent protocol. No wash step is required for the luminescent protocol.

Activation of the olfactory receptor is then detected, for example, by detecting a change in intracellular calcium levels using the calcium sensitive fluorescent dye, the calcium sensitive luminescent photoprotein, or by any detection system known in the art. Cells that do not express the olfactory receptor (MOCK control) are used as a control. Examples of such data capturing systems include FLIPR® Tetra or a FlexStation® 3 system. However, other imaging techniques and systems can be used, for example, microscopic imaging of the treated cells.

For each putative olfactory receptor modulator, dose response curves are generated with at least 8 concentrations in triplicate and the $EC_{50}$ value of the putative olfactory receptor modulator is determined. Graphs are plotted, for example, in SigmaPlot V12 (Systat Software) with error bars representing standard error.

REFERENCES

Niimura, Y., & Nei, M. (2007). Extensive Gains and Losses of Olfactory Receptor Genes in Mammalian Evolution. PLoS ONE, 2(8), e708. http://doi.org/10.1371/journal.pone.0000708

Niimura, Y., Matsui, A., & Touhara, K. (2015). Corrigendum: Extreme expansion of the olfactory receptor gene repertoire in African elephants and evolutionary dynamics of orthologous gene groups in 13 placental mammals. Genome Research, 25(6), 926.

Fu L, Niu B, Zhu Z, Wu S, Li W. CD-HIT: accelerated for clustering the next-generation sequencing data. Bioinformatics. 2012 Dec. 1; 28(23):3150-2. doi:10.1093/bioinformatics/bts565. Epub 2012 Oct. 11. PubMed PMID: 23060610; PubMedCentral PMCID: PMC3516142.

Rice P, Longden I, Bleasby A. EMBOSS: the European Molecular Biology Open Software Suite. Trends Genet. 2000 June; 16(6):276-7. PubMed PMID: 10827456.

Although the presently disclosed subject matter and its advantages have been described in detail, it should be understood that various changes, substitutions and alterations can be made herein without departing from the spirit and scope of the invention as defined by the appended claims. Moreover, the scope of the present application is not intended to be limited to the particular embodiments of the process, machine, manufacture, composition of matter, means, methods and steps described in the specification. As one of ordinary skill in the art will readily appreciate from the disclosure of the presently disclosed subject matter, processes, machines, manufacture, compositions of matter, means, methods, or steps, presently existing or later to be developed that perform substantially the same function or achieve substantially the same result as the corresponding embodiments described herein may be utilized according to the presently disclosed subject matter. Accordingly, the appended claims are intended to include within their scope such processes, machines, manufacture, compositions of matter, means, methods, or steps.

Patents, patent applications, publications, product descriptions and protocols are cited throughout this application the disclosures of which are incorporated herein by reference in their entireties for all purposes.

SEQUENCE LISTING (3809 sequences)

SEQ ID NO: 1 - DNA, 948 bp, Homo sapiens
atgcagccagaatctggggccaatggaacagtcattgctgagttcatcctgctgggcttgctggaggcgccagggctgcagccagttgtctttgtgctcttcctctttgcctacctggtcacggtcaggggcaacctcagcatcctggcagctgtcttggtggagcccaaactccacacccccatgtacttcttcctggggaacctatcagtgctggatgttgggtgcatcagcgtcactgttccatcaatgttgagtcgtctcctgtcccgcaagcgtgcagttccctgtggggcctgccttacccagctcttcttcttccatctgttcgttggagtggactgcttcctgctgaccgccatggcctatgaccgattcctggccatctgccggcccctcacctacagcacccgcatgagtcagacagtccagaggatgttggtggctgcgtcctgggcttgtgctttcaccaacgcactgacccacactgtggccatgtccacgctcaacttctgtggccccaatgtgatcaatcacttctactgtgacctcccacagctcttccagctctcctgctccagcacccaactcaatgagctgctgctttttgctgtgggttttataatggcaggtacccccatggctctcattgtcatctcctatatccacgtggcagctgcagtcctgcgaattcgctctgtagagggcaggaagaaagccttctccacatgtggctcccacctcactgtggttgccatattctatggttcaggtatctttaactatatgcgactgggttcaaccaagctttcagacaaggataaagctgttggaattttcaacactgtcatcaatcccatgctgaacccaatcatctacagcttcagaaaccctgatgtgcagagtgccatctggaggatgctcacagggaggcggtcactggcttga

SEQ ID NO: 2 - DNA, 954 bp, Homo sapiens
atgagaaatttgagtggaggccatgtcgaggagtttgtcttggtgggtttccctaccacgcctcccctccagctgctcctctttgtccttttttttgcaatttaccttctgacattgttggagaatgcacttattgtcttcacaatatggcttgctccaagccttcatcgtcccatgtactttttccttggccatctctctttcctggagctatggtacatcaatgtcaccattcctcggctcttggcagcctttcttacccaggatggtagagtctcctacgtaggttgcatgacccaactgtacttctttattgccttagcctgtactgaatgtgtgctgttggcagttatggcctatgatcgctacctggccatctgtggacccctcctttaccctagtctcatgccttccagtctggccactcgccttgctgctgcctcttggggcagtggcttcttcagctccatgatgaagcttctttttatttcccaattgtcctactgtggacccaacattatcaaccactttttctgtgatatttccccactactcaacctcacctgctctgacaaggagcaagcagagctagtagacttccttctggccctggtgatgattctactccctctattggctgtggtttcatcatacactgccatcattgcagccatcctgaggatccctacgtccaggggacgccacaaagccttttccacttgtgccgctcatctggcagtggttgttatctactactcctccactctcttcacctatgcacggccccgggccatgtacaccttcaaccacaacaagattatctctgtgctctacactatcattgtaccattcttcaacccagccatctactgcctgaggaacaaggaggtgaaggaggccttcaggaagacagtgatgggcagatgtcactatcctagggatgttcaggactga

SEQ ID NO: 3 - DNA, 956 bp, Homo sapiens
atgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatgcccaaaatgctggccatcttctggttcaattccactaccatccagtttgatgcttgtctgctacagatgtttgccatccactccttatctggcatggaatccacagtgctgctggccatggcttttgaccgctatgtggccatctgtcacccactgcgccatgccacagtacttacgttgcctcgtgtcaccaaaattggtgtggctgctgtggtgcggggggctgcactgatggcaccccttcctgtcttcatcaagcagctgcccttctgccgctccaatatcctttcccattcctactgcctacaccaagatgtcatgaagctggcctgtgatgatatccgggtcaatgtcgtctatggccttatcgtcatcatctccgccattggcctggactcacttctcatctccttctcatatctgcttattcttaagactgtgttgggcttgacacgtgaagcccaggccaaggcatttggcacttgcgtctctcatgtgtgtgctgtgttcatattctatgtacctttcattggattgtccatggtgcatcgctttagcaagcggcgtgactctccgctgcccgtcatcttggccaatatctatctgctggttcctcctgtgctcaacccaattgtctatggagtgaagacaaaggagattcgacagcgcatccttcgacttttccatgtggccacacacgcttcagagcccta

SEQ ID NO: 4 - DNA, 948 bp, Homo sapiens
atgggagactggaataacagtgatgctgtggagcccatatttatcctgaggggttttcctggactggagtatgttcattcttggctctccatcctcttctgtcttgcatatttggtagcatttatgggtaatgttaccatcctgtctgtcatttggatagaatcctctctccatcagcccatgtattactttatttccatcttagcagtgaatgacctggggatgtccctgtctacacttcccaccatgcttgctgtgttatggttggatgctccagagatccaggcaagtgcttgctatgctcagctgttcttcatccacacattcacattcctggagtcctcagtgttgctggccatggcctttgaccgttttgttgctatctgccatccactgcactaccccaccatcctcaccaacagtgtaattggcaaaattggtttggcctgtttgctacgaagcttgggagttgtacttcccacacctttgctactgagacactatcactactgccatggcaatgccctctctcacgccttctgtttgcaccaggatgttctaagattatcctgtacagatgccaggaccaacagtatttatgggctttgtgtagtcattgccacactaggtgtggattcaatcttcatacttctttcttatgttctgattcttaatactgtgctggatattgcatctcgtgaagagcagctaaaggcactcaacacatgtgtatcccatatctgtgtggtgcttatcttctttgtgccagttattggggtgtcaatggtccatcgctttgggaagcatctgtctcccatagtccacatcctcatggcagacatctaccttcttcttcccccagtccttaaccctattgtctatagtgtcagaacaaagcagattcgtctaggaattctccacaagtttgtcctaaggaggaggttttaa

SEQ ID NO: 5 - DNA, 993 bp, Homo sapiens
atgttctttattattcattctttggttacttctgtttttctaacagctttgggaccccagaacagaacaatgcattttgtgactgagtttgtcctcctgggtttccatggtcaaagggagatgcagagctgcttcttctcattcatcctggttctctatctcctgacactgctagggaatggagctattgtctgtgcagtgaaattggacaggcggctccacacacccatgtacatccttctgggaaactttgcctttctagagatctggtacatttcctccactgtcccaaacatgctagtcaatatcctctctgagattaaaaccatctccttctctggttgcttcctgcaattctatttctttttttcactgggtacaacagagtgtttctttttatcagttatggcttatgatcggtacctggccatctgtcgtccattacactacccctccatcatgactgggaagttctgtataattctggtctgtgtatgctgggtaggcggatttctctgctatccagtccctattgttcttatctcccaacttcccttctgtgggcccaacatcattgaccacttggtgtgtgacccaggcccattgtttgcactggcctgcatctctgctccttccactgagcttatctgttacaccttcaactcgatgattatctttgggcccttcctctccatcttgggatcttacactctggtcatcagagctgtgctttgtattccctctggtgctggtcgaactaaagctttctccacatgtgggtcccacctaatggtggtgtctctattctatggaacccttatggtgatgtatgtgagcccaacatcagggaacccagcaggaatgcagaagatcatcactctggtatacacagcaatgactccattcttaaatccccttatctatagtcttcgaaacaaagacatgaaagatgctctaaagagagtcctggggttaacagttagccaaaactga

SEQ ID NO: 6 - DNA, 942 bp, Homo sapiens
atggaccagatcaaccacactaatgtgaaggagtttttcttcctggaacttacacgttcccgagagctggagtttttcttgtttgtggtcttctttgctgtgtatgtagcaacagtcctgggaaatgcactcattgtggtcactattacctgtgagtcccgcctacacactcctatgtactttctcctgcggaacaaatcagtcctggacatcgttttttcatctatcaccgtccccaagttcctggtggatcttttatcagacaggaaaaccatctcctacaatggctgcatggcacagatctttttcttccactttgctggtggggcagatatttttttcctctctgtgatggcctatgacagataccttgcaatcgccaagcccctgcactatgtgaccatgatgaggaaagaggtgtgggtggccttggtggtggcttcttgggtgagtggtggtttgcattcaatcatccaggtaattctgatgcttccattccccttctgtggccccaacacactggatgccttctactgttatgtgctccaggtggtaaaactggcctgcactgacacctttgctttggagcttttcatgatctctaacaacggactggtgaccctgctctggttcctcctgctcctgggctcctacactgtcattctggtgatgctgagatcccactctggggaggggcggaacaaggccctctccacgtgcacgtcccacatgctggtggtgactcttcacttcgtgccttgtgtttacatctactgccggcccttcatgacgctgcccatggacacaaccatatccattaataacacggtcattacccccatgctgaaccccatcatctattccctgagaaatcaagagatgaagtcagccatgcagaggctgcagaggagacttgggccttccgagagcagaaaatggggg

SEQ ID NO: 7 - DNA, 939 bp, Homo sapiens
atggacagtctaaaccaaacaagagtgactgaatttgtcttcttgggactcactgataaccgggtgctggaaatgctgtttttcatggcattctcagccatttatatgctaacgctttcagggaacattctcatcatcattgccacagtctttactccaagtctccatacccccatgtatttcttcctgagcaatctgtcctttattgacatctgccactcatctgtcactgtgcctaagatgttggagggtttgcttttagaaagaaagaccatttcctttgacaactgcatcacacagctcttcttcctacatctctttgcctgtgccgagatctttctgctgatcattatggcgtatgatcgttacgtggctatctgcactccactccactaccccaatgtgatgaacatgagagtctgtatacagcttgtctttgctctctggttggggggtactgttcactcactagggcagaccttcttgactattcgtctaccttactgtggccccaacattattgacagctacttctgtgatgtgcctcttgttatcaagctggcctgcacagatacatacctcacaggaatactgattgtgaccaatagtggaaccatctccctctcctgtttcttggccgtggtcacctcctatatggtcatcctggtttctcttcgaaaacactcagctgaagggcgccgtaaagccctgtctacctgctcggcccacttcatggtggttgccctcttctttgggccatgtatcttcatctatactcggccagacaccagcttctccattgacaaggtggtgtctgtcttctacacagtggtcacccctttgctgaatcccttcatttacaccttgaggaatgaggaggtaaaaagtgccatgaagcagctcaggcagagacaagtttttttcacgaaatcatataca

SEQ ID NO: 8 - DNA, 939 bp, Homo sapiens
atggacggggtgaatgatagctccttgcagggctttgttctgatgggcatatcagaccatccccagctggagatgatcttttttatagccatcctcttctcctatttgctgaccctacttgggaactcaaccatcatcttgctttcccgcctggaggcccggctccatacacccatgtacttcttcctcagcaacctctcctccttggaccttgctttcgctactagttcagtcccccaaatgctgatcaatttatggggaccaggcaagaccatcagctatggtggctgcataacccagctctatgtcttcctttggctgggggccaccgagtgcatcctgctggtggtgatggcatttgaccgctacgtggcagtgtgccggcccctccgctacaccgccatcatgaacccccagctctgctggctgctggctgtgattgcctggctgggtggcttgggcaactctgtgatccagtcaacattcactctgcagctcccattgtgtgggcaccggagggtggagggattcctctgcgaggtgcctgccatgatcaaactggcctgtggcgacacaagtctcaaccaggctgtgctcaatggtgtctgcaccttcttcactgcagtcccactaagcatcatcgtgatctcctactgcctcattgctcaggcagtgctgaaaatccgctctgcagaggggaggcgaaaggcgttcaatacgtgcctctcccatctgctggtggtgttcctcttctatggctcagccagctatgggtatctgcttccggccaagaacagcaaacaggaccagggcaagttcatttccctgttctactcgttggtcacacccatggtgaatcccctcatctacacgctgcggaacatggaagtgaagggcgcactgaggaggttgctggggaaaggaagagaagttggctga

SEQ ID NO: 9 - DNA, 948 bp, Homo sapiens
atgtccataaccaaagcctggaacagctcatcagtgaccatgttcatcctcctgggattcacagaccatccagaactccaggccctcctctttgtgaccttcctgggcatctatcttaccaccctggcctggaacctggccctcatttttctgatcagaggtgacacccatctgcacacacccatgtacttcttcctaagcaacttatctttcattgacatctgctactcttctgctgtggctcccaatatgctcactgacttcttctgggagcagaagaccatatcatttgtgggctgtgctgctcagttttttttctttgtcggcatgggtctgtctgagtgcctcctcctgactgctatggcatacgaccgatatgcagccatctccagcccccttctctaccccactatcatgacccagggcctctgtacacgcatggtggttggggcatatgttggtggcttcctgagctccctgatccaggccagctccatatttaggcttcacttttgcggacccaacatcatcaaccacttcttctgcgacctcccaccagtcctggctctgtcttgctctgacaccttcctcagtcaagtggtgaatttcctcgtggtggtcactgtcggaggaacatcgttcctccaactccttatctcctatggttacatagtgtctgcggtcctgaagatcccttcagcagagggccgatggaaagcctgcaacacgtgtgcctcgcatctgatggtggtgactctgctgtttgggacagcccttttcgtgtacttgcgacccagctccagctacttgctaggcagggacaaggtggtgtctgttttctattcattggtgatccccatgctgaaccctctcatttacagtttgaggaacaaagagatcaaggatgccctgtggaaggtgttggaaaggaagaaagtgttttcttag

SEQ ID NO: 10 - DNA, 936 bp, Homo sapiens
atggctgctgagaattcctccttcgtgacacagtttatcctcgcaggcttaactgaccaaccgggagtccagatccccctcttcttcctgtttctaggcttctacgtggtcactgtggtggggaacctgggcttgataaccctgataaggctcaactctcacttgcacacccctatgtacttcttcctctataacttgtccttcatagatttctgctattccagtgttatcactcccaaaatgctgatgagctttgtcttaaagaagaacagcatctcctacgcagggtgtatgactcagctcttcttctttcttttctttgttgtctctgagtccttcatcctgtcagcaatggcgtatgaccgctatgtggccatctgtaacccactgttgtacatggtcaccatgtctccccaggtgtgttttctccttttgttgggtgtctatgggatggggtttgctggggccatggcccacacagcgtgcatgatgggtgtgaccttctgtgccaataaccttgtcaaccactacatgtgtgacatccttccccttcttgagtgtgcttgcaccagcacctatgtgaatgagcttgtagtgtttgttgttgtgggcattgatattggtgtgcccacagtcaccatcttcatttcctatgctctcattctctccagcatcttccacattgattccacggagggcaggtccaaagccttcagcacctgcagctcccacataattgcagtttctctgttctttgggtcaggagcattcatgtacctcaaacccttttctcttttagctatgaaccagggcaaggtgtcttccctattctataccactgtggtgcccatgctcaacccattaatttatagcctgaggaataaggacgtcaaagttgctctaaagaaaatcttgaacaaaaatgcattctcctga

SEQ ID NO: 11 - DNA, 948 bp, Canis familiaris
atgcagtcaaaatttggggccaatagcacagccattactgagttcatcctgctgggcttggtggacacaccagggctacaaccagttgtctttgtagtcttcctctttgcctacctggtcacagtcggaggcaacctcagcatcctggctgccatcttggtggaacccaaactccacacgcccatgtacttcttcctggggaacctgtcagtgctggatgttgggtgcatcactgtcactgttccctcaatgttggctcgcctcttgtcccacaaacgtacagttccctacagagcctgcctcacacaactcttcttcttccatctcttggttggggtggactgcttcctgttgacagccatggcctatgaccgattcctggccatctgccggcccctcacctacagcacccagatgagccagacagtccagagaatattggtagttgtgtcctgggctttagccttcaccaatgcactgacccacacagtagccatagccacactcaacttttgtggtcctaatgtgatcaaccacttctactgcgacctcccacagctcttccagctctcctgctccagcactcagctcaatgagctgctgctctttgctgtgggtttcataatggcaggtacccccttggctctcatcatcacttcctatgcacatgtggcagctgcagtcctaagaatccgctctgctgagggcaggaagaaagctttctctacatgtggctctcatctcactgtggtagccatattctatggttcaggtatatttaattacatgcgactgggtacagccaagcattcagacaaggataaaggggttggggtcttcaacactgtcatcaaccccatgctgaatccaatcatttacagcctcaggaaccttgatgtacagggtgccctctggcgggtgctcaggggaaggcagtcactggcttga

SEQ ID NO: 12 - DNA, 957 bp, Canis familiaris
atgatgggaaatttgagtggaggccacatagcagattttattttggtgggcttcccaacctctccacccctccagttacttctctttgtcctcttctttgcaatttacctgttgacactgttggagaatgcactcatcgtttccacaatctggctcactccaagccttcaccgcccgatgtactttttccttggccatctgtccttcctggagctgtggtacatcaatgtcacagttcctcgtcttttgggagcatttcttacccaggaccgtagagtctcctatgtaggctgcatgacccagctctacttcttcattgccctagcctgcaccgaatgtgtcctgctggcagtcatggcctatgaccgctacctggccatctgtgagcccctccgttatcctagtctcatgccgtccagcctggccattcgccttgctgcttcctcttggggtggtggcttcttcagctccatgatgaagcttcttttcatttcccgactgtcctactgtgggcccaacatcatcaaccattttttctgtgatatctccccactactcaaccttacctgctctgacaaggagcaagcagaactagtagacttcctgttggccctggtgatgatcctgcttcctctactggctgtggtttcatcatatgctgccatcattgccaccatcctgaggatccctactgcccagggacgtcgcaaagccttttccacctgtgcctctcacctggcagtggttgtcatctactactcctccaccctcttcacctatgcaaggccccgggccatgtacaccttcaaccacaacaagatcatctctgtgctctatacggtcattgtaccattcctcaatccagccatctactgcctgaggaacaaggaggtgaaggatgctctcaggaagttggttctgggcagatgccactatcctagtgatgtcccagactga

SEQ ID NO: 13 - DNA, 954 bp, Canis familiaris
atggtggaccccaatggcaatgaatccagtgccacatattttattttaataggcctcccaggcttggaagaagctcagttctggttggccttccccttgtgctccctctactttattgctgtattgggtaacctgacaatcatctacattgtgcggactgagcacagcctacatgaacccatgtatgtttttctttgcatgctttctggccttgacatccttatctccacctcatctatgcccaaaatgatggccatcttctggttcaattccactaccatccagtttgatgcttgtctactacagatgtttgccatccattctttatctggcatggagtccacagtactgctggccatggcctttgaccgctatgtggccatttgccacccactacgccatgccactgtactaacattgcctcgtgttatgaagattggcatggctgctgtggtacggggtactgcacttatggcacccctgcctgtttttatcaaacgactgcctttctgccactccaacattctttcccattcctactgcctacaccaagatgtcatgaagctggcttgtgctgacatccgtgtcaatatcatctatggcctcattgtcatcatctctgccattggcctggactcacttctcatctccttgtcatatctacttatcctcaagactgtgttgggcttgacacgtgaagcccaggcaaaggcatttggcacttgtgtctctcatgtatgtgctgttttcatattctatgtacctttcattggattatctatggtgcaccgctttggcaagagacatgactccttcctgcccatcattatggccaacacctacctacttgtacctcctgtgctcaaccccattgtttatggagtcaagacaaaggagatctggcagcgtatccttcgtcttttccatgtgaccaaccatacttcagatctctag

SEQ ID NO: 14 - DNA, 963 bp, Canis familiaris
atgccaagggtcaccatggtggtctggaataacaataacactctggagcccatatttattctgaagggatttcctgggttggagtgtgttcattcttggttctcaatccctttctgtcttgcgtacttggtagcatttattggtaatgtcaccatcctctctgtcatctggatagagtcctcactccaccagcccatgtattactttctttccatcttggcactgactgacctaggcatgtccatgtccacacttcccaccatgcttgctgtgttatggctggatgctagagagatccaggcaagtgcttgctatgctcagctcttcttcatccacacattcacattcctggagtcttcggtgctattggccatggccttcgatcgttttgttgctatctgccgtccactgcactacaccaccatccttaacaacagtgtaataggcaagattggcttggcctgcttgctaagaagcatgggagttgtacttcctacacctttgctactgagacattatcactactgccatgtcaatgccctttcccatgccttctgtttgcaccaagacgttctcaaattgtcctgttcagatgccaggatcagcagtgtctatggactgtgtgtagtcatcactacactgggcatggattcagtcttcatacttctttcttatgtcctgattttgaatgctgtgctgggcatagcatctcatgaagagcggctaaaggcactcaacacatgtgtgtcccatatctgcgtggtgctcattttctttgtgccagttattggggtgtcaatggtccatcgctttgggaaacatctgtctcccatagttcacatcatcatggctgatatttacttgcttttccccccagtacttaaccctattgtctatagtgtcaggacaaagcagattcgtataagaattttccacaagttaagactagggaggaggctttaa

SEQ ID NO: 15 - DNA, 993 bp, Canis familiaris
atgctcatcattattcactcattggttatctctgcttctctaacagctttggaatcccagaacacaacaatgcgttttgtgtctgagtttgtcctcctgggtttccctggtcaaagggagatgcagaactttttcttctcattcatcctggtgatctatctcctcaccctgctggggaatgggattattgtctgcatagtgaaatgggacaagcagcttcacacacccatgtacatcttcttgggaaactttgccttcctagagatctggtacacctcctccactgtcccaagtatgctggtcaacatcctttccgagaccaagaccatctccttcactgggtgcttccttcaattctacttctttttctcactgggtacaacagagtgtttcttcttatcagtcatggcttatgatcggtacctcgccatctgtcgcccactccattacccctccatcatgactgggaagctctgtgtggccctggtctgtgtttgctgggtgagtggatttctctgctatccagtccccattgtcctcatctcccaacttccattctgtggacccaacatcattgatcactttgtgtgtgacccaggcccactgttcgcactggcctgcatccctgctccttccactgagcttctctgttacaccttcaattcactgattatcttcgggcccttcctcttcatcctgggatcttacaccctggttctcagagctgtgcttcgcattccttctggtgcaggtcgaactaaagcattctccacgtgtgggtcccatctaatggtggtgtctctattctatggaacccttatggtgatgtatgtgagcccgacatcagggaatccgacgggaatgcaaaagatcatcactctggtatactcggcagtgactccactcttaaacccccttatctatagtctccgaaacaaagacatgaaagatgccctaaagaaagtcctaggattaagaagtaaccaaaactga

SEQ ID NO: 16 - DNA, 936 bp, Canis familiaris
atgggccagagcaaccacaccaatgtgaaggaatttgtctttctgaaactcactcacttccacgagctagaattgttcttgtttgtggtcttccttgctgtatatgtagcaactgtgctgggcaatgtcctcattgtggtgaccatcacctgtgagtcccacctccactctcccatgtactttctgctgcggaacaaatcagtcctggacattgtcttttcatctgtcactgttcccaagttcctggtggatctgttatcagagagaaaaaccatctcctacaatggctgcatggcacagatcttcttcttccacttcgctggtggggcagacattttcttcctctctgtgatggcctatgacaggtaccttgcaatcgccaaacccctgcattatgtgaccattatgaggagagagacgtgggtgggcttggtggtggcttcctgggtgggtggtggtttgcactcaattgtccaggtaactctcatgcttccactccctttctgtggccccaacatcctggatgccttctactgtgatgtgccccaagtgattaagctggcctgtaccaacacctttgccctggagcttctcatgatctctaacaatgggctggtgaccctgctgtggttcctcctgctcctgggctcctacactgtcattctggtgatgctgagatctcactctggggaggggcggaataaggccctgtccacctgcacttcccatatcttcgtggtgaccctgcacttcgtgccttgcgtctacatctactgccggcccttcatcacgctgcccatggacacagttgtatccatcaataacacagtcattacccccatgctgaaccccatgatctatacactgaggaaccaggagatgaagtcagccatgaaaagactgcagagaaggcttggaccttctgagagcagttag

SEQ ID NO: 17 - DNA, 927 bp, Canis familiaris
atggaggctccgaatcaaacaagagtgactgagtttgtcttcttggggctcacagataactgggcgctggggacgctactttttgtggcattctccctggcttatgtgctcacccttctggggaacactctcatcatagtgaccacggcccttacccggcgcctccatacccccatgtacttcttcctgagcaacctgtccttcattgacacctgccactcctcggtcactgtgcccaagatgctggagggcctgcttagggagagaaagactatttcctttgatgactgcattgcgcagctcttcttcctacacctgttcgcttgtgctgagatccttctgctgaccgtcatggcttacgaccgctacgtggccatctgtgccccgctgcgctaccccaacgtgatgagcatccgggtgtgtgtgcagctcgtcctcgccctctggtgggggggtaccgttcactctctggtgcagaccctcctgaccattcgtttgccctactgcggccccaacgttatcgatagctacttctgcgatgtgccccccgtcatcaagctggcctgcacggacacctacctcacgggagtgctcattgtctccaacagtggaaccatctccctcacctgtttcctggctttggtcacctcttacacaatcatcctggtgtctcttagaaaacagtctgctgaagggcgccggaaagctctgtctacgtgctcagcccacttcatggtggtcgccttcttctttggaccatgcatcttcatctacactcggccagacaccagcttctccatcgacaaggtggtatctgtcttctacaccgtggtcacccctttgctaaatcccctcatttacaccttgaggaatgaggaggtaaaaagtgccataaagcatctcagacagaaacaggttttctcataa

SEQ ID NO: 18 - DNA, 939 bp, Canis familiaris
atgccagaggccaacgacagcttcctggagggcttcattctgatgggtatatctgaccatccccagctggagataatctttttcatggtcattctcttctcttacttactgactctgcttgggaactcaaccattatcctgctttcctggctggatgcccggctccatactcccatgtacttcttcctcagcaacctctccaccctggaccttgcttttactactagctcagtcccccaaatgctgatcaacttatggggaccagataagaccataagctatggtggctgtgtgacccagctctatgttttcctctggctaggggccactgagtgtatcctgcttgtggtgatggcgtttgaccgctatgtggcagtttgccggcccctgcactacaccaccatcatgaaccctcggctctgctggctgctggctgccattgcatggctgggtggcttgagcaactctgtgatccagtcaaccttcactctgcagctccccttatgtgggcaccggagggtggacaacttcctgtgtgaggtacctgccatgatcaaactggcctgtggagacacgagtctcaatgaggttgtgctcaatggtgtctgcaccttcttcactgctgtcccactaagtgtcatcctgatctcctactgctacatagctcaggcagtgctgaagatccactcagtagagggacagagaaaggcctttaatacgtgcctctcacatctggtggtggtgttgctcttctatggctcagctatctatgggtatctccttccagctaagaccagcaaccaggaccagggcaaattcatttccctcttctactctgtggtcacaccaacggtgaaccctctcatctacactctgagaaatagggaagtaaagggagcactaaggaggctgctaggaaagggaagatcacttggctga

SEQ ID NO: 19 - DNA, 960 bp, Canis familiaris
atgtccacagttaaggcctggaacagctcttcagtgaccatgttcatcctcctgggatttgcagaccatccagaactgcagactcttctctttgtgaccttcctgagtatctatcttgtgacactggcctggaacctggccctcatctttctgatcagaagtgacccccatctgcacacacccatgtacttcttcctcagcaacttgtccttcattgacatctgttattcttccacagtggcccccaagatgctcactgatttcttccaggagcaaaagaccatctcgttcttgggctgtgctgctcagttttttttctttgtcagcatgggtctcactgagtgcttccttctgactgccatggcatatgatcgatacgcagccatctccaaccccttgctctacactgccatcatgtcccagggcctctgtacacgcatggtgctgggggcatatgtcggtggtttcctgagctccttgatccaggccatctctatatttcagctccacttctgtggacccaatatcatcaaccatttcttctgtgaccttccaccagtcctggcactttcttgctctgacaccttccctagtcaagtggtgaattttctcatagtgatcactgttgggggaacatcattcctcatcctcctcatctcctacagttacataggagctgctgtcttgaagatccgctcagtggaaggccgaaggaaagccttcaacacatgtgcctcgcatctgatggtggtgactcttctgtttgggacagctcttttcatgtacctgcggcccagctccagctactcacttgccagggacaaggtggtgtctgtcttctattcgctggtgatccccatgctgaaccctctcatttacagtctaaggaacagagatatcaaagacgccctgtggaaggcattggagaagaagaaagtgtttttcctagatcatgattga

SEQ ID NO: 20 - DNA, 948 bp, Canis familiaris
atgcctttagtaagaatggcagctgagaattcctctgtgacagagtttatcctctcaggcttaaccaaccagccaggactccagattcctctcttcttcctgtttctaggtttctatgtggtcacggtggtagggaacctgggcctgataaccctgattgggctgaattctcacctgcacacccccatgtactttttcctcttcaacttgtccttcatagatttctgctattccactgttatcactcccaagatgctgatgaattttgtcttgaggaagaacgtcatctcctacgcagggtgtatgactcagctcttcttctttctcttctttgttgtatctgagtccttcatcctgtcagcaatggcatatgaccgctatgccgccatctgtaacccactggtatacactgccaccatgtctcctcaggtctgcttcctccttctgttgggtgtctatgtgatggggtttgctggagccatggcccacacagtgtgcatggtaagactgaccttctgtgccaacaatctggttgaccactacatgtgcgacatccttccccttcttgagcgttcttgcaccagcacctatgtcaatgagctggtagtttttattgttgtgggcattgatattggtgtgcccacagttaccatcttcatttcttatgccctcatcctctccagcattctccgtattcattctaccaagggcaggtccaaagccttcagcacctgcagctcccacataattgctgtttccctcttctttggatcaggggcatttatgtacctcaaaccatcctctcttttacctatgaatcaggggaaagtgtcctctttgttctacaccatcgttgtgcccatgctcaacccactaatctacagcttgaggaataaggatgtcaaaattgctctgaagaaaacactgagcaagaaaccattctcttga

SEQ ID NO: 21 - DNA, 948 bp, Felis catus
atgaagtcaaaatttgagtacaatagaacagccattactgagttcatcctgctgggcttagtggagacaccagacctgcggccagttgtctttgtagtcttcctcctttcctacctgctcacagttgggggcaacctcagcatcctggccgccatcttggtggagcccaaactccacacccccatgtacttcttcctggggaacctatcggtgctggacattgggtgcatcacagtcactattccctcaatgttggctcgtctcctgtcccacaagcgtactgttccctatggagcctgcctcacacagcttttcttctttcaccttctcgttggggtggactgcttccttttgacagccatggcctatgaccgattcctggccatctgccagcccctcacctacagcacccgaatgagccagacagtccagaggatattggtggctgtgtcctgggctttagccttcactaatgcactgacccacacagtagccatatccaccctgaacttctgtggtcccaatgtgatcaatcacttctactgtgacctcccacagctcttccagctctcctgctccagcacccaactcaatgagttgctgctctttgctgtgggtttcataatggcaggtactcccctggctctcatcgtcacctcctatgcccatgtgacagctgcagtcctacgaatccgttctgctgagggcaggaagaaagccttctccacatgtggctctcatctcactgtggttgccatattctacggttcaggtatatttaattacatgcgactgggttcagccaagctttcagacaaggataaagcttttggaatttttaacaccgtcatcaaccccatgctgaatccaatcatctacagcctcaggaaccctgacgtgcagggtgccctctggagagtgctcatggggaggcggccactggcttga

SEQ ID NO: 22 - DNA, 954 bp, Felis catus
atgggaaattggagcagaggccacatagcagagttcgtgttggtgggcttccctacctctccgcccctccagtgcctcctctttgtcctcttcctggcaatttacctgttgacattgttggagaacgcactcatcgtttccacagtctggctcacgccaagccttcaccgcccgatgtactttttccttggccatctctccttcctggagctgtggtacatcaatgtcacagttccccggcttttgggagcatttcttacccaggagcgtagagtctcctacgtaggctgcatgactcagctctacttctttattgccctagcctgcaccgaatgtgtcctgctggcggtcatggcctatgaccgctacctggccatctgtgagcccctccgttatcctagtctcatgccatccagcctggccattcgcctcgctgcttcctcttggggtagtggcttcttgagctccatgatgaagcttcttttcatttcccggctgtcctactgtggacccaacgtcatcaaccactttttctgcgatatctccccactactcaacctcacctgctctgacaaagagcaagcagaactagtagacttcctcttggccctggtgatgattctgctccctctgttggccgtggtttcatcatatgctgccataatggctgccatcctcaggattcctactgcccagggacgtcgcaaagccttctccacctgtgcctctcacctggcagtggttgttatctactactcctccaccctcttcacctatgcacggccccaggccatgtacaccttcaaccataacaaggtcatctctgtgctctatacagtcattgtaccgttcctcaatccagccatctactgcctgaggaacaaggaggtgaaggatgctctcaggaagtcagtcctgggcagatgccactatccgagggacgtcccagattga

SEQ ID NO: 23 - DNA, 954 bp, Felis catus
atggtggacaccaatggcagtgaatctagtgccacatatttcattctaataggccttccaggcttggaaaaagctcagttctggttggccttcccgttatgctccctctaccttattgctgtgctaggtaacctgacagtcatctgcattgtgcggactgagcacagactacatgaacccatgtatatttttctttgcatgctttctggccttgacatacttatctctacttcatctatgcccagaatgatggccatcttctggttcaattccactaccatccagtttgatgcttgtcttctacagatgtttgccatccactccttatctggcatggagtccactgtactgctggccatggcctttgaccgctatgtggccatttgtcacccactacgccatgccactgtgctaacattgcctcgtgttaccaagattggcgtggctgctgtggtacggggtacttcacttatggcacccctgcctatcttcatcaaacggctgcctttctgccgctccaacattctttcccattcctactgcctacatcaagatgtcatgaagctggcttgtgctgacatccgtgtcaatatcatctatggcctcattgtcatcatctctgccattggcctggactcacttctcatctccttgtcatatctgcttatcctcaagactgtgttgggcttgacacgtgaagcccaggcaaaggcatttggcacttgtgtctctcatgtgtgtgctgttttcatattctatgtacctttcattgggttatctatggtgcaccgctttgggaagcggcatgactccctcctgcccatcattatggccaacacctacttgcttgttcctcctgtgctcaaccctattgtttatggagtgaagacaaaggagatccggcagcgtatccttcgtcttttccatgtgaccacccatacttcagatccctag

SEQ ID NO: 24 - DNA, 963 bp, Felis catus
atgccaaggttcaccatggtggtctggaataacaataacaccatggagcctatatttattctgaggggatttcatggattggagtgtgtctattcttggatctcagtcccattctgtcttgcatacttggtagcatttattggtaatgttaccatcctctctgtcatttggatagagtcatcactccatcagcccatgtactacttcctttccatcttggcactgactgacctaggtatgtctatgtccacacttcccaccatgcttgctgtgttatggctggatgctcgggagatccaggcaagtgcttgctatgctcagctctttttcatccacacattcacattcctggagtcttcggtgctactggccatggcctttgaccgttttgttgctatctgccgtccactgcactatactaccatccttaacaacagtgtaataggcaagattggtttggcctgcttgctaagaagcatgggagttgtacttcctacacctttgctactgagacattatcactactgccatgacaatgccctttcccataccttctgtttgcaccaagacattctgaaattatcctgttcagatgcaaggatcagcagtgtctatggcctgtgtgtagttattaccacacttggtgtggattcagtctgcatacttctttcttatatcctgattctgaatgctgtgctggggattgcatctcatgaagagcggcggaaggcactcaacacatgcatatcccatatctgtgttgtgctcattttctttgtgccagtaattggggtgtcaatggtccatcgctttgggaaacatctgtctccaagaattcacatcatcatggccgatatttacctgcttttccccccagtgcttaaccctattgtctatagcatcaaaacaaagcagattcgtctaagaattctccgcaggtttggactgcggagggggcattaa

SEQ ID NO: 25 - DNA, 993 bp, Felis catus
atgttcattgttattcactccttcgttacttctatttctctaacagctttggaatctcagaacgcaacaatgcattttgtgactgagtttgtcctcctgggttttcctggtcaaagggagatgcagaactttttcttctcattaatccttgtggtctatctcctcactctgctggggaatggggttattgtctatgtagtgaaatgggacaagcggcttcacacacccatgtacatcctcttgggaaactttgccttcctagagatctggtacatctcctccactgtcccaaacatgctggtcaccatcctctctgagaccaagaccatctccttcactggatgcttcctccaattttatttctttttctcattgggtacaacagagtgtttcttcttatcagttatggcttatgaccggtaccttgccatctgtcgcccactacattatccttccatcatgactgggaagctctgtgtgatcctggtctgcgtttgctgggtgagtggatttctctgctatccaatccccattgtcctcatctcccaacttcccttctgtggacctaacatcattgaccacttcgtgtgtgacccaggcccattgttcgcactggcctgcatccctgctccttccactgaacttatctgctataccttcaactcagtgattatctttgggcccttcctttctatcttgggatcttacactctggtactcagagctgtgcttcgtattccttctggtgctggtcaaactaaagctttctccacatgtgggtcacacctaatggtggtgtctctattctatggaacccttatggtgatgtatgtaagcccaacatcaggaaatccagcaggaatgcagaagatcgtcactttggtatactcagcagtgactccactcttaaacccccttatctatagtcttcgaaataaagacatgaaagatgccctaaagaaactcctaggattaagaagtaacccaaactga

SEQ ID NO: 26 - DNA, 966 bp, Felis catus
atggaggagggtggtcccaaccatggccagagcaaccacaccaatgtgaaggaatttgtcttcctagaactcactcacttccaggagctggaatgtttcttgtttgtggctttccttgctgtatatgtaaccaccgtgctgggcaatgccctcattgtgctgaccatcacctatgagtcccaccttcacactcccatgtactttctgctgcggaacaaatcggtcctggacattgttttttcatctgtcactgttcccaagttcctggtggatctgttatcagagaggaaaaccatctcctacaatggctgcatggcacagatcttcttcttccattttgctggtggggcagatattttcttcctctccgtgatggcctatgacagataccttgcaatcgccaaacccctgcattatgtgaccattatgaagagagaggtgtgggtgggcttggtggtggcttcctgggtgggcggtggtttgcactcaattgtccagataattctgatgcttccactctccttctgtggccccaacatcctggatgccttctactgtgatgtgccccaagtagttaagctggcttgcactgatacctttgctctggaacttctcatgatctctaacaatgggttggtgaccctgctatggttcctcttgctcctgggatcctacaccgttattctggtgatgctgagatctcactctggggcaggacggaacaaggccctgtccacctgcacctcccatatcctcgtggtgactctgcactttgtgccttgtgtctacatctactgccggcccttcactacactgcccatggacacagctgtgtccatcaataacacggtcattacgcccatgctgaaccccatgatttataccctgaggaaccaggagatgaagtctgccatgaaaagactacacagaaggcttggaccttctgagagcagtaagctggggtga

SEQ ID NO: 27 - DNA, 939 bp, Felis catus
atggatgctctaaatcaaacaagagtgactgaatttgtcttcttgggactcactgataagtgggtgctggagatactattttttctggcattctccgtcacatatgtattaacccttttgggaaacactctcattatagttactatagtctttactccacgcctccatacccccatgtatttcttcctgagcaatctgtcctttattgacatctgccactcatctgtcactgtgcccaagatgctagagggcttgcttttagagataaagactatttcctttgataattgcattgcacagctcttcttcctacatctgtttgcttgtgctgagatctttctgctgaccattatggcttatgatcgttatgtagccatctgtgctccattgcactattctaatgtgatgaacatgagggtctgtgtacagcttgtctttgctctctggttgggggctactgttcactctctggtgcagaccttcttgaccattcgtctaccttactgtggccccaacattattgatagctacttctgcgatgtgccccctgtcatcaagctggcttgcacagatacatacctcacgggaatgctaattgtgtctaatagtggaaccatctccctcacctgtttcctggctttggtcacctcttacacggtcatcctggtttctcttagaaaacagtcagctgaagggcgccggaaagccttgtctacctgttcagcccacttcatggttgtagccttcttttttggaccatgtatcttcatctacactcggccagacactagcttctccattgacaaggtggtatctgtcttctacacagtggtcactcctttgctgaatcctctcatttacaccttgagaaatgaggaggtaaaaagtgccatgaagcatctcagacagagaggttttttcatgaagtcaggtacatga

SEQ ID NO: 28 - DNA, 939 bp, Felis catus
atggcagaggccaacaacagcttttcagagggctgcatcctgatgggtatatctgaccatccccagctggagatcgtctttttcatagtcattctcttctcttactcgctgaccctagttgggaattcgaccaccatcctgctctcctgcctggatgcccggctccacacccccatgtacttcttcctcagcaacctctcctccctggacctcgcttttactaccagctcggtcccccaaatgctgaccaacttatggggaccagataagactataagctacgctggctgtgtgatccagctctatgttttcctctggctaggggccactgagtgcatcctgctcgtggtgatggcattcgaccgccatgtggcagtttgccagcccctgcgctacaccgtcatcgtgagccctcggctctgccggctgctggctgccattgcatggctgggcggcttgagcaactccatgatccagtcaacgttcactctccagctcccattgtgtgggcaccggagggtggacaacttcctgtgtgaggtgcctgccatgatcaaactggcctgtggagacacaagtctcaacgaggccgtgctcaatggtgtctgcaccttcttcactgccgtcccgctgagcatcatcctgatctcctactgctccatagctcgggcagtgctgaagatccgctcagctgagggacagagaaaggcctttaatacttgcctttcccatctggtggtggtgctcctcttctatgggtcagctatctacgggtacctccttccggctaagaccagccaccagggccaaggcaaattcatttccctcttctactctgtggtcacgccaatggtgaaccctctcatctacactctgagaaacaaggaggtaaaggcggcactgaggaggctccggggaaagggaagagaattcggctga

SEQ ID NO: 29 - DNA, 957 bp, Felis catus
atgagaagcatgtccacagctaaggcctggaatagctcttcagtaaccatgttcatcttcctgggatttgcagaccatccagaactccagacccttctctttgtgaccttcctgggtatctatcttgtgacactggcctggaacctggccctcatctttttgatcagaggtgacccccgtctgcacacacccatgtacttcttcctcagcaacttgtctttcatcgacatctgctactcttctacagtggcccccaagatgctcactgatttcttctgggagcaaaagaccatatcattcttgggctgtgctgctcagttttttttctttgtcagtatgggtctcactgagtgcttcctcctgactgccatggcatacgacagatacgcagccatctccaatcccctgctgtacacagccatcatgtcccaaggcctctgcacacgcatggtgcttggggcatatgttggtggcttcctgagctccctgatccaggccagctccatatttcagcttcacttctgcggacccaacattatcaatcatttcttctgtgacctccctccagtactggcactttcttgctctgacacctttcctagtcaagtggtgaattttctcgtggtagtcactattggggggacatcattcctcatcctcatcatctcctacagttacataggaactgctgtcttgaaaatccgttcagtggaaggccgaaagaaagccttcagcacatgtgcctcacacttgatggtggtgactctgttgtttgggacggcccttttcatgtacctgagacccagctccagctactcgcttggcagggacaaggtagtgtctgtgttctattcactggtgatccccatgctgaaccctcttatttacagtttgaggaacagagagatcaaagatgccctatggaaggtgttggagaagaagaaactgttttcctag

SEQ ID NO: 30 - DNA, 945 bp, Felis catus
atgcctttaatgagaatggcagctgagaactcctctgtgacagaatttatccttgcaggcttaaccaaccagcccggacttcggatgcccctcttcttcctgtttctaggtttctatgtggtcactgtgatggggaacctgggtctgataaccctgattgggctgaattctcacctgcacacccccatgtacttcttcctcttcaacttgtccttcatagatttttgctattccactgttatcactcccaagatgctgatgagttttgtctcaaagaacaccatcgcctacgcagggtgtatgactcagctcttcttttttcttttctttgttgtctctgagtccttcatcctgtcagcaatggcatatgaccgctacaccgccatctgtaacccactggtgtacacagccaccatgtctcctcaggtctgctcgcttcttctgttgggtgtctatgtgatggggtttgctggggccatggcccacacgacatgcatggtgaggctgaccttctgtgccaacaatctggttgaccactacatgtgtgacatccttccccttcttgagcgctcttgcaccagcacctatgtaaatgagctggtagttttcgttgtcgtgggcattgatattggcgtgcccacagttaccatcttcatttcttatgccctcatcctcaccagcattctccatattcgttccactgagggcaggtccaaagccttcagcacatgcagctctcacataattgctgtttctcttttctttgggtcaggggcatttatgtacctcaaaccatcctctcttttacctatgaatcaggggaaagtgtcctccttgttctataccaccgttgtgcccatgctcaacccgctaatctatagcttaagaaataaagatgtcaaagttgctctgaagaaatcattgagcaaaaagacattctcttga

SEQ ID NO: 31 - protein, 315 aa, Homo sapiens
MQPESGANGTVIAEFILLGLLEAPGLQPVVFVLFLFAYLVTVRGNLSILAAVLVEPKLHTPMYFFLGNLSVLDVGCISVTVPSMLSRLLSRKRAVPCGACLTQLFFFHLFVGVDCFLLTAMAYDRFLAICRPLTYSTRMSQTVQRMLVAASWACAFTNALTHTVAMSTLNFCGPNVINHFYCDLPQLFQLSCSSTQLNELLLFAVGFIMAGTPMALIVISYIHVAAAVLRIRSVEGRKKAFSTCGSHLTVVAIFYGSGIFNYMRLGSTKLSDKDKAVGIFNTVINPMLNPIIYSFRNPDVQSAIWRMLTGRRSLA

SEQ ID NO: 32 - protein, 317 aa, Homo sapiens
MRNLSGGHVEEFVLVGFPTTPPLQLLLFVLFFAIYLLTLLENALIVFTIWLAPSLHRPMYFFLGHLSFLELWYINVTIPRLLAAFLTQDGRVSYVGCMTQLYFFIALACTECVLLAVMAYDRYLAICGPLLYPSLMPSSLATRLAAASWGSGFFSSMMKLLFISQLSYCGPNIINHFFCDISPLLNLTCSDKEQAELVDFLLALVMILLPLLAVVSSYTAIIAAILRIPTSRGRHKAFSTCAAHLAVVVIYYSSTLFTYARPRAMYTFNHNKIISVLYTIIVPFFNPAIYCLRNKEVKEAFRKTVMGRCHYPRDVQD

SEQ ID NO: 33 - protein, 318 aa, Homo sapiens
MMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 34 - protein, 315 aa, Homo sapiens
MGDWNNSDAVEPIFILRGFPGLEYVHSWLSILFCLAYLVAFMGNVTILSVIWIESSLHQPMYYFISILAVNDLGMSLSTLPTMLAVLWLDAPEIQASACYAQLFFIHTFTFLESSVLLAMAFDRFVAICHPLHYPTILTNSVIGKIGLACLLRSLGVVLPTPLLLRHYHYCHGNALSHAFCLHQDVLRLSCTDARTNSIYGLCVVIATLGVDSIFILLSYVLILNTVLDIASREEQLKALNTCVSHICVVLIFFVPVIGVSMVHRFGKHLSPIVHILMADIYLLLPPVLNPIVYSVRTKQIRLGILHKFVLRRRF

SEQ ID NO: 35 - protein, 330 aa, Homo sapiens
MFFIIHSLVTSVFLTALGPQNRTMHFVTEFVLLGFHGQREMQSCFFSFILVLYLLTLLGNGAIVCAVKLDRRLHTPMYILLGNFAFLEIWYISSTVPNMLVNILSEIKTISFSGCFLQFYFFFSLGTTECFFLSVMAYDRYLAICRPLHYPSIMTGKFCIILVCVCWVGGFLCYPVPIVLISQLPFCGPNIIDHLVCDPGPLFALACISAPSTELICYTFNSMIIFGPFLSILGSYTLVIRAVLCIPSGAGRTKAFSTCGSHLMVVSLFYGTLMVMYVSPTSGNPAGMQKIITLVYTAMTPFLNPLIYSLRNKDMKDALKRVLGLTVSQN

SEQ ID NO: 36 - protein, 314 aa, Homo sapiens
MDQINHTNVKEFFFLELTRSRELEFFLFVVFFAVYVATVLGNALIVVTITCESRLHTPMYFLLRNKSVLDIVFSSITVPKFLVDLLSDRKTISYNGCMAQIFFFHFAGGADIFFLSVMAYDRYLAIAKPLHYVTMMRKEVWVALVVASWVSGGLHSIIQVILMLPFPFCGPNTLDAFYCYVLQVVKLACTDTFALELFMISNNGLVTLLWFLLLLGSYTVILVMLRSHSGEGRNKALSTCTSHMLVVTLHFVPCVYIYCRPFMTLPMDTTISINNTVITPMLNPIIYSLRNQEMKSAMQRLQRRLGPSESRKWG

SEQ ID NO: 37 - protein, 313 aa, Homo sapiens
MDSLNQTRVTEFVFLGLTDNRVLEMLFFMAFSAIYMLTLSGNILIIIATVFTPSLHTPMYFFLSNLSFIDICHSSVTVPKMLEGLLLERKTISFDNCITQLFFLHLFACAEIFLLIIMAYDRYVAICTPLHYPNVMNMRVCIQLVFALWLGGTVHSLGQTFLTIRLPYCGPNIIDSYFCDVPLVIKLACTDTYLTGILIVTNSGTISLSCFLAVVTSYMVILVSLRKHSAEGRRKALSTCSAHFMVVALFFGPCIFIYTRPDTSFSIDKVVSVFYTVVTPLLNPFIYTLRNEEVKSAMKQLRQRQVFFTKSYT

SEQ ID NO: 38 - protein, 312 aa, Homo sapiens
MDGVNDSSLQGFVLMGISDHPQLEMIFFIAILFSYLLTLLGNSTIILLSRLEARLHTPMYFFLSNLSSLDLAFATSSVPQMLINLWGPGKTISYGGCITQLYVFLWLGATECILLVVMAFDRYVAVCRPLRYTAIMNPQLCWLLAVIAWLGGLGNSVIQSTFTLQLPLCGHRRVEGFLCEVPAMIKLACGDTSLNQAVLNGVCTFFTAVPLSIIVISYCLIAQAVLKIRSAEGRRKAFNTCLSHLLVVFLFYGSASYGYLLPAKNSKQDQGKFISLFYSLVTPMVNPLIYTLRNMEVKGALRRLLGKGREVG

SEQ ID NO: 39 - protein, 315 aa, Homo sapiens
MSITKAWNSSSVTMFILLGFTDHPELQALLFVTFLGIYLTTLAWNLALIFLIRGDTHLHTPMYFFLSNLSFIDICYSSAVAPNMLTDFFWEQKTISFVGCAAQFFFFVGMGLSECLLLTAMAYDRYAAISSPLLYPTIMTQGLCTRMVVGAYVGGFLSSLIQASSIFRLHFCGPNIINHFFCDLPPVLALSCSDTFLSQVVNFLVVVTVGGTSFLQLLISYGYIVSAVLKIPSAEGRWKACNTCASHLMVVTLLFGTALFVYLRPSSSYLLGRDKVVSVFYSLVIPMLNPLIYSLRNKEIKDALWKVLERKKVFS

SEQ ID NO: 40 - protein, 311 aa, Homo sapiens
MAAENSSFVTQFILAGLTDQPGVQIPLFFLFLGFYVVTVVGNLGLITLIRLNSHLHTPMYFFLYNLSFIDFCYSSVITPKMLMSFVLKKNSISYAGCMTQLFFFLFFVVSESFILSAMAYDRYVAICNPLLYMVTMSPQVCFLLLLGVYGMGFAGAMAHTACMMGVTFCANNLVNHYMCDILPLLECACTSTYVNELVVFVVVGIDIGVPTVTIFISYALILSSIFHIDSTEGRSKAFSTCSSHIIAVSLFFGSGAFMYLKPFSLLAMNQGKVSSLFYTTVVPMLNPLIYSLRNKDVKVALKKILNKNAFS

SEQ ID NO: 41 - protein, 315 aa, Canis familiaris
MQSKFGANSTAITEFILLGLVDTPGLQPVVFVVFLFAYLVTVGGNLSILAAILVEPKLHTPMYFFLGNLSVLDVGCITVTVPSMLARLLSHKRTVPYRACLTQLFFFHLLVGVDCFLLTAMAYDRFLAICRPLTYSTQMSQTVQRILVVVSWALAFTNALTHTVAIATLNFCGPNVINHFYCDLPQLFQLSCSSTQLNELLLFAVGFIMAGTPLALIITSYAHVAAAVLRIRSAEGRKKAFSTCGSHLTVVAIFYGSGIFNYMRLGTAKHSDKDKGVGVFNTVINPMLNPIIYSLRNLDVQGALWRVLRGRQSLA

SEQ ID NO: 42 - protein, 318 aa, Canis familiaris
MMGNLSGGHIADFILVGFPTSPPLQLLLFVLFFAIYLLTLLENALIVSTIWLTPSLHRPMYFFLGHLSFLELWYINVTVPRLLGAFLTQDRRVSYVGCMTQLYFFIALACTECVLLAVMAYDRYLAICEPLRYPSLMPSSLAIRLAASSWGGGFFSSMMKLLFISRLSYCGPNIINHFFCDISPLLNLTCSDKEQAELVDFLLALVMILLPLLAVVSSYAAIIATILRIPTAQGRRKAFSTCASHLAVVVIYYSSTLFTYARPRAMYTFNHNKIISVLYTVIVPFLNPAIYCLRNKEVKDALRKLVLGRCHYPSDVPD

SEQ ID NO: 43 - protein, 317 aa, Canis familiaris
MVDPNGNESSATYFILIGLPGLEEAQFWLAFPLCSLYFIAVLGNLTIIYIVRTEHSLHEPMYVFLCMLSGLDILISTSSMPKMMAIFWFNSTTIQFDACLLQMFAIHSLSGMESTVLLAMAFDRYVAICHPLRHATVLTLPRVMKIGMAAVVRGTALMAPLPVFIKRLPFCHSNILSHSYCLHQDVMKLACADIRVNIIYGLIVIISAIGLDSLLISLSYLLILKTVLGLTREAQAKAFGTCVSHVCAVFIFYVPFIGLSMVHRFGKRHDSFLPIIMANTYLLVPPVLNPIVYGVKTKEIWQRILRLFHVTNHTSDL

SEQ ID NO: 44 - protein, 320 aa, Canis familiaris
MPRVTMVVWNNNNTLEPIFILKGFPGLECVHSWFSIPFCLAYLVAFIGNVTILSVIWIESSLHQPMYYFLSILALTDLGMSMSTLPTMLAVLWLDAREIQASACYAQLFFIHTFTFLESSVLLAMAFDRFVAICRPLHYTTILNNSVIGKIGLACLLRSMGVVLPTPLLLRHYHYCHVNALSHAFCLHQDVLKLSCSDARISSVYGLCVVITTLGMDSVFILLSYVLILNAVLGIASHEERLKALNTCVSHICVVLIFFVPVIGVSMVHRFGKHLSPIVHIIMADIYLLFPPVLNPIVYSVRTKQIRIRIFHKLRLGRRL

SEQ ID NO: 45 - protein, 330 aa, Canis familiaris
MLIIIHSLVISASLTALESQNTTMRFVSEFVLLGFPGQREMQNFFFSFILVIYLLTLLGNGIIVCIVKWDKQLHTPMYIFLGNFAFLEIWYTSSTVPSMLVNILSETKTISFTGCFLQFYFFFSLGTTECFFLSVMAYDRYLAICRPLHYPSIMTGKLCVALVCVCWVSGFLCYPVPIVLISQLPFCGPNIIDHFVCDPGPLFALACIPAPSTELLCYTFNSLIIFGPFLFILGSYTLVLRAVLRIPSGAGRTKAFSTCGSHLMVVSLFYGTLMVMYVSPTSGNPTGMQKIITLVYSAVTPLLNPLIYSLRNKDMKDALKKVLGLRSNQN

SEQ ID NO: 46 - protein, 311 aa, Canis familiaris
MGQSNHTNVKEFVFLKLTHFHELELFLFVVFLAVYVATVLGNVLIVVTITCESHLHSPMYFLLRNKSVLDIVFSSVTVPKFLVDLLSERKTISYNGCMAQIFFFHFAGGADIFFLSVMAYDRYLAIAKPLHYVTIMRRETWVGLVVASWVGGGLHSIVQVTLMLPLPFCGPNILDAFYCDVPQVIKLACTNTFALELLMISNNGLVTLLWFLLLLGSYTVILVMLRSHSGEGRNKALSTCTSHIFVVTLHFVPCVYIYCRPFITLPMDTVVSINNTVITPMLNPMIYTLRNQEMKSAMKRLQRRLGPSESS

SEQ ID NO: 47 - protein, 308 aa, Canis familiaris
MEAPNQTRVTEFVFLGLTDNWALGTLLFVAFSLAYVLTLLGNTLIIVTTALTRRLHTPMYFFLSNLSFIDTCHSSVTVPKMLEGLLRERKTISFDDCIAQLFFLHLFACAEILLLTVMAYDRYVAICAPLRYPNVMSIRVCVQLVLALWWGGTVHSLVQTLLTIRLPYCGPNVIDSYFCDVPPVIKLACTDTYLTGVLIVSNSGTISLTCFLALVTSYTIILVSLRKQSAEGRRKALSTCSAHFMVVAFFFGPCIFIYTRPDTSFSIDKVVSVFYTVVTPLLNPLIYTLRNEEVKSAIKHLRQKQVFS

SEQ ID NO: 48 - protein, 312 aa, Canis familiaris
MPEANDSFLEGFILMGISDHPQLEIIFFMVILFSYLLTLLGNSTIILLSWLDARLHTPMYFFLSNLSTLDLAFTTSSVPQMLINLWGPDKTISYGGCVTQLYVFLWLGATECILLVVMAFDRYVAVCRPLHYTTIMNPRLCWLLAAIAWLGGLSNSVIQSTFTLQLPLCGHRRVDNFLCEVPAMIKLACGDTSLNEVVLNGVCTFFTAVPLSVILISYCYIAQAVLKIHSVEGQRKAFNTCLSHLVVVLLFYGSAIYGYLLPAKTSNQDQGKFISLFYSVVTPTVNPLIYTLRNREVKGALRRLLGKGRSLG

SEQ ID NO: 49 - protein, 319 aa, Canis familiaris
MSTVKAWNSSSVTMFILLGFADHPELQTLLFVTFLSIYLVTLAWNLALIFLIRSDPHLHTPMYFFLSNLSFIDICYSSTVAPKMLTDFFQEQKTISFLGCAAQFFFFVSMGLTECFLLTAMAYDRYAAISNPLLYTAIMSQGLCTRMVLGAYVGGFLSSLIQAISIFQLHFCGPNIINHFFCDLPPVLALSCSDTFPSQVVNFLIVITVGGTSFLILLISYSYIGAAVLKIRSVEGRRKAFNTCASHLMVVTLLFGTALFMYLRPSSSYSLARDKVVSVFYSLVIPMLNPLIYSLRNRDIKDALWKALEKKKVFFLDHD

SEQ ID NO: 50 - protein, 315 aa, Canis familiaris
MPLVRMAAENSSVTEFILSGLTNQPGLQIPLFFLFLGFYVVTVVGNLGLITLIGLNSHLHTPMYFFLFNLSFIDFCYSTVITPKMLMNFVLRKNVISYAGCMTQLFFFLFFVVSESFILSAMAYDRYAAICNPLVYTATMSPQVCFLLLLGVYVMGFAGAMAHTVCMVRLTFCANNLVDHYMCDILPLLERSCTSTYVNELVVFIVVGIDIGVPTVTIFISYALILSSILRIHSTKGRSKAFSTCSSHIIAVSLFFGSGAFMYLKPSSLLPMNQGKVSSLFYTIVVPMLNPLIYSLRNKDVKIALKKTLSKKPFS

SEQ ID NO: 51 - protein, 315 aa, Felis catus
MKSKFEYNRTAITEFILLGLVETPDLRPVVFVVFLLSYLLTVGGNLSILAAILVEPKLHTPMYFFLGNLSVLDIGCITVTIPSMLARLLSHKRTVPYGACLTQLFFFHLLVGVDCFLLTAMAYDRFLAICQPLTYSTRMSQTVQRILVAVSWALAFTNALTHTVAISTLNFCGPNVINHFYCDLPQLFQLSCSSTQLNELLLFAVGFIMAGTPLALIVTSYAHVTAAVLRIRSAEGRKKAFSTCGSHLTVVAIFYGSGIFNYMRLGSAKLSDKDKAFGIFNTVINPMLNPIIYSLRNPDVQGALWRVLMGRRPLA

SEQ ID NO: 52 - protein, 317 aa, Felis catus
MGNWSRGHIAEFVLVGFPTSPPLQCLLFVLFLAIYLLTLLENALIVSTVWLTPSLHRPMYFFLGHLSFLELWYINVTVPRLLGAFLTQERRVSYVGCMTQLYFFIALACTECVLLAVMAYDRYLAICEPLRYPSLMPSSLAIRLAASSWGSGFLSSMMKLLFISRLSYCGPNVINHFFCDISPLLNLTCSDKEQAELVDFLLALVMILLPLLAVVSSYAAIMAAILRIPTAQGRRKAFSTCASHLAVVVIYYSSTLFTYARPQAMYTFNHNKVISVLYTVIVPFLNPAIYCLRNKEVKDALRKSVLGRCHYPRDVPD

SEQ ID NO: 53 - protein, 317 aa, Felis catus
MVDTNGSESSATYFILIGLPGLEKAQFWLAFPLCSLYLIAVLGNLTVICIVRTEHRLHEPMYIFLCMLSGLDILISTSSMPRMMAIFWFNSTTIQFDACLLQMFAIHSLSGMESTVLLAMAFDRYVAICHPLRHATVLTLPRVTKIGVAAVVRGTSLMAPLPIFIKRLPFCRSNILSHSYCLHQDVMKLACADIRVNIIYGLIVIISAIGLDSLLISLSYLLILKTVLGLTREAQAKAFGTCVSHVCAVFIFYVPFIGLSMVHRFGKRHDSLLPIIMANTYLLVPPVLNPIVYGVKTKEIRQRILRLFHVTTHTSDP

SEQ ID NO: 54 - protein, 320 aa, Felis catus
MPRFTMVVWNNNNTMEPIFILRGFHGLECVYSWISVPFCLAYLVAFIGNVTILSVIWIESSLHQPMYYFLSILALTDLGMSMSTLPTMLAVLWLDAREIQASACYAQLFFIHTFTFLESSVLLAMAFDRFVAICRPLHYTTILNNSVIGKIGLACLLRSMGVVLPTPLLLRHYHYCHDNALSHTFCLHQDILKLSCSDARISSVYGLCVVITTLGVDSVCILLSYILILNAVLGIASHEERRKALNTCISHICVVLIFFVPVIGVSMVHRFGKHLSPRIHIIMADIYLLFPPVLNPIVYSIKTKQIRLRILRRFGLRRGH

SEQ ID NO: 55 - protein, 330 aa, Felis catus
MFIVIHSFVTSISLTALESQNATMHFVTEFVLLGFPGQREMQNFFFSLILVVYLLTLLGNGVIVYVVKWDKRLHTPMYILLGNFAFLEIWYISSTVPNMLVTILSETKTISFTGCFLQFYFFFSLGTTECFFLSVMAYDRYLAICRPLHYPSIMTGKLCVILVCVCWVSGFLCYPIPIVLISQLPFCGPNIIDHFVCDPGPLFALACIPAPSTELICYTFNSVIIFGPFLSILGSYTLVLRAVLRIPSGAGQTKAFSTCGSHLMVVSLFYGTLMVMYVSPTSGNPAGMQKIVTLVYSAVTPLLNPLIYSLRNKDMKDALKKLLGLRSNPN

SEQ ID NO: 56 - protein, 321 aa, Felis catus
MEEGGPNHGQSNHTNVKEFVFLELTHFQELECFLFVAFLAVYVTTVLGNALIVLTITYESHLHTPMYFLLRNKSVLDIVFSSVTVPKFLVDLLSERKTISYNGCMAQIFFFHFAGGADIFFLSVMAYDRYLAIAKPLHYVTIMKREVWVGLVVASWVGGGLHSIVQIILMLPLSFCGPNILDAFYCDVPQVVKLACTDTFALELLMISNNGLVTLLWFLLLLGSYTVILVMLRSHSGAGRNKALSTCTSHILVVTLHFVPCVYIYCRPFTTLPMDTAVSINNTVITPMLNPMIYTLRNQEMKSAMKRLHRRLGPSESSKLG

SEQ ID NO: 57 - protein, 312 aa, Felis catus
MDALNQTRVTEFVFLGLTDKWVLEILFFLAFSVTYVLTLLGNTLIIVTIVFTPRLHTPMYFFLSNLSFIDICHSSVTVPKMLEGLLLEIKTISFDNCIAQLFFLHLFACAEIFLLTIMAYDRYVAICAPLHYSNVMNMRVCVQLVFALWLGATVHSLVQTFLTIRLPYCGPNIIDSYFCDVPPVIKLACTDTYLTGMLIVSNSGTISLTCFLALVTSYTVILVSLRKQSAEGRRKALSTCSAHFMVVAFFFGPCIFIYTRPDTSFSIDKVVSVFYTVVTPLLNPLIYTLRNEEVKSAMKHLRQRGFFMKSGT

SEQ ID NO: 58 - protein, 312 aa, Felis catus
MAEANNSFSEGCILMGISDHPQLEIVFFIVILFSYSLTLVGNSTTILLSCLDARLHTPMYFFLSNLSSLDLAFTTSSVPQMLTNLWGPDKTISYAGCVIQLYVFLWLGATECILLVVMAFDRHVAVCQPLRYTVIVSPRLCRLLAAIAWLGGLSNSMIQSTFTLQLPLCGHRRVDNFLCEVPAMIKLACGDTSLNEAVLNGVCTFFTAVPLSIILISYCSIARAVLKIRSAEGQRKAFNTCLSHLVVVLLFYGSAIYGYLLPAKTSHQGQGKFISLFYSVVTPMVNPLIYTLRNKEVKAALRRLRGKGREFG

SEQ ID NO: 59 - protein, 318 aa, Felis catus
MRSMSTAKAWNSSSVTMFIFLGFADHPELQTLLFVTFLGIYLVTLAWNLALIFLIRGDPRLHTPMYFFLSNLSFIDICYSSTVAPKMLTDFFWEQKTISFLGCAAQFFFFVSMGLTECFLLTAMAYDRYAAISNPLLYTAIMSQGLCTRMVLGAYVGGFLSSLIQASSIFQLHFCGPNIINHFFCDLPPVLALSCSDTFPSQVVNFLVVVTIGGTSFLILIISYSYIGTAVLKIRSVEGRKKAFSTCASHLMVVTLLFGTALFMYLRPSSSYSLGRDKVVSVFYSLVIPMLNPLIYSLRNREIKDALWKVLEKKKLFS

SEQ ID NO: 60 - protein, 314 aa, Felis catus
MPLMRMAAENSSVTEFILAGLTNQPGLRMPLFFLFLGFYVVTVMGNLGLITLIGLNSHLHTPMYFFLFNLSFIDFCYSTVITPKMLMSFVSKNTIAYAGCMTQLFFFLFFVVSESFILSAMAYDRYTAICNPLVYTATMSPQVCSLLLLGVYVMGFAGAMAHTTCMVRLTFCANNLVDHYMCDILPLLERSCTSTYVNELVVFVVVGIDIGVPTVTIFISYALILTSILHIRSTEGRSKAFSTCSSHIIAVSLFFGSGAFMYLKPSSLLPMNQGKVSSLFYTTVVPMLNPLIYSLRNKDVKVALKKSLSKKTFS

SEQ ID NO: 61 - DNA, 531 bp, Canis familiaris
aatctcacagcagtatctgtcttcctcctttggggcttctcggctgtgcccaagttacagctgcttgactcggccaccttccttctcatttatctggctgcgattttgggaaacattgctatcctggctgccgtgagacacaacacctgcctgcacacacccatgtacttcttcctcaaacatctgtccttggtggatgtctgctccgtgtccaccaccctgccccaggccccagtggtgaccgtgctgggctccgagatttccctccatgcatgtgcattccagctctttgcttttgtctgctttgggtccacagagtgttttctcatcacttgcatggctttcaatcgttgtctggccatctacagggccctggtgtacagggaagccatgagcctggggacctgcatttctctggtgtcagtggcctggggcagtgggctcattttctctgccttccacacagccaacaccttcttcctgcccttctgtggccccagtgtgattgaccacttcttctgcgacattcct

SEQ ID NO: 62 - protein, 177 aa, Canis familiaris
NLTAVSVFLLWGFSAVPKLQLLDSATFLLIYLAAILGNIAILAAVRHNTCLHTPMYFFLKHLSLVDVCSVSTTLPQAPVVTVLGSEISLHACAFQLFAFVCFGSTECFLITCMAFNRCLAIYRALVYREAMSLGTCISLVSVAWGSGLIFSAFHTANTFFLPFCGPSVIDHFFCDIP

SEQ ID NO: 63 - DNA, 990 bp, Canis familiaris
atgccgaccgcctgggcccccccgggcgcccccgaagcccccccctgcgccaaccagagctgcgtccccagtgagctggtcctgctgggcttcgcgcacgtgcccgcgctgcggccgctgctcgccacgctcttcctggccatgttcctgctcacgctgctgggcaacgcgctcatcgtgctgctgaccgccctggacccggccctgcgcgcgcccatgtacctgttcctgcgccacctggccctggtggagatgtgcttctcgctggacatcgtgccgcagctgcttctgaccctgctgcggcccgggcggggcgtgtctcccgccggctgcgccctgcagctgctgctggtgttgtcctgcgtcacgtccgagtgcttcctcctgacgaccatggcctgggaccgctacgtggccatctgcaggcctctgcgttatggcgccatcgtgagcccgcggctctgccacctgctggccgccacgtgctggctggctggcgtccctgtgtctctggtcttcaccatctggctgttccgcttccccttctgcgggccccgaggcatccgccacttcttctgtgacatcgcgcctctgctgagcctggtgtgtgcagacaccagagtcttcgaggccaacgtgttggcggccacggtgctggttatcatggttcccttctgtctgatagccgcgtcctacaccaagattctggccaccgtgctgcggatgccatctgccagggggcgccacaaggccctgtccacgtgcgcctctcacttcgtcgtggtgcttctgttttatggcaccacgggggtcatccacttgcgacccaagggcagctactccccggagagcaagcaggtggtgtccttgtcctacaccctggtaacccccatgctcaaccccctcatctacagccttcgaaacaaggaggtgagggctgccctgggacgcgtgtgttgccatggccaggaatctggaccccatgaatga

SEQ ID NO: 64 - protein, 329 aa, Canis familiaris
MPTAWAPPGAPEAPPCANQSCVPSELVLLGFAHVPALRPLLATLFLAMFLLTLLGNALIVLLTALDPALRAPMYLFLRHLALVEMCFSLDIVPQLLLTLLRPGRGVSPAGCALQLLLVLSCVTSECFLLTTMAWDRYVAICRPLRYGAIVSPRLCHLLAATCWLAGVPVSLVFTIWLFRFPFCGPRGIRHFFCDIAPLLSLVCADTRVFEANVLAATVLVIMVPFCLIAASYTKILATVLRMPSARGRHKALSTCASHFVVVLLFYGTTGVIHLRPKGSYSPESKQVVSLSYTLVTPMLNPLIYSLRNKEVRAALGRVCCHGQESGPHE

SEQ ID NO: 65 - DNA, 675 bp, Canis familiaris
ggggcttggactggaccctgccatgtacccttcacagcctgcatgacccagctattcttctttatagtcctcatctgcacggagtgcaccctcctggcctccatggcctatgaccgctacgtggccatctgccgccctctccactacccactgctcatgaggccccaggtctgcctgggcttggccttgtcttcatggattggggggctgctggtctcagtggtcaagacatcttgcattgccagcctgtcctactgtggccccaatgtcctcaaccaatttttctgtgatgtctcccctctgctcaacctgtcttgcacccacgtggccctgacggagctggtggacttcatctctgccatcgtcatcttctgtggaacactgttggcagcattagcctcctactcagccatcgtggtggctgtgctcctcatgccatcagccgctgcccgacgcaaggccttttccacctgtgcctcccacctgattgtggtgggcatcttctactcagcagccctcttcatctactgccgtcccagccgtatcaaatccatggacctcaacaaggtgctgtcagtcatctacacggtagtcacgcccatgtgcaaccccatcatctactgcctgaggaacaaagaggtccatgtggtgcttcggaaaactctccactggcct

SEQ ID NO: 66 - protein, 225 aa, Canis familiaris
GAWTGPCHVPFTACMTQLFFFIVLICTECTLLASMAYDRYVAICRPLHYPLLMRPQVCLGLALSSWIGGLLVSVVKTSCIASLSYCGPNVLNQFFCDVSPLLNLSCTHVALTELVDFISAIVIFCGTLLAALASYSAIVVAVLLMPSAAARRKAFSTCASHLIVVGIFYSAALFIYCRPSRIKSMDLNKVLSVIYTVVTPMCNPIIYCLRNKEVHVVLRKTLHWP

SEQ ID NO: 67 - DNA, 945 bp, Canis familiaris
atggagaggtccctggagttgggcaacatgaccagagtccaggagtttgtcttgctgggtttgtccaccaggcctggcataaggaatgtcctgtttgctgtcttcctgaccctctacctgctgaccctcctggaaaacaccctcatcatctacctcatctgcagtcacagtgagctccacaagcccatgtacttcttcttgggtaacctgagctgcctagagatgtgctatgtgtcagtgaccatgcccagcctgctcctggggctttggactggaccctgccatgtacccttcacagcctgcatgacccagctcttcttcttcatctctctcatctgcatggagtgcactctcttggcctccatggcttatgatcgctatgtggccatctgccacccactccactacccactgcttatgaggccccaggtctgcctgggcttggctttgtcctcatggcttggggggctgctggtctcagtggtaaagacatcttgcattgccagcctgtcctactgtggccccaatgtcctcaaccacttcttctgtgacgtctcccctctgcttaacctgtcttgcacccacgtggctctgacagagctggtggacttcatctctgccatcatcattctctggggttctctccttgtggctatagcgtcctatgtagccatcgggagggctgtgctctgcatgtcatcagctgttgcccgtcgcaaagctctctccacctgtgcctcacacctggtggtggtcggcatcttctatgcagccactctcttcatctacgcccgtcccagccgcatagaagccatggacctcaacaaggtgctgtcagtcatctatacagtggtcacgcccatgtgcaaccccatcatctactgcctgcgtaacagggaggtccaggcagcattccacagaaccctacactggtcccgaagctga

SEQ ID NO: 68 - protein, 314 aa, Canis familiaris
MERSLELGNMTRVQEFVLLGLSTRPGIRNVLFAVFLTLYLLTLLENTLIIYLICSHSELHKPMYFFLGNLSCLEMCYVSVTMPSLLLGLWTGPCHVPFTACMTQLFFFISLICMECTLLASMAYDRYVAICHPLHYPLLMRPQVCLGLALSSWLGGLLVSVVKTSCIASLSYCGPNVLNHFFCDVSPLLNLSCTHVALTELVDFISAIIILWGSLLVAIASYVAIGRAVLCMSSAVARRKALSTCASHLVVVGIFYAATLFIYARPSRIEAMDLNKVLSVIYTVVTPMCNPIIYCLRNREVQAAFHRTLHWSRS

SEQ ID NO: 69 - DNA, 975 bp, Canis familiaris
atggagaggtccctggagttgggcaacatgaccagagtccaggagtttgtcttgctgggtttgtccaccaggcctggcataaggaatgtcctgtttgctgtcttcctgaccctctacctgctgaccctcctggaaaacaccctcatcatctacctcatctgcagtcacagcgagctccacaagcccatgtacttcttcttgggtaacctgagctgcctagagatgtgctatgtgtcagtgaccatgcccagcctgctcctggggctttggactggaccctgccatgtacccttcacagcctgcataattcagctttttttattcatagctttcattagtaccaagtgcaccctcctggcctccatggcttatgatcgctatgtggccatctgccacccactccactacccactgcttatgaggccccaggtctgcctgggcttggctttgtcctcatggcttggggggctgctggtctcagtggtaaagacatcttgcattgccagcctgtcctactgtggccccaatgtcctcaaccacttcttctgtgacgtctcccctctgctcaacctgtcttgcacccatgtggccctgacggagctggtggacttcatctctgccatcattatcttctgtgggtcattactagttgctttggcctcctatgtagccattgggaacactgtgctccacatgccatcggcagccacccgtcgcaaagccctctccacctgtgcctcacacctgttggtggtgggcatgttctacgcagtggtcctcttcatatattcccaccccagacacatcaattctacagggctcagcaaggtgctgtcagtcatctatacgatggtcacacccatgtgcagccctatcatctactgcctgcggaacagagaggtccacgtcgcgctgcagaaaactctccacttgtgctgggtctcttcagttagaactgaccttgcccactcttga

SEQ ID NO: 70 - protein, 324 aa, Canis familiaris
MERSLELGNMTRVQEFVLLGLSTRPGIRNVLFAVFLTLYLLTLLENTLIIYLICSHSELHKPMYFFLGNLSCLEMCYVSVTMPSLLLGLWTGPCHVPFTACIIQLFLFIAFISTKCTLLASMAYDRYVAICHPLHYPLLMRPQVCLGLALSSWLGGLLVSVVKTSCIASLSYCGPNVLNHFFCDVSPLLNLSCTHVALTELVDFISAIIIFCGSLLVALASYVAIGNTVLHMPSAATRRKALSTCASHLLVVGMFYAVVLFIYSHPRHINSTGLSKVLSVIYTMVTPMCSPIIYCLRNREVHVALQKTLHLCWVSSVRTDLAHS

SEQ ID NO: 71 - DNA, 939 bp, Canis familiaris
atggagagttctctggagttgggcaacatgaccagagtccaggagtttgtcttgctgggtttgtccaccaggccgggcataaggaatgccctgtttgctgtcttcctgaccctctacctgctgaccctcctggaaaacaccctcatcatctacctcatctgcagtcacagcgagctccacaagcccatgtacttcttcttgggtaacctgagctgcctagagatgtgctatgtgtcagtgaccatgcccagtctgctcctggggctttggactggaccctgccatgtacccttcacagcctgcatgacccagctattcttctttatagtcctcatctgcacggagtgcaccctcctggcctccatggcctatgaccgctacgtggccatctgccgccctctccactacccactgctcatgaggccccaggtctgcctgggcttggccttgtcttcatggattggggggctgctggtctcagtggtcaagacatcttgcattgccagcctgtcctactgtggccccaatgtcctcaaccaatttttctgtgatgtctcccctctgctcaacctgtcttgcacccacgtggccctgacggagctggtggacttcatctctgccatcgtcatcttctgtggaacactgttggcagcattagcctcctactcagccatcgtggtggctgtgctcctcatgccatcagccgctgcccgacgcaaggccttttccacctgtgcctcccacctgattgtggtgggcatcttctactcagcagccctcttcatctactgccgtcccagccgtatcaaatccatggacctcaacaaggtgctgtcagtcatctacacggtagtcacgcccatgtgcaaccccatcatctactgcctgaggaacaaagaggtccatgtggtgcttcggaaaactctccactggccttga

SEQ ID NO: 72 - protein, 312 aa, Canis familiaris
MESSLELGNMTRVQEFVLLGLSTRPGIRNALFAVFLTLYLLTLLENTLIIYLICSHSELHKPMYFFLGNLSCLEMCYVSVTMPSLLLGLWTGPCHVPFTACMTQLFFFIVLICTECTLLASMAYDRYVAICRPLHYPLLMRPQVCLGLALSSWIGGLLVSVVKTSCIASLSYCGPNVLNQFFCDVSPLLNLSCTHVALTELVDFISAIVIFCGTLLAALASYSAIVVAVLLMPSAAARRKAFSTCASHLIVVGIFYSAALFIYCRPSRIKSMDLNKVLSVIYTVVTPMCNPIIYCLRNKEVHVVLRKTLHWP

SEQ ID NO: 73 - DNA, 492 bp, Canis familiaris
ggcgtccctgtgtctctggtcttcaccatctggctgttccgcttccccttctgcgggccccgaggcatccgccacttcttctgtgacatcgcgcctctgctgagcctggtgtgtgcagacaccagagtcttcgaggccaacgtgttggcggccacggtgctggttatcatggttcccttctgtctgatagccgcgtcctacaccaagattctggccaccgtgctgcggatgccatctgccagggggcgccacaaggccctgtccacgtgcgcctctcacttcgtcgtggtgcttctgttttatggcaccacgggggtcatccacttgcgacccaagggcagctactccccggagagcaagcaggtggtgtccttgtcctacaccctggtaacccccatgctcaaccccctcatctacagccttcgaaacaaggaggtgagggctgccctgggacgcgtgtgttgccatggccaggaatctggaccccatgaa

SEQ ID NO: 74 - protein, 164 aa, Canis familiaris
GVPVSLVFTIWLFRFPFCGPRGIRHFFCDIAPLLSLVCADTRVFEANVLAATVLVIMVPFCLIAASYTKILATVLRMPSARGRHKALSTCASHFVVVLLFYGTTGVIHLRPKGSYSPESKQVVSLSYTLVTPMLNPLIYSLRNKEVRAALGRVCCHGQESGPHE

SEQ ID NO: 75 - DNA, 879 bp, Canis familiaris
atgggcagccaaaacagcacagaggaggtctacttcattctgcttgggctctcccagtacccatgggctcaaaccatcttcctctgcctgatcttcctgtcctatatcatcaatcttttcgggaacagcctcatcctgctcctgatctgctatgattgatccccggctccacacgcccatgtacttcttcctcttcaacttcttcctcttccatgtacttccttcctggacgtgtgctacaccatatccagcatgccccagatcctcatcaaatgcctggtgaccattcacatcatctcgctaggttgatgcttggcccggatggctgtgggactttatctgggtgtagtggagtgtctcctgatggccaccgtggcctatgatcactgtgtggccattgttgaccccctgtgctattccaggcatatggggccctggctttgcagtctgttggctgggacctcatggtctgtggtgttcctgctgaccacggtccctgtgctgaccatgcccttggagttctgtgttcaccaggtcatcaatcacttatcgtgcgagctcctggccctgctcaagcttgcctgctctcacctgcagttctatgagtcactcatggtgggcaccagtgccctgaccctgctggctccttttgccttcatcgtggcctcctacagaaggatcttagtgtctgtgctgcggctgcggtctgcagggggccatgccaaggccttttccacatgtgggtctcacctcacagtggtggccctcttctatggcacggccatcttcatgtatatgatgcctcaggacaagatcatccatgactgagataagataatctccatgtcctatggcgtcctcaccccccatgatgaacca

SEQ ID NO: 76 - protein, 65 aa, Canis familiaris
WFIMGGEDAIGHGDYLISVMDDLVLRHHIHEDGRAIEEGHHCEVRPTCGKGLGMAPCRPQPQHRH

SEQ ID NO: 77 - DNA, 699 bp, Canis familiaris
accgtcatcatgcccaagatgttgctcagcattgccacagggaccaagaccattagttttgctggttgcatcacttaggactttttccacgtcttcctggaggctacagagttcctcctcctcacacccaaggcctgtgaccactacattgccatctgccagcctctctgctacctcagtgtcatgagcaacagagtctgcacacggctcatcctcacctgctggctggcaggattctccttcatcatcgtgcctgtcatcctgaccagtcatcttccattatgcaacacccacatcaaccacttcttctgtaactatatgcctctaatggaagtagtgtgtagcaggccacaagtgttagaggtggtggcttttaccctggccattgaggcgctggtcagcactgtattgctgatcaccatatcttatgtccagatcatccagaccattgtaaggatcccctctgtccaggagagaaggaaagctttctctacctcttcttcccatatcattgtgatcaccaggtgctatgacagctgcttcttcatgtatgtcaagccctctctaggcaagggggttgatttcaacaaaggagtgtctgtaatcaatacaattattgcccccctcttgaatcccttcatctatactctcaggaaccaacaagttaaggaagtagtgaaaaacctgatcaggaaaatg

SEQ ID NO: 78 - protein, 172 aa, Canis familiaris
MSNRVCTRLILTCWLAGFSFIIVPVILTSHLPLCNTHINHFFCNYMPLMEVVCSRPQVLEVVAFTLAIEALVSTVLLITISYVQIIQTIVRIPSVQERRKAFSTSSSHIIVITRCYDSCFFMYVKPSLGKGVDFNKGVSVINTIIAPLLNPFIYTLRNQQVKEVVKNLIRKM

SEQ ID NO: 79 - DNA, 648 bp, Canis familiaris
atctccttccagagctgtgtggcccagatgtacgtcttcatggtcctgggcatctcagagtgctgcctcctcacagccatggcctatgaccactatgcagccatctgtcagcccctgcactatgccaccctcatgagctggagggcctgcacggctatggtgggtgtctcctggctcatgggcatcgtcacagccaccacccattccactctcatcttcactctgcccttccccagccaccccatcatcctgcacttcctctgtgacatcctgccagtactgaggctggcaagtgctgggaaacacgagagtgaaatctccgtgatgacagccaccgtggtcttcatcatggtccccttctctctgatcattgcctcttatgcctgcattctgagtgccaacctggcaatggcctccacccagagccgtcacaaggtcttctctacttgctcctcccacctgcttgtggtcttcctcttctttggaacagccagcatcacctacatccagccccggactggctcctctgttaccatgaaccgcatcctcagcctcttctacacagtcatcacacccatgctcaaccccatcatctacacccttcgcaacaaggaggtggcaagggccctgcagcgcatggtgaagagg

SEQ ID NO: 80 - protein, 216 aa, Canis familiaris
ISFQSCVAQMYVFMVLGISECCLLTAMAYDHYAAICQPLHYATLMSWRACTAMVGVSWLMGIVTATTHSTLIFTLPFPSHPIILHFLCDILPVLRLASAGKHESEISVMTATVVFIMVPFSLIIASYACILSANLAMASTQSRHKVFSTCSSHLLVVFLFFGTASITYIQPRTGSSVTMNRILSLFYTVITPMLNPIIYTLRNKEVARALQRMVKR

SEQ ID NO: 81 - DNA, 666 bp, Canis familiaris
ttctcacagacaccacctatcgaggcaggggtatttgtactatttattttcttctatgtgcccacttgggtaggcaatgtcctcatcttggtcacagtagcctctgataactatctgaattcatcacccatgtatttccttcttggcaacccctctttcctggacttacgttattcaactatccctaagcttctggctgactttcttgataatgagaagctcattcgctatggccaatgcattgtgcagctcttctttctgcattttgtaggagcagttgagatgttcctgcttacagtgatggcctatgatctttatgttgcaatttgttgccctctgcactataccactattatgagtcaaggattacgctgtatgttggtagctgcttcctggatgggagtgtttgtgtaatctactgtccagaggatccttgctatacgtttgccttttttgtggaccaaaccaggtggacaacttcttttgtgatgttcccccatcatcaaacttgcctgtgtggacacattattattgattattgaattactaatggcatctaacagtgggttaatctctaccagttcctttattatactgttttcttcctattccactatcctggtcaagattcgctccaaggagggaaggcgaaaggcactcgccacc

SEQ ID NO: 82 - protein, 137 aa, Canis familiaris
FSQTPPIEAGVFVLFIFFYVPTWVGNVLILVTVASDNYLNSSPMYFLLGNPSFLDLRYSTIPKLLADFLDNEKLIRYGQCIVQLFFLHFVGAVEMFLLTVMAYDLYVAICCPLHYTTIMSQGLRCMLVAASWMGVFV

SEQ ID NO: 83 - DNA, 810 bp, Canis familiaris
atgtatgaatcaaattattctgatgtgttttggtttatatccttggcactttctacctatagaccagcactgaattttctccttgccttttctccagtgttttatgtaacagttatcctgggaaacctccttgttgtgtttagagtgatgtttacccttacttacattccactatgtacttccttttagcaaatctctcattcattgacttgtgtctttccaccttaatgattcctaagaagattcatgacctgcactcagggcacaaaaccatatccttccagggatgtgtcatccatttatttgtatttcatgtcctgggtggatctgagatggtgctgctcattgccatggtcttggatcgcctatgtggccatatgtaagcctctccactatctgactatcatgagtccgcagatgtgaattttgcttctgtctggtgcttgggctgttggcctcattcattcagtggcccagttagctttcgttgtccacttgactttttgtggtcctaatgtgatagacagcttttgctttgaacttccttggttcatcaaatgtgcctgcgcagacccttacaggatggaattcatggtgactgccaacagcaggttcatttccatgggcgccttcttctcattgcttatctcctaagttttcatcctggtcactctctggaaacgttcctcaggtggtttgtctaaggccttttctactctgtcagcgcacattaaagaagctgtgatctatgtatacaatgaaatattactcagccatcagaaatggcgaatacccaccatctgtctggac

SEQ ID NO: 84 - protein, 62 aa, Canis familiaris
MYESNYSDVFWFISLALSTYRPALNFLLAFSPVFYVTVILGNLLVVFRVMFTLTYIPLCTSF

SEQ ID NO: 85 - DNA, 933 bp, Canis familiaris
atgaagttgcagaattattccttggtgtcagaatttgtgttgtatggactctgcacgtcacgacatctccagcatttattcttcatatttttctctgggatctatgtggccagtgtgctgggtaacctcatcattgtggtcaccataatttctgactcacacttgcactcctctcctatgtacttcctgctaggaaacctatctttcttagacatatggctcgcctcctttgccacccccaagatgctcagggactttcttagtgaccgaaagcttatctcctttggaggatgtatggctcaaatcttcttcttgcactttattggtggggctgagatggtacttctggtttccatggcctatgacagatatgtggctatatgtaaacctctgcattatatgactgtgatgagacggcagacctgcgtggggctggtgttggtctcatgggtcattggctttgtgcattccatcagtcaagtagcctttactgtgaatttaccgtactgtggccccaatgaggtggacagcttcttttgtgacctgcctcttgtaatcaagcttgcctgcatggacacctacatcttaggtatccttatgatctcagatagtggattactctccatgagctgctttctgctcctcttggtctcttacactgtcatcctcatcactgtccgacagcgcactgctggtggcgtatccaaagcactctccacttgctctgcacacatcatggttgtcacactcttctttgggccctgcattttcatttatgtgtggcctttcagccggttctctgtggacaagctcctgtctgtgttttacaccatttttactccactcttgaacccccttatctacacactgagaaataaagagatgaaaatagctatgaagaaactgtgtaaccaccatgtgacttctcgttga

SEQ ID NO: 86 - protein, 310 aa, Canis familiaris
MKLQNYSLVSEFVLYGLCTSRHLQHLFFIFFSGIYVASVLGNLIIVVTIISDSHLHSSPMYFLLGNLSFLDIWLASFATPKMLRDFLSDRKLISFGGCMAQIFFLHFIGGAEMVLLVSMAYDRYVAICKPLHYMTVMRRQTCVGLVLVSWVIGFVHSISQVAFTVNLPYCGPNEVDSFFCDLPLVIKLACMDTYILGILMISDSGLLSMSCFLLLLVSYTVILITVRQRTAGGVSKALSTCSAHIMVVTLFFGPCIFIYVWPFSRFSVDKLLSVFYTIFTPLLNPLIYTLRNKEMKIAMKKLCNHHVTSR

SEQ ID NO: 87 - DNA, 909 bp, Canis familiaris
atgagaaaccattcaacagaaatagagtttattctcataagactgacggatgacccacaattgcaagttgtgatttttgtgtttttatttcttaattacacattgagcctgatggggaacttaaccattatcctactcactctgctggatcctcacctcaagatgccaatgtatttctttctctgtaatttctcatttttagaaatcatattcacaacggtatgtattcccagatacttgaaaaccatagtgactaaagaacaaaacgtttcatataataactgtgtggctcaattattttttattcttttactgggagttgcagagttttaccttctggctgctatgtcctatgaccgctatgtggccatctgtaaacccttgcattacccaatcattatgaacagcagagtgtgctattggcttgtactttcttcttggctgactggattcctaatcatctttccaccattgctcatgggactcaagctggatttctgtgcttccaaaacgattgatcactttatgtttcccccatcctgcagatatcctgcacagacacacacacaattttatgtcctagaattgatgtctttcatcttcgctgtggtgacacttgtggtcacattggtgttagtggatctctcctacacttgcatcatgaagaccattatgaaattcccttctgcacagcaaaggaccaaagctttttccacctgtacttcccatatgattgttgtctccatgacatatgggagctacatctttatgtatattaagccatctgccaaagaaagggtgactgtatccaaagatgtagctttgctgtatacctcaattgcccctttactaaatcccttcatttatatcctaaggaaccagcaggtgaacgaaatcttttgctcctaa

SEQ ID NO: 88 - protein, 302 aa, Canis familiaris
MRNHSTEIEFILIRLTDDPQLQVVIFVFLFLNYTLSLMGNLTIILLTLLDPHLKMPMYFFLCNFSFLEIIFTTVCIPRYLKTIVTKEQNVSYNNCVAQLFFILLLGVAEFYLLAAMSYDRYVAICKPLHYPIIMNSRVCYWLVLSSWLTGFLIIFPPLLMGLKLDFCASKTIDHFMFPPSCRYPAQTHTQFYVLELMSFIFAVVTLVVTLVLVDLSYTCIMKTIMKFPSAQQRTKAFSTCTSHMIVVSMTYGSYIFMYIKPSAKERVTVSKDVALLYTSIAPLLNPFIYILRNQQVNEIFCS

SEQ ID NO: 89 - DNA, 645 bp, Canis familiaris
caattgttttttaccttccttcttggtgcatctgaactttgtttgctggcagctatgtcctatgaccactatgttgccatttgtaagcacctgcattacacaaccatcatgagcagtaagatctgcacacaagttgtcttctgttgtcggtttgctgggtcttttgtcatctttccacctctcctcttagacttaaatcttggcttctatgccttcaacattgttgatcatttctactgtgccacaacccccctgctgcagatctcctgcttagacacacagctcttagagacaatgggatacatctctgctttggtgacactcacagtcacattggtaatggtgataatatcatatacctacattgtattaagaattctaaaaatcttttcagtcaatcagaggaaaaaggctttttcaacatgttcttctcacatgactgtgatatccctttcttatggcagctgcatcttcatgtatgttaagccatcagccaaacaaagaacatcttattccaagggaattgcagtgctcaacacgtctgttgctctacttttgaatcctttcatctacactttgtggaacaagcaagtaaaaacagccttcatgaacatggtacacaaaattgtttctttctcgaacaaa

SEQ ID NO: 90 - protein, 215 aa, Canis familiaris
QLFFTFLLGASELCLLAAMSYDHYVAICKHLHYTTIMSSKICTQVVFCCRFAGSFVIFPPLLLDLNLGFYAFNIVDHFYCATTPLLQISCLDTQLLETMGYISALVTLTVTLVMVIISYTYIVLRILKIFSVNQRKKAFSTCSSHMTVISLSYGSCIFMYVKPSAKQRTSYSKGIAVLNTSVALLLNPFIYTLWNKQVKTAFMNMVHKIVSFSNK

SEQ ID NO: 91 - DNA, 891 bp, Canis familiaris
gaaaactgtacaactgtgacagtatttatcttagcaggattgatggaggacccaaaactgaagattgtgctatttgtcttcctgctcctcacctgcttgctaagaatctcaggcaacttagttattattaccctcactttgctggactcacatctcaagacccctatgtatttctttctttgaaatttttctttcttagaaatttcttatacgacagtctgcatccccaaattgcttgtaagcatggcaactgatgacaaaaccatttcctataactgttgtgcaactcagttgtttgccttccttcttggagcatctgaatgttacctcctggctgtcatgtcctacgatcattatgtcaccatctgcaagcccctgcattacacaaccattatgagcagcaaaatctgtatccagctagtccttagctcttggatcactggtttcctcatcatctttcccaggactcattttaggcttaagcctggacttctgtgattccaatgtcattgatcatttctactgtgacactgctcccctcctgcagatctcctgcatggacagacatgtgttggaaatgatgagtttcatcttagctttggtgactctgctggtcactttggcattagtaattctatcatacacatatattgccctgacaattttaaaatttccttctgccaaccagagaaaaaagctttctccacctgttcttctcacatgattgtcatctccctctcatatggcagctgcatctttatgtaccttaaaccctcagtcaaacagaggatatccttgaagaagggagtggcagttctcaatacttctgttgctccacttttgaatccctttatttatactctaaggaaacagcaggtgaagcaagcattt

SEQ ID NO: 92 - protein, 83 aa, Canis familiaris
KLYNCDSIYLSRIDGGPKTEDCAICLPAPHLLAKNLRQLSYYYPHFAGLTSQDPYVFLSLKFFFLRNFLYDSLHPQIACKHGN

SEQ ID NO: 93 - DNA, 780 bp, Canis familiaris
atgatgggaaaccagacatcagtgatagaattcattcttcttggactgacgaatgacactgagcttcaagctgtgcttttcctttttctgctgctaacttatgtcttaagcatcatgggaaacttgaccatcatcattctggcccttttggattatcgccttcagactcctatgtatttctttttccggaatttttctgttttggaagtatcttttacttctgtctttgttcccaaaatgctagtcaatattgcaactggagacaagactatctccttcgctggttgtttcactcagaatttttttgccatccttctggggcaactgaattttatcttttagctgccatgtcctatgattgctatgttgccatttgtaaacccttgcattatacaactgtaatgagcaggaaactgcattcagcttgttctgtgttcctggttctctggttttttggttgtcattgtgccacatacaatgactctccaactgcctttctgtgtctccaatgtcatcaatcattgatgctgtgactatcccatactgctgcatctgtcctgttcagacacacagttcatagaagtgatggaatttatctttgctacagttaccctcatcttcaccttggtgctagtgattctttcctacacgtacataatcaggacaattctgagaatcccttctgttcaacaaagaaaaaaaagccttttctacatgctcctgtcacatgattgtggtctcactttcatatggaagttgtatctttatgtacataaatcc

SEQ ID NO: 94 - protein, 113 aa, Canis familiaris
MMGNQTSVIEFILLGLTNDTELQAVLFLFLLLTYVLSIMGNLTIIILALLDYRLQTPMYFFFRNFSVLEVSFTSVFVPKMLVNIATGDKTISFAGCFTQNFFAILLGQLNFIF

SEQ ID NO: 95 - DNA, 507 bp, Canis familiaris
tcctattttagtggctacatcagctcggttcttcagacgagtatgacatttactttgtccttttgtgcttcccgagccatcgaccacttttactgtgatgaccgtccacttcaaaggattacttgctctgatctctactttcataggatagtttcctttcccttatgcagcattattattttacctaccatcattgtcattctcatgtcctatatgtatattgtgtccacagttctaaagataagatccactgagggatgtaagaaagccttctccacttgcagctctcacctaggagtcgtgagcatcctgtacggtgccatcatttttatgtatttcatccctgacagattccctgaactaagtaaagtggctccttatgttatacgttagtcactctcatgttgaatcctttgatttactccctgagaaacaaagatgtcaaagaggctctgagaaagatcctggggaaaaatatttttatttaattctatattaacagtgata

SEQ ID NO: 96 - protein, 130 aa, Canis familiaris
SYFSGYISSVLQTSMTFTLSFCASRAIDHFYCDDRPLQRITCSDLYFHRIVSFPLCSIIILPTIIVILMSYMYIVSTVLKIRSTEGCKKAFSTCSSHLGVVSILYGAIIFMYFIPDRFPELSKVAPYVIR

SEQ ID NO: 97 - DNA, 255 bp, Canis familiaris
ctgatggatgacccaaagtggcaggtcgtacttttcatatttcttcttgttacctacatgttcagtgtgactgggaacctggtcattatcatcctcacactaacagatccccacctgaagactctaatgtatttcttccttcgaaacttctcattcctagaaatgtcattcacatctgttgcaattcccagattccttgtcactgttgtgacgggagacaaaaccatttcctacaatgactgtctgggaaacata

SEQ ID NO: 98 - protein, 85 aa, Canis familiaris
LMDDPKWQVVLFIFLLVTYMFSVTGNLVIIILTLTDPHLKTLMYFFLRNFSFLEMSFTSVAIPRFLVTVVTGDKTISYNDCLGNI

SEQ ID NO: 99 - DNA, 873 bp, Canis familiaris
atgttagcgatgaaaaaccaaacccttctgacagaattcattctgctgggactaacagaaatcccagagatccaacttgtagtctttctatttctcttcctcacctacatattcagcatcattggaaacctcacaatcatcacacttacactactggactcacacctccagactcccatgtatttcttcctccggaatttctccttcctagaaatttcctttacaaccacctttactcctaggctgctgttcagcatcacaactggcaacaagagcattagctttgctggctgcttcactcagtatttctttgccaccttctttggagccacagagttttaccttctggctgccatgtcctatgaccgctatgtggctatatgcaaacccctgcattacatgaccattatgagcaacagtctgcattcagctggttctctgctcttggttggctggatttctaatcatcatatccccaatcatcctgaccagtcagctggatttctgtgcctccaacatactgaatcattattattgtgactacggacccctgctagaaatatcttgctcagacacaagactcttagaactggttgactttatcttagcagctgtgaccttggtggtcaccctggtgctggtggttctctcctacacaaacatcatctggaccatcctcaagatcccctcgctcagcaaaggaaaaaggccttttccacatgttcttcccacatgattgtcattgccctctcttatggcagttgcatcttcatgtatataaaaccctcagccaaagaaggagttgccttcaataagggggtagctgtgctcaatacctcattgcccctttattgaacccattcatttacactt

SEQ ID NO: 100 - protein, 179 aa, Canis familiaris
MLAMKNQTLLTEFILLGLTEIPEIQLVVFLFLFLTYIFSIIGNLTIITLTLLDSHLQTPMYFFLRNFSFLEISFTTTFTPRLLFSITTGNKSISFAGCFTQYFFATFFGATEFYLLAAMSYDRYVAICKPLHYMTIMSNSLHSAGSLLLVGWISNHHIPNHPDQSAGFLCLQHTESLLL

SEQ ID NO: 101 - DNA, 939 bp, Canis familiaris
atgaaaaactatacagcaataacaacattcatcttggtgggattaacaaatgacccacatctacagattctgctttttatttttctatttctaacctacttgttgagtgttgtagggaatctgaccattatcagcctcacgttggtggattcccaccttaaaacacccatgtattttttcctccggaatttctccatcttggaagtgttctttaccactgtctgcattcctagattcctctacacaatggcatctggggacaataccgttacctacaatgcatgtgccactcaattattttttgttgtcatattgggtgtgactgaatttttcctcctcacagccatgtcctatgaccgctatgtggccatctgcaaacccctgcattacatgactatcatgaacaacagggtctgcatcaagtttcttattggatgttatatgttagctctgctcatcgtcctcccaccctatatcatgggcttcaagctcgagttttgtgactccaatgtcatagatcactttggctgtgacgctgctcccatcctgaagattacctgctcagacacagagtttattgagcgatttgtcttggtcctggctgtgttgacactcattttcaccttggtgtgtgtaattctgtcctacacatacatcatcaggaccattctcagatttccttctgtccagcaaaggaaaaaggctttttctacttgttcttcccatataattgtggtttctattacttatggaagctgcatctttatctatatcaaacctcatgcaaaagaaggggttgctattaataaggtggtgtcagtgcttaccacctcagttgccccagtgatgaatccctttatttatactctgaggaacaagcaagtggtacaagctttcaaagacatgatcaaaagagttgcatctatctcaaagaattaa

SEQ ID NO: 102 - protein, 312 aa, Canis familiaris
MKNYTAITTFILVGLTNDPHLQILLFIFLFLTYLLSVVGNLTIISLTLVDSHLKTPMYFFLRNFSILEVFFTTVCIPRFLYTMASGDNTVTYNACATQLFFVVILGVTEFFLLTAMSYDRYVAICKPLHYMTIMNNRVCIKFLIGCYMLALLIVLPPYIMGFKLEFCDSNVIDHFGCDAAPILKITCSDTEFIERFVLVLAVLTLIFTLVCVILSYTYIIRTILRFPSVQQRKKAFSTCSSHIIVVSITYGSCIFIYIKPHAKEGVAINKVVSVLTTSVAPVMNPFIYTLRNKQVVQAFKDMIKRVASISKN

SEQ ID NO: 103 - DNA, 945 bp, Canis familiaris
atgagaaaccacacagaactaacagactttatcctcctgggattgtcagatgacccacagcttcaggaggtgatctttgtctttctgctcatcacctacattctcagcatcactgggaacctgaccattatcaccctcaccctgctggattcccacctccagacccccatgtatttcttcctcagaaacttctccttactcgagatttcattcacaactgtgagcgtacccaagttcctgggcaccctgattacaggagataaaactgtttcctttaatgattgtatggctcagttattttttgttatttttttcattctgttgggagtcactgaattttacctgctggctgccatgtcctgtgactgatacattgccatcggcaaacctctgcattacatgaccatcatgaatcccagagtctgcatactccttgtctttgcttcttggtcggcttcattcttaatcatattcccatcactcatgctgttcatacagcttgattattgtaagtccaatgctatagaccattttacctgtgactatttccccttactacatctttcttgttcagacactagattcttagagatagtgggtttttcctgtgctgtttttacgttaatgttcacattggtgataataattctgtcctacatatatatcctcagaacaattttgaagattccttctactagtcagaggacaaaggccttttccatctgttcttcccacatgattgtcatctctatctcctatggcagctgcattttcatgtatattaacccagcagcaaaagacagagtgtctctgagcaagggagttgctgtgctaaacacctcggtagcccccatgctgaacccctttatttacagcctaaggaaccagcaagtcaagcaagccttactggacagggcaaggaagattgtatttttctcaagcaaa

SEQ ID NO: 104 - protein, 182 aa, Canis familiaris
MTIMNPRVCILLVFASWSASFLIIFPSLMLFIQLDYCKSNAIDHFTCDYFPLLHLSCSDTRFLEIVGFSCAVFTLMFTLVIIILSYIYILRTILKIPSTSQRTKAFSICSSHMIVISISYGSCIFMYINPAAKDRVSLSKGVAVLNTSVAPMLNPFIYSLRNQQVKQALLDRARKIVFFSSK

SEQ ID NO: 105 - DNA, 681 bp, Canis familiaris
ttctgaaatatctgcatacccttgattaacaatacagttacctataatccttgtgccactcaattattttttgttattgtcttgggtgtgactgaaatttgcctcctcacagccatgtcctatgaccactatgtggccatctgcaaacccctgcattacatgaccatcatgaacaacaggctctgcatcaagttccttattggatgttatatgttagctttgctcatcatcctcctaccctatatcatgagcttcaagctcgagttttgtgactccaatgtcatagatcactatggctgtgatgctgctcccatcctgaagattacctgctcagacacagagtttattgagcgatttgtcttggtcctcgttgtgttgacactcattttcaccttggtgtgtgtaattctgtcctacacatacatcatcaggaccattctcagatttccttctgtcttttgtcctaaaaaaaaaaaaaaggctttttctacttgatattcccatataattgtggtttctattacttatggaagctgcaactttatctatatcaaacctcatgcaaaagaaggggttgctattaataaggtggtgtcagtgcttaccacctcagttgccccagtgatgaatccctttatttatactctgaggaacaagcaagtggtacaagctttcaaagaa

SEQ ID NO: 106 - protein, 23 aa, Canis familiaris
FFESLYHLLVPQSINKGIHHWGN

SEQ ID NO: 107 - DNA, 996 bp, Canis familiaris
atggttagatttcaaaagtcagtgatgagaaactatacagcaataacaacttttatcctgctgggtctgacagacgacccacaactgcaaatcctgctctttatctttatatttctcacctacatcttgagcgtaacaggaaacctgactattatcaccctcacactggtgaactcccatcttaaaactcctatgtacttttttctgagaaatttctccttcttagaagtgtcattcaccactgtctgcattcctagattcctgtatagtatatcaacaggggacaatactattacctacaatgcttgtgcaagtcaaatattttttttgttatgcaagtcaaatattttttttgttattctctttggatcaactgaattttttctcctggccgccatgtcctatgatcgctatgttgctatctgtaaaccacttcattacatgaccatcatgagcaatagggtgtgtagcttattagtcttctgctgttgggtgtctggcttgatgatcattctcccaccccctagcttgtgcctccagctggaattttgtgactccaatgccattgatcattttagctgtgatgcagctcccctcctgaagatctcatgttcagatacatggatgatagaacaaatggttatccttgtggctgtatttgcactcattatcaccttagtgtgtgtatttctgtcctacacatacatcatcaggaccattctgagattcccctctgtccaacaaagaaaaaaggccttttccacctgctcatcccacatgattgtagtttccatcacctatggaagcggcatcttcatctatatcaagccatcagcaaaagaagggatagccataaataaaggtgtttcggtgctcactacttctgttgcacccttgctgaaccccttcttttacaccttaagaaataagcaagtgaaacaagcttttaatgacttcataaagaagatgacatttcactcaaagaaactgaagttt

SEQ ID NO: 108 - protein, 332 aa, Canis familiaris
MVRFQKSVMRNYTAITTFILLGLTDDPQLQILLFIFIFLTYILSVTGNLTIITLTLVNSHLKTPMYFFLRNFSFLEVSFTTVCIPRFLYSISTGDNTITYNACASQIFFLLCKSNIFFVILFGSTEFFLLAAMSYDRYVAICKPLHYMTIMSNRVCSLLVFCCWVSGLMIILPPPSLCLQLEFCDSNAIDHFSCDAAPLLKISCSDTWMIEQMVILVAVFALIITLVCVFLSYTYIIRTILRFPSVQQRKKAFSTCSSHMIVVSITYGSGIFIYIKPSAKEGIAINKGVSVLTTSVAPLLNPFFYTLRNKQVKQAFNDFIKKMTFHSKKLKF

SEQ ID NO: 109 - DNA, 933 bp, Canis familiaris
atgagaaatcacacagcaataacattcatcttgttgggacttacagaggacccacagctgcaagttcttcttttttatcttcttatttctcagctacgtgctgagcattactggaaatttgaccattatcattcttacatttatggattctcatcttaaaacacctatgtattttttttctccacaatttctccatcttagaaatctcattcacaacagtatgcattcccagattcttgtacagtataacaactggagacaaaactattacgttataatgcttgtgcttgccaaatattttttattgggctttttggggtcacagaattttttctcctggcagccatgtcctatgaccgctatgtggccatctgcaaaccccttcattacatgaccatcatgaataacaaagtctgtaccatccttgtccactgttgctggatttctgtgctgctgatcatcatcacaccccttggtatgggcctccagctggaattctgtgactccaatgccactgatcattttggctgtgatgcatctcctctttttaagatttcatgctcggatacatgggttatagaacagatggttataatctgtgcagtactgacattcattattacactgggtgtcattctttcctatatatatatcatcaggacaattctaagattttcttctgcttctcaaagaaaaaaagctttctccacctgttcttcacacatgcttgttgtttccattacatacggcagctgtattttcatctatatcaagccttctgccaaagaagaggtgaatatcaataaaggggtatccgtgctcactatatgtgttgctcctttgttgaaccctttcatttatactttgaggaacaagcaagtgaaacgagctttcaatgacacaaccaaaaaaattgcatttatcttacacaaa

SEQ ID NO: 110 - protein, 196 aa, Canis familiaris
MSYDRYVAICKPLHYMTIMNNKVCTILVHCCWISVLLIIITPLGMGLQLEFCDSNATDHFGCDASPLFKISCSDTWVIEQMVIICAVLTFIITLGVILSYIYIIRTILRFSSASQRKKAFSTCSSHMLVVSITYGSCIFIYIKPSAKEEVNINKGVSVLTICVAPLLNPFIYTLRNKQVKRAFNDTTKKIAFILHK

SEQ ID NO: 111 - DNA, 939 bp, Canis familiaris
atgagaaaccaaacggcactaacaactttcatcttgctgggactcacagaggaccctcaactaaaaattttgctttttatgtttctgtttctttcctacatgttgaatgtatctggaaacctaaccatcatcatcctcactctgattgattcccaccttaaaacaccaatgtatcttttcctccaaaatttctccttcctagaaatttcattcacaactgcttgtgtccccagatttttatatagcatatcatcaggggacaaatccattacctataatgcttgtgtcagtcaactgttgtttacagacctctttgcagtaacagaattttttctcttggccactatgtcctatgatcgctatgtggccatctgcaaacccctgcattacatgaccatcatgagcagaagagtctgcaagaacttcatcgtcttctgttgggtagcagcactgatcatcattctcccaccaattagtctaggtttgggcctggaattctgtgattcaaacatcattgatcatttttgttgtgatgcatctcctatcctgaagatctcttgctcagacacatggttgatagaacagatggttatagtctgtgctgtgttgacattcatcatcaccctcatgtgtgtagttctttcttacatttatattatcgggaccattctaaggtttccctctgctcagcaaaggaaaaaggccttttccacttgttcttcccacatgattgttgtttccattacttatggtagctgtatcttcatttatgtcaaaccttcagccaaggatgaggtagctattaataaagggatttcactccttattacttctatctcaccaatgttgaacccctttatttacacactgagaaacaagcaagtgaagaaagcttttcatgattcaattaaaaaaatcgcattcctatcaaagatgtaa

SEQ ID NO: 112 - protein, 312 aa, Canis familiaris
MRNQTALTTFILLGLTEDPQLKILLFMFLFLSYMLNVSGNLTIIILTLIDSHLKTPMYLFLQNFSFLEISFTTACVPRFLYSISSGDKSITYNACVSQLLFTDLFAVTEFFLLATMSYDRYVAICKPLHYMTIMSRRVCKNFIVFCWVAALIIILPPISLGLGLEFCDSNIIDHFCCDASPILKISCSDTWLIEQMVIVCAVLTFIITLMCVVLSYIYIIGTILRFPSAQQRKKAFSTCSSHMIVVSITYGSCIFIYVKPSAKDEVAINKGISLLITSISPMLNPFIYTLRNKQVKKAFHDSIKKIAFLSKM

SEQ ID NO: 113 - DNA, 936 bp, Canis familiaris
atgagaaacggtacaataacaacattcattctgctgggactgacagatgaccctgagctgcaagttctgatttttatctttctatttctcacctacactttgagtataactggaaacctgaccatcatcatactcacttttgtggatccccaccttaaaacacccatgtactttttcttaaaaaatttctccttcttggagatctcattcacatctgccgttattcccagatatttgtatagcatagcaacaggtgacaatgttattacctataatgcttgtgtcattcaagtgttttttactgacctctgtggagtatcagagttttttctgctggctgccatgtcctatgaccgctatgttgccatctgcaaacccttgcattatgtgatcataatgagtaacagtgtctgcaggattctcaatatctgttgttgggtggctggtttatgtataataatcccaccacttagcctgggtttaaatctaaaattttgtgactctaacataattgatcattttggctgtgatgcatttcccttagtgaaaatctcatgttcagatacaaggttcatggaatggacagttataatatgtgccatactgaccttgaatatgactcttacctgtgtggttctgtcatatgcttacatcatcaagacaatttttagattcccttctgttcaacaaagaaaaaaggcctattcgacctgttcttcccacatgattgtggtatccatcacctatggcacatgcattttcatctatatgaatcctacagcaaaggaaaaagtgaccattaataaagtggtttcactgctcattttttctatttcacctacattgaacccatttatttataccttgagaaacaatcaagttaagaaagccttcgaggactcaatcaaaagaattgccttgctctcaactaagtaa

SEQ ID NO: 114 - protein, 311 aa, Canis familiaris
MRNGTITTFILLGLTDDPELQVLIFIFLFLTYTLSITGNLTIIILTFVDPHLKTPMYFFLKNFSFLEISFTSAVIPRYLYSIATGDNVITYNACVIQVFFTDLCGVSEFFLLAAMSYDRYVAICKPLHYVIIMSNSVCRILNICCWVAGLCIIIPPLSLGLNLKFCDSNIIDHFGCDAFPLVKISCSDTRFMEWTVIICAILTLNMTLTCVVLSYAYIIKTIFRFPSVQQRKKAYSTCSSHMIVVSITYGTCIFIYMNPTAKEKVTINKVVSLLIFSISPTLNPFIYTLRNNQVKKAFEDSIKRIALLSTK

SEQ ID NO: 115 - DNA, 942 bp, Canis familiaris
aatctgttatttttgcagctttaaaaaaaagaatattccaacataaataattgttctagctctgtgagtgaattcatccttttggtcttcccttctacctgggaaattcagattctccttttctcaatcttctgtggaacttatattctgacactgactggaaatctgtgcattatctgtgctgtgaggtgggaccatagcctacaaactccaatgtacatcctgctggccaatttctccttcctggagatctgctttatcacctccactgtccccaaaatgctagccaacttgctgtctgagaccagaaccatctgcttctatggctgcttcctccagttctacttcttctctgagggcaccgctgagaccttcttcttgtctgccatggcctttgacaggtttcttgctacctgcaggcccctgcactaccccactgtcatgactgctcagcgctgcatcagaataggagctgggtgctgggtgtgtggtttcttatacttcctcttgcctatttacctcatctctcagctcccattttgttgttctaataagattgatcacttcctgtgtgacccaggacctcttatgaagctgtcctgtgtgccagctcctgctactgagatcatctgtgccatctataactcagtcctcactttctccaccttattcttcattaccagcttctataccttggtgatcagagctgtgctcagggtcccctcagcataaggtcggcataaggccttctctacgtgtggctcccatctggctgtggtgtccctgttttatggctctatcatggctgtatatgtaagccccacagcaggcactccagcagggattctgtgttaactccacttttcaaccccttgatctatagcctctgaaataaggaagatgaaggcagctctgggaaaataattcaggattgtcagattt

SEQ ID NO: 116 - protein, 29 aa, Canis familiaris
NLTILNYFPRAAFIFLISEAIDQGVEKWS

SEQ ID NO: 117 - DNA, 456 bp, Canis familiaris
ggaagtcaagctctccccttcgcagatgacatgatcagcccctactgtggttctctggaaatggatcacttcttctgttaggtccctgctctgctgagtctctcctgcgctgacaccttgctctttgatgatctcatgtatgcttgctgtgtagtcatgctgctgctgccccttgaggtccttgcggtttcctatgcctgagtcctcacagctgtcattaggttgccttccacagatggtaaacagaaggctctgaccacttgctcttcccctgtggctgtgctgtactatggagtagccatgtttagctacatacagaggacctccagtaggacaccagtgagtgactgagccacttccatcttctacacaatcctcactccaatgctcaacccactcatttacagtctgaggaacagggaggtaacaagtgccctcaggaaggtgctggggaga

SEQ ID NO: 118 - protein, 152 aa, Canis familiaris
SPQHLPEGTCYLPVPQTVNEWVEHWSEDCVEDGSGSVTHWCPTGGPLYVAKHGYSIVQHSHRGRASGQSLLFTICGRQPNDSCEDSGIGNRKDLKGQQQHDYTASIHEIIKEQGVSAGETQQSRDLTEEVIHFQRTTVGADHVICEGESLTS

SEQ ID NO: 119 - DNA, 303 bp, Canis familiaris
ggccttttcacccactccccactgcacctcctccttttttccatcatcatagtaatgttcctggtggccctctctggcaatgggctcatgatcctcctcataaatgttgactcccgcctgcacagccccatgtacttcttcctcagctggctgtcactcatggaccttatgctcatctccaccattgtgccacggatggccaccaacttcttcctgggccatggatccatctccttcacaggctgtgggctccagatcctcttctttctctctctcctgggggatgaatgcttcctgctggcc

SEQ ID NO: 120 - protein, 101 aa, Canis familiaris
GLFTHSPLHLLLFSIIIVMFLVALSGNGLMILLINVDSRLHSPMYFFLSWLSLMDLMLISTIVPRMATNFFLGHGSISFTGCGLQILFFLSLLGDECFLLA

SEQ ID NO: 121 - DNA, 948 bp, Canis familiaris
atggagatatggttgaaccgaacatctatagatggcttcatcctcttgggcatcttttcccatagccagactgatcttgtcctattctctgtggttatggtggtcttcacagtggccctctgtgggaatgttctcctcctcttcctcatctacatagatcctcggcttcacacacccatgtatttcttcctcagtcagctctctctcatggacctcatgttggtctgtgcaaatgtgccaaagatggcagtcaacttcctgtctggcaggaagtccatctcctttgtgggttgtggcatacaaattggcttttttgtctctcttgtgggatctgaggggctcttgctgggactcatggcttatgatcgctatgtggccattagccacccacttcactatcctatcctcatgagtcagaaggtctgtctcaagtttgctgggagttcctgggcctttgggatactagatggaattatccagatggtggcagccatgagcttaccttactgtggctcaaggattgtggatcatttcttctgtgaggtgccagctttattaaaactggcctgtacagacacatccctttttgacactctgctctttgcttgctgtgtctttatgctgcttcttcccttctccattattgtggcctcctatgcccatatcctgagggctgtgctccacatgtgctctgctcaggcccgtaaaaaggccctggccacctgttcctcccacctgacagctgtctccctcttctatggggcagccatgttcatctacctgaggcctcggcgctaccgggcccctagtcatgacaaggcggtctctatcttctacacagtccttactcctatgctcaaccccctcatttatagcttaagaaaccaagaagtgatgggggccctgaggaaggggctggatcattgcaggattggcagccagcactga

SEQ ID NO: 122 - protein, 315 aa, Canis familiaris
MEIWLNRTSIDGFILLGIFSHSQTDLVLFSVVMVVFTVALCGNVLLLFLIYIDPRLHTPMYFFLSQLSLMDLMLVCANVPKMAVNFLSGRKSISFVGCGIQIGFFVSLVGSEGLLLGLMAYDRYVAISHPLHYPILMSQKVCLKFAGSSWAFGILDGIIQMVAAMSLPYCGSRIVDHFFCEVPALLKLACTDTSLFDTLLFACCVFMLLLPFSIIVASYAHILRAVLHMCSAQARKKALATCSSHLTAVSLFYGAAMFIYLRPRRYRAPSHDKAVSIFYTVLTPMLNPLIYSLRNQEVMGALRKGLDHCRIGSQH

SEQ ID NO: 123 - DNA, 933 bp, Canis familiaris
atggaaacagctaatgacagcacaggtgggtatttcatcctagtgggcttctctgaacggcctgagttagagctgatcctctctttctttgtcctgatgttctacactgtaactcttgtgggcaatgtggccatcgtcctgctctctatcctggatactggacttcacacacccatgtacttcttccttagaaacctctctgtgcttgacctctgcttcaccaccagtattgtgccccagatgctggtgaacatgtggggaggcaacaagaagatcagttatgctggctgcatggtccagtactgggtggccttggcacttggctccactgagtgtgtgctccttgcagtgatggcggttgaccgctatgttgcagtttgctggcctctgcgctatgcctgtatcatgcacgccaggctgtgccacctcctggcagcagcttcctggtcctttggttttgccaactcctttttacagtcctcaatggccatcgtgctgcctcgatgtggaaaccggcgtgtggaccatttcttttgtgaattgttgatcatcattaaactctcctgtgtggatactggcccaacagaatctaaaatgtttattgcccggctaatcatcctaggcatgcctgtctccatcatcctgaccacttacgtatgcatcaccagggcagtagtaaaaatgcgctcagcagagggaaggaaaaaggcctttgggacctgtgcctcccacctaatggtagtctcactcttctatgggaccattatgtttttgtatctgcagcccaaggacaactactcccaggaccagagcaaagcactggcagtgctgtacatgatccttgcacccacactcaaccctctgatctacacgctgaggaataaggatgtgaagaaagcagtcaggaggatgatagggaaggagcaggtgtag

SEQ ID NO: 124 - protein, 310 aa, Canis familiaris
METANDSTGGYFILVGFSERPELELILSFFVLMFYTVTLVGNVAIVLLSILDTGLHTPMYFFLRNLSVLDLCFTTSIVPQMLVNMWGGNKKISYAGCMVQYWVALALGSTECVLLAVMAVDRYVAVCWPLRYACIMHARLCHLLAAASWSFGFANSFLQSSMAIVLPRCGNRRVDHFFCELLIIIKLSCVDTGPTESKMFIARLIILGMPVSIILTTYVCITRAVVKMRSAEGRKKAFGTCASHLMVVSLFYGTIMFLYLQPKDNYSQDQSKALAVLYMILAPTLNPLIYTLRNKDVKKAVRRMIGKEQV

SEQ ID NO: 125 - DNA, 939 bp, Canis familiaris
atggacagagacaaccagactacagtcacagaattccttcttctgggactctctgggcagtcagagcaagaagacattctctttgggctattcttggggatgtacctggtcaccatcatcgggaactttctcattgtcttggccatcagcagtgacagtcatctccacacccccatgtacttcttcttggctaacctctcctgtgtcgacatctgcttttcatcggtcacaacccccaagatgctggtgaatcacatcctgggaagcgagtctatctcgtacatggaatgcatgatccagatctacttcttcatcactttcaccaacatggatgggttcttcttgagtgtgatggcctatgatcgttatgtagccgtctgttgcccgctccactacaccatgatcatgaagcccaaactctgtatgcttctggtggtggcatcttgggtcattacaaacctgcatgctctcctccacacccttcttatggcccaactcgcatattgtttcaacaatactgtgcatcactttttctgtgacccctatgcaattctaaagctgtcctgttctagtacctttatcaatgacctgatggtattcactgtgggtggactggtatttctgacaccgttcacatgtatcatcatttcatatgcttatatcctctccaatgtactgaagttgccatctgcccatggaataaggaaagcattctccacatgtgggtctcacctcactgtggtctccctattctatggggcaattttgggggtgtatatgcgcccttcatcctcctactcagtccaagacacagtggccactgtcatcttcacagtggtgactcccttggtcaatcccttcatctacagcctgagaaatcatgacatgcagagagctttgaggaaactaatctcagtttctagaattagaaaattttag

SEQ ID NO: 126 - protein, 312 aa, Canis familiaris
MDRDNQTTVTEFLLLGLSGQSEQEDILFGLFLGMYLVTIIGNFLIVLAISSDSHLHTPMYFFLANLSCVDICFSSVTTPKMLVNHILGSESISYMECMIQIYFFITFTNMDGFFLSVMAYDRYVAVCCPLHYTMIMKPKLCMLLVVASWVITNLHALLHTLLMAQLAYCFNNTVHHFFCDPYAILKLSCSSTFINDLMVFTVGGLVFLTPFTCIIISYAYILSNVLKLPSAHGIRKAFSTCGSHLTVVSLFYGAILGVYMRPSSSYSVQDTVATVIFTVVTPLVNPFIYSLRNHDMQRALRKLISVSRIRKF

SEQ ID NO: 127 - DNA, 942 bp, Canis familiaris
atgtccagggggaaggagaatgtgacaggagtcaccgagttcctcctacttggcatcaccagtgaccccgagcagcggcaagtcctcttctggctcttcctgtgtatgtacctggtcactgtggctgggaacacactcatcatcctggtcatcggctcccatccccgcctgcacacccccatgtacttcttccttatcaatctctcctttgttgacatctgcttcactaccaacctgatccccaagctgctggtcaaccacgtagcaggaacatggactatctcttacccccactgcctgacccagatgtacttcctcatctcctttgccaacctggacacctttctgctagcggccatggcactggaccgttatgtggccatctgcaaacccctgctataccacaccatcatcactcctcagctctgtaggggactaaccacactcatgtggacatgctctggcctcatctccctggttcacacactcctcatgaacggactgacattctgctcctcagcccgggagatcttgcacttctactgtgatgcctacctgctgatgaagattgcctgctcagacacgcgtgtcaatcaacacatgttcctgggtgccgtggtcctatttgtggccccctgtgcgctcattgtagtttcctacatccgcatagctacagccgtcctccggatcccttctgccctgggaaggcgcaaggcattttccacatgcagctcccatctatctgtggtcaccttgttctatggaactgtcctgggggtatacatacgaccacctaagtccttctcagtccaggacacagtggcaactgtcatgtatacagtggtgacgcccatgctaaatcccttcatctacagcctgaggaaccaggacatgaaggaggctgtaggaagactcttcagcaagggctccaaatcctcttag

SEQ ID NO: 128 - protein, 313 aa, Canis familiaris
MSRGKENVTGVTEFLLLGITSDPEQRQVLFWLFLCMYLVTVAGNTLIILVIGSHPRLHTPMYFFLINLSFVDICFTTNLIPKLLVNHVAGTWTISYPHCLTQMYFLISFANLDTFLLAAMALDRYVAICKPLLYHTIITPQLCRGLTTLMWTCSGLISLVHTLLMNGLTFCSSAREILHFYCDAYLLMKIACSDTRVNQHMFLGAVVLFVAPCALIVVSYIRIATAVLRIPSALGRRKAFSTCSSHLSVVTLFYGTVLGVYIRPPKSFSVQDTVATVMYTVVTPMLNPFIYSLRNQDMKEAVGRLFSKGSKSS

SEQ ID NO: 129 - DNA, 981 bp, Canis familiaris
atggcaaaccagacggctgtgaccgaatacatcttgctggggcttcaggagcaccataagctcgagatggtcctgtttgtgctctgcctgggcatctactctgtgaatgtgctggggaactccctcctcatagtgctgaacatgttggacccccgtctgcacagccccatgtacttcttcctcagcaacctctccctgatggacatctgtggcacatcctcctttgtgcctctcatggtggtcaacttcctgaaaacccagaggaccatctccttccctggctgtgccctgcagatgtacctgaccctggctctgggcaccacggagtgcctgcttctggcagtgatggcatacgaccgttatgtggccatctgccagccacttaggtacccagagatcatgcgtaggcagacgtgtgtgcagatggtggtgctgagctgggggatgggctttgccaattcactgctgcagtcctttcttacctggaatgtctccttctgtggccacaatatcatcaaccacttcttctgcgagatcttggcagtgctgaaactggcctgcggggacatctctctcaatgcactgctaataatggtggccacagttatcctgacactggccccacttctgctcatcttcctgtcctacattttcatcctcgctaccatccttagggtgccctcagctgcaggccggtgcaaagccttctccacctgctctgcccacatcatagtggtggtagttttctatgggaccatctccttcatgtacttcaagcccaaggccaaggaccctgacctggataagattattgcattgttctatggggttgtgacaccctcactgaaccccatcatctacagcctgaggaacgcagaagtgaaagctgctgctatagccctgctgtggggagacctgctctccaggaagatgtcccatcttccctgttgctcttcaactctatcatgcatggcaggctag

SEQ ID NO: 130 - protein, 326 aa, Canis familiaris
MANQTAVTEYILLGLQEHHKLEMVLFVLCLGIYSVNVLGNSLLIVLNMLDPRLHSPMYFFLSNLSLMDICGTSSFVPLMVVNFLKTQRTISFPGCALQMYLTLALGTTECLLLAVMAYDRYVAICQPLRYPEIMRRQTCVQMVVLSWGMGFANSLLQSFLTWNVSFCGHNIINHFFCEILAVLKLACGDISLNALLIMVATVILTLAPLLLIFLSYIFILATILRVPSAAGRCKAFSTCSAHIIVVVVFYGTISFMYFKPKAKDPDLDKIIALFYGVVTPSLNPIIYSLRNAEVKAAAIALLWGDLLSRKMSHLPCCSSTLSCMAG

SEQ ID NO: 131 - DNA, 960 bp, Canis familiaris
atgtctcctgagcactgcaatatggagttggtcaataggacagagatctttgagttctttctgaaaggattttctggctacccagccctggagcacctgctcttccctctgtgctcagccatgtacctggtgaccctgctggggaacacagccatcgtggcagtgagtgtcctcgatgtccacctacacacgcccatgtacttcttcctgggcaacctctccatcctggacatctgctacacatctacctttgtgcctctgatgctggtccacctcctgtcagcccagaagaccatctcttttgttggctgtgcaatccagatgtgtctgagcctagccacaggctccacagagtgtctacttcttgccatcatggcctacgatcgctacctggccatttgccggccactcaggtatcccgtgctcatgagccaccggctctgcttgttgctggcaggagccgcctggggactctgtcttgtcaagtcaatgactgagactgtcattgccatgaggttgcctttctgtggccaccgcatggttagtcacttcacctgtgagatcctggcagtgctgaagctggcatgcagtgacacatcagtcagtgaagtcttcctgctggtgggtgccattctgctgctgcctatacccctggcattcatctgcctgtcctacacacttatcctggccaccatcctgagagtgccctcagcagctgggcgtcgcaaagccttctccacctgctcagcacacctggctgtggtgatgctgttctacggcaccgtcatattcatgtacatgaaacccaagagcaaggaggcccacatctctgatgaggtcttcacagtcctctatgctgttgtcacacctatgctgaaccctgtcatctacagcttgaggaacaaggaggtaaaggaggctgccaggaaagtatggtgtaggagttggacatccaagtga

SEQ ID NO: 132 - protein, 319 aa, Canis familiaris
MSPEHCNMELVNRTEIFEFFLKGFSGYPALEHLLFPLCSAMYLVTLLGNTAIVAVSVLDVHLHTPMYFFLGNLSILDICYTSTFVPLMLVHLLSAQKTISFVGCAIQMCLSLATGSTECLLLAIMAYDRYLAICRPLRYPVLMSHRLCLLLAGAAWGLCLVKSMTETVIAMRLPFCGHRMVSHFTCEILAVLKLACSDTSVSEVFLLVGAILLLPIPLAFICLSYTLILATILRVPSAAGRRKAFSTCSAHLAVVMLFYGTVIFMYMKPKSKEAHISDEVFTVLYAVVTPMLNPVIYSLRNKEVKEAARKVWCRSWTSK

SEQ ID NO: 133 - DNA, 960 bp, Canis familiaris
atggaaaaagccaactggtcctcccctgtggcggggttcattatcctgggactctcagaccacccagggttggagaaaatgttttttgtgctcatcctcctgatgtacctggtgatcctgctgggcaacggggtcctcatcctggtgaccatccttgactcccgcctgcacacacccatgtacttcttcctggggaacctctccttcctggacatctgctacacaacctcctcagtccctctagtcctggatggcttcctgacccccaggaaaatcatctccttctcagcctgtgctgtgcagatgttcttctcatttgctatggcaggtacagagtgtgtgcttctgggcatgatggcatttgatcgctatgtggccatctgtaacccgctgaggtaccctgtggtcatgagcaaggctgcctatgtgcccatggctgtcagctcctgggctattggtggtactgcttctgtggtacacacatccttgacaattcagttgcctttctgtggaaacaatgtcatcaatcaccttgcctgtgagatcctggctgtcctgagattggcctgtgttgacatctccatcaatgtcatcagcatgcgggtggccaatgtgatcttgctgggggtcccagttctgttcatctctatctcttatgtgttcatcattgctaccatcctgaggatcccctcagctgaggggaggagaaaggctttctccacctgctctgcccacttcactgtggtggtcatcttctacgggaccttatttttcatgtatagaaagcccaaatctaaggattcgctggaagacaataaagaggacctttcagacaagctcattcccctcttttatggagtggtgacccccatgctcaaccccatcatctatagcctcaggaacaaggacgtgaagtctgctgtgtggaacctgatgtcacagaaatgcttcaccaggtga

SEQ ID NO: 134 - protein, 319 aa, Canis familiaris
MEKANWSSPVAGFIILGLSDHPGLEKMFFVLILLMYLVILLGNGVLILVTILDSRLHTPMYFFLGNLSFLDICYTTSSVPLVLDGFLTPRKIISFSACAVQMFFSFAMAGTECVLLGMMAFDRYVAICNPLRYPVVMSKAAYVPMAVSSWAIGGTASVVHTSLTIQLPFCGNNVINHLACEILAVLRLACVDISINVISMRVANVILLGVPVLFISISYVFIIATILRIPSAEGRRKAFSTCSAHFTVVVIFYGTLFFMYRKPKSKDSLEDNKEDLSDKLIPLFYGVVTPMLNPIIYSLRNKDVKSAVWNLMSQKCFTR

SEQ ID NO: 135 - DNA, 960 bp, Canis familiaris
atggacaggttcaattggacttctcctgtgatggggttcatcctcctgggcctctcagcccacccgaagctggagaaaatgttctttgtgctcatcctcttgatgtacctggtgatcctgctgggcaacggggtcctcatcctggtgaccatccttgactcccgcctgcacacacccatgtacttcttcctggggaacctctccttcctggacatctgctacacaacctcctcagtcccccttattcttgacagcttcctgacccccagcaaaaccatacccttctcagcctgtgctgtgcagatgtttctctcctttgccatgggagccacagagtgtgtgctactgggcatgatggcatttgatcgctatgtggccatctgtaacccacttaggtaccctgtggtcatgagcaaggctgcctatgtgcccatggctgccagctcctgggcagctggaagcatgactgccacggtgcaaacatccttagcgatgcgactgcctttctgtggggacaacatcatcaaccacttcacctgtgagatcctggcagtcctaaagttggcctgtgctgatatttccatcaatgtgatcagtatggcagtggctaatgtgatcttccttggcattccagttctatttatttctgtctcttatgtgttcatcattgctaccatcctgaggatcccctcagctgaggggaggaaaaaggccttctccacctgctctgcccacctcactgtagtggtcatcttctatggaacaatcctctttatgtatgggaagcccaaatccaaggatcctcagggggcagacaagcaggacatttctgacaagctcacctccctcttttatggggtagtgacccccatgctcaaccccatcatctacagcctgaggaacaaggacgtgaaggctgctgtgaggaatctggtacttcacaaacactttatccagtga

SEQ ID NO: 136 - protein, 319 aa, Canis familiaris
MDRFNWTSPVMGFILLGLSAHPKLEKMFFVLILLMYLVILLGNGVLILVTILDSRLHTPMYFFLGNLSFLDICYTTSSVPLILDSFLTPSKTIPFSACAVQMFLSFAMGATECVLLGMMAFDRYVAICNPLRYPVVMSKAAYVPMAASSWAAGSMTATVQTSLAMRLPFCGDNIINHFTCEILAVLKLACADISINVISMAVANVIFLGIPVLFISVSYVFIIATILRIPSAEGRKKAFSTCSAHLTVVVIFYGTILFMYGKPKSKDPQGADKQDISDKLTSLFYGVVTPMLNPIIYSLRNKDVKAAVRNLVLHKHFIQ

SEQ ID NO: 137 - DNA, 960 bp, Canis familiaris
atggaaagttccaaccagactgtctctgtgacagagtttattctactgggcctctcagcccacccgaagctggagaaaatgttctttgtgctcatcctcttgatgtacctggtgatcctgctgggcaacggggtcctcatcctggtgactgtgtctgtctcccacctgcacacacccatgtacttcttcttggggaacctctccttcctggacatctgctacacaacctcttcagttcccctcattcttgacagcttcctgacccccaggaaaaccatacccttctcagcctgtgccatgcagatgtttctctcctttgccatgggagccacagagtgtgtgcttctgggcatgatggcatttgatcgctatgtggccatctgtaacccgctgaggtaccctgtggtcatgagcaaggctgcctatgtgcccatggctgccagctcctgggcagctggaagtgctgcctctatggttcaaacatcccttgcaatgaaacttcccttctgtgggaacaatatcattaaccactttacctgtgagatcctggctattctaaagttagcttgtgctgacatctccatcaatgtgatcagtatgggggtgacaaatgtgattttcctgggggtcccagttctgttcatctttgtctcctatatcttcatcctcaccaccatcctaaggatcccctcagctgagggaagaaaaaaggccttctccacctgctctgcccaccttgcagtcgtggtcatcttctatgggactattctcttcatgtacgggaagcccaaatccaaggaccccctgggggcagacaagcaggatgtttcagacaagcttacctccctcttctatggggtggtgacccccatgctcaaccccatcatctacagcctgaggaacaaggacgtgaaggctgctgtgaggaacctggtggctcaaaaatgctttacccagtga

SEQ ID NO: 138 - protein, 319 aa, Canis familiaris
MESSNQTVSVTEFILLGLSAHPKLEKMFFVLILLMYLVILLGNGVLILVTVSVSHLHTPMYFFLGNLSFLDICYTTSSVPLILDSFLTPRKTIPFSACAMQMFLSFAMGATECVLLGMMAFDRYVAICNPLRYPVVMSKAAYVPMAASSWAAGSAASMVQTSLAMKLPFCGNNIINHFTCEILAILKLACADISINVISMGVTNVIFLGVPVLFIFVSYIFILTTILRIPSAEGRKKAFSTCSAHLAVVVIFYGTILFMYGKPKSKDPLGADKQDVSDKLTSLFYGVVTPMLNPIIYSLRNKDVKAAVRNLVAQKCFTQ

SEQ ID NO: 139 - DNA, 954 bp, Canis familiaris
atgaaaatggccaaccaatctgttctggcaggatttgtcttgctggggctctcagatcaaccaaagcttgagagaacattctttgtgctcatcctgtcgatgtacctggtgatcctactgggaaacggggtcctcatcctggtgaccatccatgactcccgcctgcacacacccatgtacttcttcctggggaacctttccttcctggacatctgctacacaacctcctcaatccctctagtcctggatggcttcctgacccccaggaaaaccatctccttctcaggctgtgctgtgcagatgtttctctcctttgccatgggagccacagagtgtgtgcttctgggcatgatggcatttgatcgctatgtggccatctgtaacccacttaggtaccctgtggtcatgagcaaggctgcctatgtgcccatggctgccagctcctgggtggctggtggcatcaactccttggtgcagatctctcttgcagtacagttacccttctgtggggacaacatcatcaaccactttacctgtgagatcttggctgtcctaaagttggcctgtgctgacatctccatcaatgtaatcagtatgggggtggccaatgtgatcttcctgggcgtcccagttctgttcatctctatctcctacatcttcatcctcaccaccatcctgaagatcccttcagctgaagggaggagaaaggccttctccacctgctctgcccatctcactgtagtggtcatcttctatggaactattcttttcatgtatgcaaagcccaaatctaaggaccccctgggagcagacaagcaggatgtttcagacaagctcatctctctcttctatggagtgctgactcccatgctcaacccaatcatctacagcctaagaaacaaggatgtgaaggtcgctgtgaagaccctggtgaggcagaaacgctttgcatag

SEQ ID NO: 140 - protein, 317 aa, Canis familiaris
MKMANQSVLAGFVLLGLSDQPKLERTFFVLILSMYLVILLGNGVLILVTIHDSRLHTPMYFFLGNLSFLDICYTTSSIPLVLDGFLTPRKTISFSGCAVQMFLSFAMGATECVLLGMMAFDRYVAICNPLRYPVVMSKAAYVPMAASSWVAGGINSLVQISLAVQLPFCGDNIINHFTCEILAVLKLACADISINVISMGVANVIFLGVPVLFISISYIFILTTILKIPSAEGRRKAFSTCSAHLTVVVIFYGTILFMYAKPKSKDPLGADKQDVSDKLISLFYGVLTPMLNPIIYSLRNKDVKVAVKTLVRQKRFA

SEQ ID NO: 141 - DNA, 957 bp, Canis familiaris
atggaaggacccaaccaatctgctgtgacagagttcgttttgcttggcctctctgcccatccaaaactagagaaaacattctttgtgctcatcctgtcgatgtacctggtgatcctactgggaaacggggtcctcatcctggtgaccatccatgactcccgcctgcacacacccatgtacttcttcctggggaacctctccttcctggacatctgctacacaacctcctcagtccctctagtcctggatggcttcctgacccccaggaaaaccatctccttctcaggctgtgccgtgcagatgtttctctcctttgccatgggagccacagagtgtgtgcttctgggcatgatggcatttgatcgctatgtggccatctgtaacccacttaggtaccctgtggtcatgagcaaggctgcctatgtgcccatggctgccagctcctgggtggctggtggcatcaactccttagtgcagatctctcttgcagtacagttacctttctgtggggacaatgtcatcaaccacttcatctgtgagatcctggctgtcctaaagttggcctgtgctgacatctccatcaatgtgatcagtatgggggtggccaatgtgatcttcctgggcgtcccagttctgttcatctctatctcttatgtgttcatcattgctaccatcctgcggatcccctcagcagaggggaggagaaaggccttctccacctgctctgcccacctcactgtagtggtcatcttctatgggactattcttttcatgtatgcaaaacccaaatctaaggatcccctgggagcagacaagcaggatgtttcagacaagctcatctccctcttctatggcctcctgactcccatgctcaaccccatcatctacagtctgaggaacaaggatgttaagaccgctgtgaggtacatagtggctcagaagcacttcactcagtga

SEQ ID NO: 142 - protein, 318 aa, Canis familiaris
MEGPNQSAVTEFVLLGLSAHPKLEKTFFVLILSMYLVILLGNGVLILVTIHDSRLHTPMYFFLGNLSFLDICYTTSSVPLVLDGFLTPRKTISFSGCAVQMFLSFAMGATECVLLGMMAFDRYVAICNPLRYPVVMSKAAYVPMAASSWVAGGINSLVQISLAVQLPFCGDNVINHFICEILAVLKLACADISINVISMGVANVIFLGVPVLFISISYVFIIATILRIPSAEGRRKAFSTCSAHLTVVVIFYGTILFMYAKPKSKDPLGADKQDVSDKLISLFYGLLTPMLNPIIYSLRNKDVKTAVRYIVAQKHFTQ

SEQ ID NO: 143 - DNA, 945 bp, Canis familiaris
atggacaggtccaatcagacctctcctgtgatggggtttattctcctgggcctctcagcccacccgaaactggagaaaaccttctttgtgctcattctcgtgatgtaccttgtaatcctgttgggcaacggggtcctcatcctggtgaccatccttgattcccacctgcacacacccatgtacttcttcctggggaacctctccttcctggacatctgctacacaacctcttcagtcccccttattcttgacagcttcctgacccccaggaaaaccatacccttctcagcctgtgtcatgcagatgtttctctcctttgccatgggagccacagagtgtgtgcttctgggcatgatggcatttgatcgctatgtggctatctgtaacccgctgaggtaccctgtggtcatgagcaaggctgcctatgtgcccatggctgccagctcctgggcagctggtatcaccaactctgtagtccagacatcccaggctatgaggcttcccttctgtggggacaatgtcatcaatcacttcacctgtgagatcctggctgtgctgaagttggcctgtgctgacatttctatcaatgtgattagcatggttgtggctaatgtgatcttcctgggggtcccagttgtgttcatttttgtctcctatgtgttcatcattgctaccatcctgaggatcccctcagctgaggggaggaaaaaggccttctccacctgctctgcccacctcaccgtagtggttgtcttctatgggaccatcctcttcatgtatgggaagcccaaatccaaggacccccagggggcagacaagcaggacatttcagacaagctcacctccctcttttatggggtggtgacccccatgctcaaccccatcatctacagcctgaggaacaaggacgtgaaggctgctatgaagaacctggtatgtcaataa

SEQ ID NO: 144 - protein, 314 aa, Canis familiaris
MDRSNQTSPVMGFILLGLSAHPKLEKTFFVLILVMYLVILLGNGVLILVTILDSHLHTPMYFFLGNLSFLDICYTTSSVPLILDSFLTPRKTIPFSACVMQMFLSFAMGATECVLLGMMAFDRYVAICNPLRYPVVMSKAAYVPMAASSWAAGITNSVVQTSQAMRLPFCGDNVINHFTCEILAVLKLACADISINVISMVVANVIFLGVPVVFIFVSYVFIIATILRIPSAEGRKKAFSTCSAHLTVVVVFYGTILFMYGKPKSKDPQGADKQDISDKLTSLFYGVVTPMLNPIIYSLRNKDVKAAMKNLVCQ

SEQ ID NO: 145 - DNA, 984 bp, Canis familiaris
atgttccaggcaaatttgacatatgtaacacattttttcctcctggggttttcccactaccccaaagttgaggtcatcgtatttgtgctgtgcttgctgatgtatctgatcaccctgctgggtaatataattctgatctccatcaccatcctggattcccacctacacaaacccatgtacttcttcctcagcaacctctcctttttagacatctggtacacctcttctgctttcactccaatgctggcaaattttgtttcaggggaatacaccatctcattcttagggtgtgctgctcagatgtacttttctcttgccatgggttccactgagtgtgtgctcctgtccatgatggcatatgaccggtatgtggccatatgcaaccccttgagataccccatcatcatgaacaagagggtttgtgtgcagattgcagctggctcctgggtgacaggctgcctcaccaccctggtggaaacagtatatgtgctgcagctctctctgtgtggtaataatacaatcaatcattttgcttgtgaaattctggctgtcttgaaactggtttgtgtggacacctccatggtggaattaatcatgctggtgatcaccatatttctcctccctatgccaatgcttctaatttgtatatcttatgcgttcattctctccaacatcctaagaatcagctctgtggatggtcgaagcaaagccttttcaacatgtgcagcccacctgactgtggtggttttgttctatgggacagctctctccatgtacctgaagccctcagctgtagattcacaggaaatagataaatttatagctttggtatatggtggattaacccctatgttgaatcctatcatctatagtctacgaaacaaagaggtgaaagcagccgtgaaaaaattgctgattagaaatccttttggtactgtgttaatttctgccctcaataatattggagcaagcacactcccctga

SEQ ID NO: 146 - protein, 327 aa, Canis familiaris
MFQANLTYVTHFFLLGFSHYPKVEVIVFVLCLLMYLITLLGNIILISITILDSHLHKPMYFFLSNLSFLDIWYTSSAFTPMLANFVSGEYTISFLGCAAQMYFSLAMGSTECVLLSMMAYDRYVAICNPLRYPIIMNKRVCVQIAAGSWVTGCLTTLVETVYVLQLSLCGNNTINHFACEILAVLKLVCVDTSMVELIMLVITIFLLPMPMLLICISYAFILSNILRISSVDGRSKAFSTCAAHLTVVVLFYGTALSMYLKPSAVDSQEIDKFIALVYGGLTPMLNPIIYSLRNKEVKAAVKKLLIRNPFGTVLISALNNIGASTLP

SEQ ID NO: 147 - DNA, 939 bp, Canis familiaris
atggggaattactcagctgtgactgaattctttttggtgggactttcccaatacccagagctccagctttttctgttcatgctctgcctcatcatgtatgtgataattctgctgggaaatagcctcctcatcatcagcagcatactggattctcgcctccacacccccatgtacttcttccttgggaatctctcgttcttggacatctgttacacatcctcttttattcctacgatgctcaccatatttaggtctgagaaaaaatccatctccttcattggctgtgctctgcagatggttgtctcccttgggttgggctgcactgaatgtgtcctcttggctgtgatggcctatgatcggtacgtggccatctgcaacccactgaggtatcccatcgtcatgaacagggtgctttatgtgcacatggctgcgtggtcctggatcataggctgtctaaactccctagttcaaacagtgctaataatgttgttgcctttctgtgggaataatgtcattgaccatcttacctgtgagttactggcccttcttaaactcatatgttcagatatttccatgaatgtgcttattatgacagtggcaagtattcttttcttagtggttcccctactgctaatttttatttcatatgttttcattctctctaccattctgagacttaactctactgaggggagaaagaaagccttttcaacgtgttcagcccacctcgctgtagtagttttattctatggttcagccttatttatgtacatgaagcccaagtcaaaagacacaaagacaattgatgagatcatcgggctgtcttatggagtggtaaccccaatgttgaaccccatcatctacagcctaaggaataaggaagtgaaagaggctatgaagaaagtcttgagtagacactttcattcacggaaaatatga

SEQ ID NO: 148 - protein, 312 aa, Canis familiaris
MGNYSAVTEFFLVGLSQYPELQLFLFMLCLIMYVIILLGNSLLIISSILDSRLHTPMYFFLGNLSFLDICYTSSFIPTMLTIFRSEKKSISFIGCALQMVVSLGLGCTECVLLAVMAYDRYVAICNPLRYPIVMNRVLYVHMAAWSWIIGCLNSLVQTVLIMLLPFCGNNVIDHLTCELLALLKLICSDISMNVLIMTVASILFLVVPLLLIFISYVFILSTILRLNSTEGRKKAFSTCSAHLAVVVLFYGSALFMYMKPKSKDTKTIDEIIGLSYGVVTPMLNPIIYSLRNKEVKEAMKKVLSRHFHSRKI

SEQ ID NO: 149 - DNA, 954 bp, Canis familiaris
atggaacacatgaagatggagaattactcagttgtgactgaattctttctggtgggactttcccaatacccagagctccagctttttctgttcatgctctgcctcatcatgtatgtgataattctgctgggaaatagcctcctcatcatcagcagcatactggattctcgcctccacacccccatgtacttcttccttgggaatctctcattcctggacatttgttacacatcttcttttattcctacaatgctcattttatttaggtctgaaacaaaatctatctccttcattggctgtgctctacagatggtagtctcccttgggttaggctgcactgagtgtgtcctcctggctgtgatggcctatgatcggtacgtggccatctgcaacccactgaggtatcccatcatcatgaacagggtgctttatgtgcacatggctgcgtggtcctggatcataggctatctgatctccctactgcaaacagtcatgacaatgatattgcctttctgtgggaataatgtcattgatcatattacctgtgagatcctggcccttcttaaactcatctgctcagatatcaccatcaatgtgattattatgacagtggcaagtattgttatactgatgcttcctctactgttaattttcatctcctatgtttttatcctctcttccatcctgagaattaattctgctgaggggagaaagaaagctttttctacctgctcagcccacctgactgtggttatcttgttctatggttcagccctttttatgtacatgaagcccaagtcaaaggacacaaacacttctgatgagatcgtcgtgctgtcttatggcgtgataacgccgatgttgaaccccatcatttacagcttgagaaataaggaggtgaaagaggctgtgaagaaagtcctgagcagacacctacatttattgaaatcatga

SEQ ID NO: 150 - protein, 317 aa, Canis familiaris
MEHMKMENYSVVTEFFLVGLSQYPELQLFLFMLCLIMYVIILLGNSLLIISSILDSRLHTPMYFFLGNLSFLDICYTSSFIPTMLILFRSETKSISFIGCALQMVVSLGLGCTECVLLAVMAYDRYVAICNPLRYPIIMNRVLYVHMAAWSWIIGYLISLLQTVMTMILPFCGNNVIDHITCEILALLKLICSDITINVIIMTVASIVILMLPLLLIFISYVFILSSILRINSAEGRKKAFSTCSAHLTVVILFYGSALFMYMKPKSKDTNTSDEIVVLSYGVITPMLNPIIYSLRNKEVKEAVKKVLSRHLHLLKS

SEQ ID NO: 151 - DNA, 945 bp, Canis familiaris
atgaagatggagaattactcagctgtgactgaattctttctggtgggtctttcccaatacccagagctccagctttttctgttcatgctctgcctcatcatgtatgtgataattctgctgggaaatagcctcatcatcatcatcagcatactggattctcgcctccacacccccatgtacttcttccttgggaatctctcattcctggacatttgttatacatcatcatctattcctccaatgctcatcatgtttaggtctgagacaaaatctatctccttcattggctgtgctctgcagatggttgcctcccttgggttgggctctactgagtgtgtcctcctggctgtgatggcctatgatcggtacgtggccatctgcaacccactgaggtatcccatcatcatgaacagggtgctttatgtgcacatggctgcgtggtcctggatcataggctgtctgaactctctcgtgcaaacagccctgacaatggttttgcctttctgtgggaataatgtcatcgaccatcttacctgtgagatcctggcccttcttaaactcatctgctcagatatctccatgaatgtgcttatcatgacagtggcaagtattgttttattggtgcttcctctattgttaattttcatctcctatgtttttatcctctcttccatcctgagaattaattctgctgaggggagaaagaaagctttttctacctgctcagcccacctgactgtggttatcttgttctatggttcagccctttttatgtacatgaagcccaagtcaaaggacacaaaagcatctgatgaaatcatcgggctgtcttatggagtgataaccccaatgttgaaccccatcatttacagcttgagaaataaggaggtgaaagaggctgtgaagaaagtcctgagcagacacttgcatctatggaaaatataa

SEQ ID NO: 152 - protein, 314 aa, Canis familiaris
MKMENYSAVTEFFLVGLSQYPELQLFLFMLCLIMYVIILLGNSLIIIISILDSRLHTPMYFFLGNLSFLDICYTSSSIPPMLIMFRSETKSISFIGCALQMVASLGLGSTECVLLAVMAYDRYVAICNPLRYPIIMNRVLYVHMAAWSWIIGCLNSLVQTALTMVLPFCGNNVIDHLTCEILALLKLICSDISMNVLIMTVASIVLLVLPLLLIFISYVFILSSILRINSAEGRKKAFSTCSAHLTVVILFYGSALFMYMKPKSKDTKASDEIIGLSYGVITPMLNPIIYSLRNKEVKEAVKKVLSRHLHLWKI

SEQ ID NO: 153 - DNA, 957 bp, Canis familiaris
atggatagtataaacaagacatttgtgaaagaattcattcttctgggactctccggttacccaacacttgagatcatgtttttttctctgattctagtaatgtatctagtgattctaattggcaatggtcttctgattatagcaagcatcttcgattcccatcttcacacccccatgtacttcttcctgggtaacctctctttcctggacatctgctatacatcctcctctgttccctcaactttggtgagcttaatttcaaagaaaaggaacatttccttctctgggtgtgcagtgcagatgttctttgggtttgcaatggggtcaacagagtgtttcctccttggcatgatggcttttgatcgctacgtagctatctgtaaccctctgagataccctgtcatcatgaacaagatggtgtatgtactaatggcttctgtgtcatggctctctggtggaatcaactcaattgtacaaacatctcttgctatgcgactgcctttctgtgggaataatattatcaatcatttcttatgtgagatactagctgtcttaaagctagcctgcgctgatatatccctcaatatttttaccctagcagtgtcaaatatggcattcctggttcttccactgctggtcatttttttctcctatatgtttatcctctacaccatcttgagaatgaactcagctacagggagacgcaaagccttttccacctgctcagcacatctgaccgtggtgatcatattttatggtaccatcttcttcatgtatgccaagcccaagtctcaagaccacctagggaatgacaatttgcaagctacggaagggcttatttccatgttttatggggtagtgacccctatgctaaatcctataatctatagcttgagaaataaggatgtaaaagcggctgtgaaatatgtgctgaattggaaagctgttaagcagtaa

SEQ ID NO: 154 - protein, 318 aa, Canis familiaris
MDSINKTFVKEFILLGLSGYPTLEIMFFSLILVMYLVILIGNGLLIIASIFDSHLHTPMYFFLGNLSFLDICYTSSSVPSTLVSLISKKRNISFSGCAVQMFFGFAMGSTECFLLGMMAFDRYVAICNPLRYPVIMNKMVYVLMASVSWLSGGINSIVQTSLAMRLPFCGNNIINHFLCEILAVLKLACADISLNIFTLAVSNMAFLVLPLLVIFFSYMFILYTILRMNSATGRRKAFSTCSAHLTVVIIFYGTIFFMYAKPKSQDHLGNDNLQATEGLISMFYGVVTPMLNPIIYSLRNKDVKAAVKYVLNWKAVKQ

SEQ ID NO: 155 - DNA, 954 bp, Canis familiaris
atggatgaaattaatcagacatctgcatcagaatttcttcttctgggactcgctggttacccaacacttgagatcatttacttcgttctaattctagtaatgtatctagtgattctaattggcaatggtcttctgattatagcaagcatcttcgattctcatcttcacacccccatgtacttcttcctgggtaacctctctttcctggacatctgctatacatcttcctctgttccctcaacattggtgagcttaatttcaaagaaaaggaacatttccttctctgggtgtgcagtgcagatgttccttgggtttgcaatgggatcaacagagtgtttgctccttggcatgatggcttttgatcgctacgtagctatctgtaaccctctgagatacctcatcatcatgaacaaggtggtgtatgtactaatggcttctgtgtcatggctctctggtggaatcaactcaattgtacaaacatttcttgccatgcgactgcctttctgtgggaataatattatcaatcatttcacgtgtgaaatattagctgtccttaagctagcttgtgctgatatatccctcaatattgtcaccatggtgatatcaaatatggcattcctggttcttccactgctggtcatttttttctcctatatgttcatcctctacaccatcttgagaatgaactcagctacagggagacacaaggccttttccacctgctcagcacatctgactgtggtgatcatattttatggtaccatcttcttcatgtatgccaagcccaagtcccaagaattgcctggagaagacaagtttcaaacttcagacaagctcatttccctgttttatggggtagtgacccctatgctaaatcctataatctatagcttgaggaataaggatgtaaaaactgctgtaaaatatctgctgaaccgaaaacctattcggtaa

SEQ ID NO: 156 - protein, 317 aa, Canis familiaris
MDEINQTSASEFLLLGLAGYPTLEIIYFVLILVMYLVILIGNGLLIIASIFDSHLHTPMYFFLGNLSFLDICYTSSSVPSTLVSLISKKRNISFSGCAVQMFLGFAMGSTECLLLGMMAFDRYVAICNPLRYLIIMNKVVYVLMASVSWLSGGINSIVQTFLAMRLPFCGNNIINHFTCEILAVLKLACADISLNIVTMVISNMAFLVLPLLVIFFSYMFILYTILRMNSATGRHKAFSTCSAHLTVVIIFYGTIFFMYAKPKSQELPGEDKFQTSDKLISLFYGVVTPMLNPIIYSLRNKDVKTAVKYLLNRKPIR

SEQ ID NO: 157 - DNA, 960 bp, Canis familiaris
atggaaaggaccaatgattccatgttgacagaatttgtccttgttgggctttctgcccacccaaagctccagacagttttctttgtgctagttttgtggatgtacctgatgatccttctaggaaatggagtccttatttcagtaatcatctatgattctcacttgcacacccccatgtatttcttcctctgtaatctttcgttcctggacatttgttatacaagttcctctgtgccactaattcttgacaactttctgagagtaaggaaaagggtttccttctctgggtgcatggtgcaaatgtttctctcatttgccatgggggccacagagtgtgtgcttctaggcatgatggcacttgaccgcttggtagccatctgctacccactgagataccctgtcatcatgagcaaaaatacctatatgctcatggcagctggatcctgggtcactgggtttattgactcagtggtgcagacatctctcgcaatgcagttgccattctgtgctaataatgtcattaaccattttgtctgtgaaattctggctatcctaaaactggcctgtgctgatatttcaatcaatgtgatcagtatggcagggtcaaatctgatgggtctggttattccactgctagtaatttctatctcttacatttttattctcaccactattctgaagatttcttccactgaaggaaaacgtaaggccttctccacttgctcagcccacctaacagtagtgattatattctatggaaccctcttcttcatgtacgcaaagcccaaatctaaaagctctgttggtgccaataatcaagacatcactgaggccctcatctctctcttctatggagtaatgactcccatgctcaatcctctcatctatagtctgaggaacaaggatgtaaaggctgctgtgaagaacatgttggggagaagaaactctgatggaatatga

SEQ ID NO: 158 - protein, 319 aa, Canis familiaris
MERTNDSMLTEFVLVGLSAHPKLQTVFFVLVLWMYLMILLGNGVLISVIIYDSHLHTPMYFFLCNLSFLDICYTSSSVPLILDNFLRVRKRVSFSGCMVQMFLSFAMGATECVLLGMMALDRLVAICYPLRYPVIMSKNTYMLMAAGSWVTGFIDSVVQTSLAMQLPFCANNVINHFVCEILAILKLACADISINVISMAGSNLMGLVIPLLVISISYIFILTTILKISSTEGKRKAFSTCSAHLTVVIIFYGTLFFMYAKPKSKSSVGANNQDITEALISLFYGVMTPMLNPLIYSLRNKDVKAAVKNMLGRRNSDGI

SEQ ID NO: 159 - DNA, 939 bp, Canis familiaris
atggacaggacaaattggacagagattgagttcattctgcagggactttctgagtacccaagagtggaaaaactcctttttgtgatgtgcttgatgatgtacctggtgatcctgctgggaaacagcaccttgatcatcctaactctcctggattcccggctccatacacccatgtacttcttccttggtaatctttccttcctagacatttggtacacatcctcctttatcccctcaatgttgatacacttcctatcacagaaaaaaaccatctcctttgctagatgtgttattcagatgtctgcctcctacactatggggtccacagagtgtgtgctcctagcagtgatggcatatgaccgttatgtggccatctgtaaccctctgagatactccatcatcatgagcaaggcactgtgtattcagatggcagctctctcctggggattgggctttctcaattcactgacagaaactgttcttgcaatacggctgcccttctgtggaaaaaatgtcattaaccactttgcttgtgaaatattggcctttgtcaagctggcttgtacagatatttccttgaatgagattactataatgttgggaaatgtaatatttttattttccccattgctgttaatttgtatctcctacattttcatcctttctactgtactaagaatcaattcagtagaaggaaggaaaaaggccttttctatctgctcagcccacttaacagtagtgactttgttttatgggacaatcctcttcatgtatatgaagccaaagtccaaagactctgcttttaataaattgattgctctgttctatggagtagtcactcccatgctcaaccctatcatctatagcctgaggaatacagaggtacatggagctatgagaaaattgatgactaaacactcatattggagaaaaggatga

SEQ ID NO: 160 - protein, 312 aa, Canis familiaris
MDRTNWTEIEFILQGLSEYPRVEKLLFVMCLMMYLVILLGNSTLIILTLLDSRLHTPMYFFLGNLSFLDIWYTSSFIPSMLIHFLSQKKTISFARCVIQMSASYTMGSTECVLLAVMAYDRYVAICNPLRYSIIMSKALCIQMAALSWGLGFLNSLTETVLAIRLPFCGKNVINHFACEILAFVKLACTDISLNEITIMLGNVIFLFSPLLLICISYIFILSTVLRINSVEGRKKAFSICSAHLTVVTLFYGTILFMYMKPKSKDSAFNKLIALFYGVVTPMLNPIIYSLRNTEVHGAMRKLMTKHSYWRKG

SEQ ID NO: 161 - DNA, 942 bp, Canis familiaris
atgatcaagacaaacttgacagtcatttcaaaatttatttttctgggatttacttactaccccaaagttgaggtcatcgtatttgtgctatgcttgctgatgtatctgatcaccctgctgggtaatataattctgatctccatcaccatcctggattcccacctacacaaacccatgtacttctttctcagcaacctctcctttttagacatctggtacacctcttctgctctcactccaatgctggcaaactttgttctggggaaaaacactatctcattctcaggatgtgccattcagatgtacttttctcttgccatgggctccactgagtgtgtgctcctctccatgatggcgtatgaccggtatgtggccatctgcaaccctctgaggtaccctgtcatcatgaataggagggtttgtgtgcagattgcagctggctcctgggtgacaggctgcctcactgccttggtggaaacaatgtctgtgctgcatcagtctctctgtggaaatagcatcatcaatcatttcacttgtgaaattctggctgtgttgaaactagtttgcgtagacacttccagggtgcagttaatcatgctgttgattagcgtacttcttcttcctatgccgatgcttctcatttgtatatcttatgcgttcattctctccaacattctgagaatcagctcagtggatggtcgaagcaaagccttttcaacatgtgcagcccacttgactgtggtggttttgttctatgggacagctctctccatgtacctgaagcccttggctgtggattcacaagaaatagataaatttatagctctggtatatgctgggttaacccccatgttgaatcctatcatttatagtctacggaacaaagaggtgaaagcagctgtgaaaaaattgctgattaggaaccctctttgtgctttttaa

SEQ ID NO: 162 - protein, 313 aa, Canis familiaris
MIKTNLTVISKFIFLGFTYYPKVEVIVFVLCLLMYLITLLGNIILISITILDSHLHKPMYFFLSNLSFLDIWYTSSALTPMLANFVLGKNTISFSGCAIQMYFSLAMGSTECVLLSMMAYDRYVAICNPLRYPVIMNRRVCVQIAAGSWVTGCLTALVETMSVLHQSLCGNSIINHFTCEILAVLKLVCVDTSRVQLIMLLISVLLLPMPMLLICISYAFILSNILRISSVDGRSKAFSTCAAHLTVVVLFYGTALSMYLKPLAVDSQEIDKFIALVYAGLTPMLNPIIYSLRNKEVKAAVKKLLIRNPLCAF

SEQ ID NO: 163 - DNA, 975 bp, Canis familiaris
atggaatgggaaaatcaaaccattctggtggaattctttttgaaggggctttctggttaccctaagcttgagctactcttttttgtgctgatcttaataatgtatgttgtcatccttctgggcaatggcacccttattttaatcagcgtcttggactcccaccttcacacccctatgtacttcttcctggggaacctctccttcttggacatctgctacaccaccacctccattccctccacgctggtgagcttcctctcagaaagaaagaccatctccttctctggctgtgcagtgcagatgttccttggcttggccatggggacaacagagtgtgtgctcctgggcatgatggcctttgaccggtatgtggctatctgcaaccccctaagatatcctgtcatcatgagcaaggactcctatgtgcccatggcaactgggtcctggatcataggactggtcaactctgcagtacaaacggcgtttgtggtacaattgcctttctgtaggaataatgtcatcaatcatttctcctgtgaaattctggctgtcatgaaactggcttgtgctgacatctcaggcaatgagttcatcatgctcgtggccacgacattgtttatattgacaccactgctattaattattatctcctactcattaatcatctctagtatcctcaagattcgcacttctgaggggagaagcaaagtcttctccacttgctcagcccacctgactgtggtgataatattctatggaaccattctcttcatgtacatgaagcccaaatctaaaaagacactcaattcagatgacttggatgcgactgacaaacttatatccatgttctatggggttatgactcccatgatgaatcctttaatctacagtctcagaaacaaggatgtgaaagaagcagttaaacacctactgaagaaaatgtgtttaacaagtaaatgggaaagggacaagtaa

SEQ ID NO: 164 - protein, 324 aa, Canis familiaris
MEWENQTILVEFFLKGLSGYPKLELLFFVLILIMYVVILLGNGTLILISVLDSHLHTPMYFFLGNLSFLDICYTTTSIPSTLVSFLSERKTISFSGCAVQMFLGLAMGTTECVLLGMMAFDRYVAICNPLRYPVIMSKDSYVPMATGSWIIGLVNSAVQTAFVVQLPFCRNNVINHFSCEILAVMKLACADISGNEFIMLVATTLFILTPLLLIIISYSLIISSILKIRTSEGRSKVFSTCSAHLTVVIIFYGTILFMYMKPKSKKTLNSDDLDATDKLISMFYGVMTPMMNPLIYSLRNKDVKEAVKHLLKKMCLTSKWERDK

SEQ ID NO: 165 - DNA, 957 bp, Canis familiaris
atggaatgggaaaatcaaaccattctggtggaattctttttgaaggggctttctggttaccctaagcttgagctactcttttttgtgctgatcttaataatgtatgttgtcatccttctgggcaatggcacccttattttaatcagcgtcttggactcccaccttcacacccctatgtacttcttcctggggaacctctccttcttggacatctgctacaccaccacctccattccctccacgctggtgagcttcctctcagaaagaaagaccatctccttctctggctgtgcagtgcagatgttccttggcttggccatggggacaacagagtgtgtgctcctgggcatgatggcctttgaccggtatgtggctatctgcaaccccctaagatatcctgtcatcatgagcaaggattcctatgtgcccatggcaactgggtcctggtttgctggggttatcaactctgcagtacaaacggcgtttgtggtacaattgcctttctgtaggaataacgtcatcaatcatttctcctgtgaaattctggctgtcatgaaactggcttgtgctgacatctcaggcaatgagttcatcatgctcgtggccacgacattgttcaccttgctgcccctgcttttgatcgtcatctcttactcattaatcatctctagtatcctcaagattcgtacttctgaggggagaagcaaagctttctccacctgctcagcccacctgactgtggtgataatattctatggaaccattctcttcatgtacatgaagcccaaatctaaagagacacttaattcagatgacttggatgcgactgacaaacttatatccatgttctatggggttatgactcccatgatgaatcctttaatctacagtctcagaaacaaggatgtgaaggaggcagttaaacatctatttagcagaagattctttagcaagtga

SEQ ID NO: 166 - protein, 318 aa, Canis familiaris
MEWENQTILVEFFLKGLSGYPKLELLFFVLILIMYVVILLGNGTLILISVLDSHLHTPMYFFLGNLSFLDICYTTTSIPSTLVSFLSERKTISFSGCAVQMFLGLAMGTTECVLLGMMAFDRYVAICNPLRYPVIMSKDSYVPMATGSWFAGVINSAVQTAFVVQLPFCRNNVINHFSCEILAVMKLACADISGNEFIMLVATTLFTLLPLLLIVISYSLIISSILKIRTSEGRSKAFSTCSAHLTVVIIFYGTILFMYMKPKSKETLNSDDLDATDKLISMFYGVMTPMMNPLIYSLRNKDVKEAVKHLFSRRFFSK

SEQ ID NO: 167 - DNA, 963 bp, Canis familiaris
atgggagagaccaatcagtcttctgtgacagaatttgtccttttgggactttctggctatccagagcttgaggccatttactttgtgctggtactgtgtatgtacctggtgatcctgctgggaaatggagtcatcatcattgtaagtgtctgtgacacccacctacacacccccatgtactttttcctcagtaacttatcattcttggatatttgctataccagttcttctattcccctatttctcagcagctttttaacatcaaagaaaaccatttccttctctggatgtggagtgcaaatgtttctttcctttgctatgggagccacagagtgtgtccttctaagcatgatggcatttgaccgctatgtggccatctgtaaccctctgagataccccatcattatgagcaagacttcatatgtgcccatggctgctgggtcctggatcgcaggaggtgtcaattctgtgttgcaaacctgtcttgcgatgcggcttcccttctgtggggataatgtcattaatcattttacttgtgaaatcttggctgtcttaaaattggcctgtgctgatatctccataaatatcattagcatggttattgctaacatgatttttcttgtggtcccagtacttttcatttttgtttcctatgttttcattctctccactatcctgaagattccttctgcagaggggaagcgcaaagccttctccacctgctctgcccacctaacagtggtgattatattctatggaaccatcctcttcatgtatgcaaaacccaaggctaaagactcatctggtgcagacaaagtacaagtcacagacaaaatcatctctctattctatggagtcgtgacacctatgctcaatcctctcatctatagtttgaggaacaaagacgtgaaagaagctgtgaagaatgtactgtgtcggaaatgctcctcagaggcgatgtga

SEQ ID NO: 168 - protein, 320 aa, Canis familiaris
MGETNQSSVTEFVLLGLSGYPELEAIYFVLVLCMYLVILLGNGVIIIVSVCDTHLHTPMYFFLSNLSFLDICYTSSSIPLFLSSFLTSKKTISFSGCGVQMFLSFAMGATECVLLSMMAFDRYVAICNPLRYPIIMSKTSYVPMAAGSWIAGGVNSVLQTCLAMRLPFCGDNVINHFTCEILAVLKLACADISINIISMVIANMIFLVVPVLFIFVSYVFILSTILKIPSAEGKRKAFSTCSAHLTVVIIFYGTILFMYAKPKAKDSSGADKVQVTDKIISLFYGVVTPMLNPLIYSLRNKDVKEAVKNVLCRKCSSEAM

SEQ ID NO: 169 - DNA, 951 bp, Canis familiaris
atgaaaggaggaaacctcaccgtttggagcttttttttcctggagggtttttctagatacccgaagttagagattgttctcttcgtcttcagccttgtgatgtatctgataactctcttgggcaacagcactctgatcttgatcactgtcctagattcacgcctccaaacccccatgtactttttccttggaaatctgtctttcatggatatctgttacacatctgcatcgattcccactttgctggtgaacttgctctcatcccagaaaaccattgtcttttctgggtgcatggtacagatgtatttgtccctcgccatgggctccacagagtgcgtgctcctggctgtgatggcatatgaccgttacgtggccatttgccacccactgagataccccatcatcataaacaggcaggtctgtgtgcagatggccactgtctcctgggtgacggggtgtgtgaccgccctgctggaaaccagtttcgccctgcgggtgcccctctgtaggaatctcatcgatcacttcacgtgtgaaattctggccgtgctgaagttagcttgcacgagttcactgctcatggacatgatcatgctggtggtcagcgtgctcctcctgcctattccgatgctcttgatttgcatctcttatgtcttcatcctttccactattctgagaatcagctcagcggagggaagaaacaaagctttttccacctgtggtgcccacctgactgtggtgatcttgtattttggggccgccctgtctatgtacctaaagccttcttcatcaagttcacaagaagtagataagatcatctcgctgctttatggagtgctgaccccaatgttgaaccccataatttacagcttaaggaacaaagaagtcaaaggtgccgtgagaaaagtactgggccagacaccattgtatcaaacacatgaaaatctctga

SEQ ID NO: 170 - protein, 316 aa, Canis familiaris
MKGGNLTVWSFFFLEGFSRYPKLEIVLFVFSLVMYLITLLGNSTLILITVLDSRLQTPMYFFLGNLSFMDICYTSASIPTLLVNLLSSQKTIVFSGCMVQMYLSLAMGSTECVLLAVMAYDRYVAICHPLRYPIIINRQVCVQMATVSWVTGCVTALLETSFALRVPLCRNLIDHFTCEILAVLKLACTSSLLMDMIMLVVSVLLLPIPMLLICISYVFILSTILRISSAEGRNKAFSTCGAHLTVVILYFGAALSMYLKPSSSSSQEVDKIISLLYGVLTPMLNPIIYSLRNKEVKGAVRKVLGQTPLYQTHENL

SEQ ID NO: 171 - DNA, 936 bp, Canis familiaris
atgagaaatcacacagcaataacagagtttattcttcttggattgacaaatgacccacagtggcaggttgtacttttcatatttctttttgttacctacatgctcagtgtgactgggaacctgatcattatcaccctcactctttcagatccccacctgcagactccaatgtatttcttccttcgaaacttctcattcctagaaatatcattcacgtctgtctgcattcccagattccttgtcactatcgtgacaagggacagaaccattacttacaatggttgtgtgactcagctatttttcttcatcttcttgggggtgacagaattttaccttctggctgccatgtcctatgaccgctacgtggccatctgcaaacccctgcattacatgactgtcatgagcagcagagtctgcatccttcttgtctttagctcatggcttgcaggattcctgatcatctttccaccattaatcctgctgctgcaactggatttctgtgcctccaatataattgatcattttatttgtgactcttctccaattctacagctttcttgtacaaacactcactttctagaactcatggcattttttttagcggtggtaacacttatggtcaccttaaccctagttattctctcttatacatacatcatccggacaattctgagaattccttctacgagtcaaaggaaaaaagccttttccacatgttcctcccacatgatagtggtctccctctcttatggtagctgtatcttcatgtacattaagccttctgcaagggaaagggtaactttaagcaaaggagtagctgtgctcaatacctcagtggctcctctcttgaatcctttcatatacacactaagaaaccagcaggtgaagcaagccttcaagaacatggttcagagaatggtcttttcaaataaatga

SEQ ID NO: 172 - protein, 311 aa, Canis familiaris
MRNHTAITEFILLGLTNDPQWQVVLFIFLFVTYMLSVTGNLIIITLTLSDPHLQTPMYFFLRNFSFLEISFTSVCIPRFLVTIVTRDRTITYNGCVTQLFFFIFLGVTEFYLLAAMSYDRYVAICKPLHYMTVMSSRVCILLVFSSWLAGFLIIFPPLILLLQLDFCASNIIDHFICDSSPILQLSCTNTHFLELMAFFLAVVTLMVTLTLVILSYTYIIRTILRIPSTSQRKKAFSTCSSHMIVVSLSYGSCIFMYIKPSARERVTLSKGVAVLNTSVAPLLNPFIYTLRNQQVKQAFKNMVQRMVFSNK

SEQ ID NO: 173 - DNA, 927 bp, Canis familiaris
atgggcacagacaatgcaacccgtcaccaggattttctcctgctgggctttcctgggtcccaggtccttcagctatctctctttatgctttttctggtaatgtacattctcacagtgggtgggaacatggctatcttgatgctggtgagtacctcccaccagctacataccccgatgtacttctttctgagcaacctttctttcttggagatttggtataccacagctgcagtccccaaagccctggccatccttctggggagaagccaaaccataacatttactggctgccttttgcagatgtaccttgttttctcattgggctgcacagagtacttcctcctggcagccatggcttacgaccgctatctggccatctgctatcctctacactatggggccatcatgaatagcctgctctcagcacagctagccctgggatcatggctgtgcggttttctggccatttcagtgcccacagctctcatcagcaccctgtccttctgtggttcccgcactatcaaccacttcttctgtgacattgcaccctggatcaccctggcttgtaccagcacacaggccgtggaactcgtggcctttgtgattgcttttgtggtcatcctgagttcatgcctcatcaccttggtctcctacatctatatcatcagcacaattctcaggatcccttcggccagcagcaggagcaaagccttctccacatgctcttcacatctcactgtggtgctcatctggtatgggtccaccatctttcttcatgtccgcctctccatcaaagagtccttggacctgaccaaagccattcatgtcctgaacactgtggtgactccagttctaaatcccttcatctacactctccgtaataaagaagtaagggaaactctgctgaagaagtggaaggggaattaa

SEQ ID NO: 174 - protein, 308 aa, Canis familiaris
MGTDNATRHQDFLLLGFPGSQVLQLSLFMLFLVMYILTVGGNMAILMLVSTSHQLHTPMYFFLSNLSFLEIWYTTAAVPKALAILLGRSQTITFTGCLLQMYLVFSLGCTEYFLLAAMAYDRYLAICYPLHYGAIMNSLLSAQLALGSWLCGFLAISVPTALISTLSFCGSRTINHFFCDIAPWITLACTSTQAVELVAFVIAFVVILSSCLITLVSYIYIISTILRIPSASSRSKAFSTCSSHLTVVLIWYGSTIFLHVRLSIKESLDLTKAIHVLNTVVTPVLNPFIYTLRNKEVRETLLKKWKGN

SEQ ID NO: 175 - DNA, 945 bp, Canis familiaris
atgggtgggaccaatgagagcactcagggaaatttcatccttctggggttttctgatcgcccctacctggagaggatcctgtttgtggtcattctcattgcatatctcctgacccttgtgggcaacaccaccatcatcttggtgtcccggctggacccccacctccacactcccatgtacttctttctcactcacctatcgttcctggacctcggtttcaccaccagctccatccctcagttgttgtataacctgaatggacatgacaagaccatcagctacacaggctgtgccattcagctcttcctatttctgggtttgggtggtgtggagtgcctactcctggctgtcatggcatatgaccggtttgttgcagtctgcaaacccctccactacatggtgatcatgaatccgcgcctctgcgtgggcttggtgtcagtggcctggagctgtggggtggccaactccttggccatgtccccagtcactctgcacttaccccgctgtgggcatcgcagtgtggaccacttcctgtgtgaagtgcctgccctgatccggatggcttgtgtcaatacagctgccatcgagggcactatctttgtcctggcagtgggcattgtgctttcccccctggtgttcattctggtgtcttacagctatattatgagagctgtgttacacattcagtcagtatcaggaagacagaaggccttcaacacctgtggctcccatctcacagtggtctctcttttctatggaaacatcatctacatgtacatgcaaccaggaaacagctcttcccaggaccagggaaagttcctcactctcttctacaacattgtcacaccacttctgaaccccctgatctacaccctcagaaacaaggaagtgaaggtggctctgcagaggctcctgctgggtaaaagagaggtggggaagtgttga

SEQ ID NO: 176 - protein, 314 aa, Canis familiaris
MGGTNESTQGNFILLGFSDRPYLERILFVVILIAYLLTLVGNTTIILVSRLDPHLHTPMYFFLTHLSFLDLGFTTSSIPQLLYNLNGHDKTISYTGCAIQLFLFLGLGGVECLLLAVMAYDRFVAVCKPLHYMVIMNPRLCVGLVSVAWSCGVANSLAMSPVTLHLPRCGHRSVDHFLCEVPALIRMACVNTAAIEGTIFVLAVGIVLSPLVFILVSYSYIMRAVLHIQSVSGRQKAFNTCGSHLTVVSLFYGNIIYMYMQPGNSSSQDQGKFLTLFYNIVTPLLNPLIYTLRNKEVKVALQRLLLGKREVGKC

SEQ ID NO: 177 - DNA, 972 bp, Canis familiaris
atgaagcccccaaatgtgtccagtgtcactgagtttcagctcctggggttccagaaccttcttgaatggcagacgctgctctttcccattttcttgttcatctactttctcacagtcacagggaatgttgtcattattgcagtggtgagcgaggaccagcaactacactcacccatgtacgtatttctcaaacatctctcctttctggagatctggtatacatccaccattgtgccccttctcctagccaacctactctgccatggccaagccatctccttccctgcgtgtatgatgcagctttacttctttgtgttctttggggctaccgaatgctttcttctggctatgatggcctatgaccgatatctggccatctgcaacccactccactactctttcctgatgagtcctgaaatctgcaccaagttggtggcaatctcctggttgacaggtgttggaacaggatttctgccctcgctaatgatttccaagttggatttctgtggtcctaacgagatcaatcatttcttctgtgacctcccacccctcatgcagctctcatgttccagtgtgtttatcaccaggatggtcatctttatcctgtcaattgcagtgctgtgcatttgcttttttcttactctcatatcctatgttttcattgtatctaccatattgagaattccttcagcctctggccagatgaagaccttttccacatgtggctcccatttggctgttgtcactatctactatgggaccatgatctccatgtatgttcgccccaatgaccacttatcacctgaaattagtaagatcatttctgtcttctacactgtggtcaccccattgctgaaccctgtcatctacagcttgaggaaccaagaattcaaagacgctgttagaagagtcataagaaaaaagtgtggtatctatggagtaagattgaaggggagtttctgtgttaggtaa

SEQ ID NO: 178 - protein, 323 aa, Canis familiaris
MKPPNVSSVTEFQLLGFQNLLEWQTLLFPIFLFIYFLTVTGNVVIIAVVSEDQQLHSPMYVFLKHLSFLEIWYTSTIVPLLLANLLCHGQAISFPACMMQLYFFVFFGATECFLLAMMAYDRYLAICNPLHYSFLMSPEICTKLVAISWLTGVGTGFLPSLMISKLDFCGPNEINHFFCDLPPLMQLSCSSVFITRMVIFILSIAVLCICFFLTLISYVFIVSTILRIPSASGQMKTFSTCGSHLAVVTIYYGTMISMYVRPNDHLSPEISKIISVFYTVVTPLLNPVIYSLRNQEFKDAVRRVIRKKCGIYGVRLKGSFCVR

SEQ ID NO: 179 - DNA, 708 bp, Canis familiaris
acaatcatgacagaattcatccttcttggttttcacatgaaaatcttgatcttattgacattcctgattatgtatgtgctgacagttttaagtaattctacaatcatcctactggtgtggaattgtaatcaccttcactcatccacgtatttgttccttgcacacctctcctttctaaaaatcatggtcacttctgtgacacctaaaatgttggccgctacaatttcacaaatgaataccatatcatgtatcacccaatatttcttttattttctctttaggactgtagagttcttcattctggcaattatgtcatatgatggctatgttgccatctgtattcctctgagataccccatcatcatgagaactcaggtctgcctaaagatgataatggcctcttgggtgagagggttaatctatatattatcgccttctgctgtaaccctaaaatttccattctgtggtcccaatgtcacagaccactttttctgtgacacttctcccatgttgaaactggtgtttggtgatctctgcatggtggagatgattcattttatctgttctgcagttccccttctgacctctcttttctttattctgactcctcatatcttcattgtgtttaccatcgtcagaatgccctctacccagggacagtggaaagctttctccacttgtgcttctcacattattgttgtcactatt

SEQ ID NO: 180 - protein, 236 aa, Canis familiaris
TIMTEFILLGFHMKILILLTFLIMYVLTVLSNSTIILLVWNCNHLHSSTYLFLAHLSFLKIMVTSVTPKMLAATISQMNTISCITQYFFYFLFRTVEFFILAIMSYDGYVAICIPLRYPIIMRTQVCLKMIMASWVRGLIYILSPSAVTLKFPFCGPNVTDHFFCDTSPMLKLVFGDLCMVEMIHFICSAVPLLTSLFFILTPHIFIVFTIVRMPSTQGQWKAFSTCASHIIVVTI

SEQ ID NO: 181 - DNA, 720 bp, Canis familiaris
ttcagaatgagaaagaaatagaaattcctctttttttctgcattcctgctcatgtacatgacatttctgattggcaacaccatgatcatccttttggtgtgtggtgactaccatctgcattcactcatgtatttctttgtggccaatctttctttccttgaagttgccatcacctccacagtggtacctaagatgctagctaacacatttcccctcaccaaggcaatatcctttatggggtatctcacacaatcttttttctatttccttctggaatccacagagttcttcatcctggctgtcatgtcatttgattgatctattgccatctacaacccactgaggtatgccgtaatcatgaacaaacagacatgcataatgttacttctgggatcctatgtaggtgcatttttgtcaattttagcatcatccatcttaactgctcctctgctcttttgtgggccaaatataatcaatcactttttttgtgacagtggccctgtgctaaagctggtctgtgcagatatctctctggctgaattggctgattttatatcctctgctgtgttgctcttgggctccctgctcctgacaggagtgtcttacatgtacattatcattacaatccttagaattccctctgtccagggacgactgaaggctttctccacctgtgtttcacacatcactgtagtgacactgtattctggaagttccatc

SEQ ID NO: 182 - protein, 121 aa, Canis familiaris
MNKQTCIMLLLGSYVGAFLSILASSILTAPLLFCGPNIINHFFCDSGPVLKLVCADISLAELADFISSAVLLLGSLLLTGVSYMYIIITILRIPSVQGRLKAFSTCVSHITVVTLYSGSSI

SEQ ID NO: 183 - DNA, 828 bp, Canis familiaris
agaaacaagactagagtcactgaagtcattcttctgggatttcagaatgagaaagaaatagaaattcctttttctgcattcctgctcatgtacatgacatctctgattggcaacaccatgatcatccttttggtgtgtggtgattactgtctgcattcaaccatgtatttctttgtggccaatctttctttccttgaacttgccatcacttccacagtggtacctaagatgctagctaacacatttcccctcaccaaggcaatatcctttgtgggatgtcttacacaatctatcttctactttcttatgggatccacagagttcttcatcctggctgtcatgttatttgatcaatctattgccatctgcaacccactgaggtatgccatcatcatgaacaaatagacatgcataatgttacttctgggatcctatgttggtgcatttttgtcaatgttggtgccatctatcttaactgctccattagtcttttgtgggccaaataaaatccatcattttttctgtgacagaggccctatgctatagctggcctgtacaggtatctctctggctgaattggctgactttatctcctctgctgtgttgctctaaggctccctgctcctgacggagtgtcttacacttatattgttatcactatcctttagaattccttttgtctagggatggcagaaagccttctctacttctgtttcacatatcacagtggtcacactttattatgggagctccgtcttcctctatgttcatccaaagaaaggcagtgcactaaatattaacaaatttgccacagtgctgaacaccatt

SEQ ID NO: 184 - protein, 134 aa, Canis familiaris
RNKTRVTEVILLGFQNEKEIEIPFSAFLLMYMTSLIGNTMIILLVCGDYCLHSTMYFFVANLSFLELAITSTVVPKMLANTFPLTKAISFVGCLTQSIFYFLMGSTEFFILAVMLFDQSIAICNPLRYAIIMNK

SEQ ID NO: 185 - DNA, 936 bp, Canis familiaris
atggtgggtggaaatgaatcctcagtaactgacttcatccttgtgggactctttcctgaatttcagcattctattgttctcaaccttgtgatcatcttcatctacatctttgccttcctgggaaacatacttctgattgtcttgatttggggagactctcagcttcatacgcccatgtacattctcctcagtcaactctccctcattgacttgacattaacttccaccattgttccaaagatggcttctaattttttcacaggggaaaggacaatatcatggattggttgtggaacacagagtttcttcttcctgatgttgggaatgtcagagtgccttattttgactctcatggcttatgaccgctatgtggctgtctgcaacccattgcgctatcccattatcatgagccctcgggtctgtatgcacatgatttttgggtgttggattggaggctctgtaagttcatttatccatacagtctaccctatgcattttcccatctgtggatcacgggagatccaccactacttctgtgaggtcccagtcctaattaagctctcctgtgaagacacttcattgtatcagttggtggtggttgtgacaagcattgtgttgcttgttgtacctttcagtctcatcactgtttcctatactctcatcttcctcactgtctttcgtatgaactctgtcaaaggcaggaaaaaaactctggccacctgctcttcccatctaactgtggtgagtctcttctttggcccaaacatatttatctatatgtctttcacttcctcccacagtgcggagcaggaccaagctctttctgtattcagcaatattctaacacccatgttgaaccctctcatttacagcctgaggaacaaagaggtggtggcagctctcaggaagcttatggggaaatgtgtgacatcttag

SEQ ID NO: 186 - protein, 311 aa, Canis familiaris
MVGGNESSVTDFILVGLFPEFQHSIVLNLVIIFIYIFAFLGNILLIVLIWGDSQLHTPMYILLSQLSLIDLTLTSTIVPKMASNFFTGERTISWIGCGTQSFFFLMLGMSECLILTLMAYDRYVAVCNPLRYPIIMSPRVCMHMIFGCWIGGSVSSFIHTVYPMHFPICGSREIHHYFCEVPVLIKLSCEDTSLYQLVVVVTSIVLLVVPFSLITVSYTLIFLTVFRMNSVKGRKKTLATCSSHLTVVSLFFGPNIFIYMSFTSSHSAEQDQALSVFSNILTPMLNPLIYSLRNKEVVAALRKLMGKCVTS

SEQ ID NO: 187 - DNA, 939 bp, Canis familiaris
atgagaagtaggaatgaaacagaatccacagacttcattctcctgggcttcttccctgaatttaaacacatcacagccgtggtctccatcattcttctgatctacatggccgccttcactggcaacactcttctgatcatcctcatttggttgtattcccatctccacacccccatgtacttcctgctcagtcagctctccttaatggacttgactttgacctctagcattgtccccaagatggtggccaacttcttctctggttggcggaacatatcattcctggcttgtgggactcaaattttcttctccctgactgtggccattgcagaatgcatccttataactctcatgtgctttgatcgttacgtggctatatgtgatcctctgcggtacccagttatcatcaatcctagagtttgcttacggatgattgccatgtcttgggctggaggggcacttacttctctgggtcacactgtttttaccttacattttaatatctgcaaccctagagagattccccacttcttctgcgaagtcatggctgtgcttaggatcgtctgtgaggatatctcagcctatgagaaggcagtggtgataacaagcatccttgttctgcttctgccattatctctcattttgtcttcctatgttctcatactccttgctgtactccgaatgaactccccagagggcaggaacaaggctctagccacctgctcctctcacctctgtgtggtgggtctctattttggtccaggtatgtgcatctacatgagacctggttctgccaagactccaaagttgaatcagggtctctttctatttggaactgtcctcactccactcctaaaccctcttgcctatagtctcaggaacaaggatgttctaagtgcactgaaaaagttaatggggaggtatcagtcctcaaagtaa

SEQ ID NO: 188 - protein, 312 aa, Canis familiaris
MRSRNETESTDFILLGFFPEFKHITAVVSIILLIYMAAFTGNTLLIILIWLYSHLHTPMYFLLSQLSLMDLTLTSSIVPKMVANFFSGWRNISFLACGTQIFFSLTVAIAECILITLMCFDRYVAICDPLRYPVIINPRVCLRMIAMSWAGGALTSLGHTVFTLHFNICNPREIPHFFCEVMAVLRIVCEDISAYEKAVVITSILVLLLPLSLILSSYVLILLAVLRMNSPEGRNKALATCSSHLCVVGLYFGPGMCIYMRPGSAKTPKLNQGLFLFGTVLTPLLNPLAYSLRNKDVLSALKKLMGRYQSSK

SEQ ID NO: 189 - DNA, 969 bp, Canis familiaris
atggagagaaacaataagaccatcaccacagattttatcctcttggggctctggcctgagtttagccaccttgcggtccttatctgcttcattcttatggtttaccttatggctgtaatgggcaatgctgttctcattctcctcatctggttggattctcgactccactctcctatgtacttcttgctcagccagctctcccttattgatgtggccttgatctcaactacagtccccaaaatggtcaccaacttcttctcagggaaaaggaccatatcacagattggctgtggagctcagattttattcagcttaaccttgggaatttctgagtgccttctactgactctcatgtcctatgaccgctacattgccatctgcaatccactacgttactcaatcttgatgagccataccacctgtaaacagatggttgttgggtcctgggcaggaggggcaataacttccctggttcatacagcctatgtcatgcacttagccatctgtcatcctcgagagatcccacacttcttgtgtgaggtcatggcactccttaagctcacttgtgaggacatttcagcctatgtgaagtcagtggtggtctcaagctttctggtggtcctcatccctctgagtctcatcctggcttcctacatccacatatttcttgctgtcctccgcatgaactcccttgaaggtaaaaacaaggccttggccacatgcttctcccacctctgtgtggtcagtctctactttggccctgccatattagtctatatgaggccaggatcctttaaaactcccaaaataaaccagtccctttttatgtttaatgccattcttactcctatgcttaatcccctcatctatagcctgagaaacaaggatgtcatagcagctctgaagagtataatcatcagtagaatcctcctaaaaaagatgaaaagacagctaggttgccatacataa

SEQ ID NO: 190 - protein, 322 aa, Canis familiaris
MERNNKTITTDFILLGLWPEFSHLAVLICFILMVYLMAVMGNAVLILLIWLDSRLHSPMYFLLSQLSLIDVALISTTVPKMVTNFFSGKRTISQIGCGAQILFSLTLGISECLLLTLMSYDRYIAICNPLRYSILMSHTTCKQMVVGSWAGGAITSLVHTAYVMHLAICHPREIPHFLCEVMALLKLTCEDISAYVKSVVVSSFLVVLIPLSLILASYIHIFLAVLRMNSLEGKNKALATCFSHLCVVSLYFGPAILVYMRPGSFKTPKINQSLFMFNAILTPMLNPLIYSLRNKDVIAALKSIIISRILLKKMKRQLGCHT

SEQ ID NO: 191 - DNA, 960 bp, Canis familiaris
atggagatacgaaatgagacattgagcacagacttcattctcctgggccttttctctggaatgaaacataccagacttcttgtctctgttgtcctcctcatctacaccattgctatcacaggaaacaccactttgatcttccttatctgggtggatccccatctccacacctccatgtatttcctgcttagccaactctctctcattgacctggctttcatctctagcatagtcccaaaaatgatggttaattttttctcaggaaagaagaatatttccctggttggctgtgggacccagatcttcttcactttgactctggggattgctgagtgcctactcttgaccctcatggcttatgaccgctatgtggccatctgcaatcctctcaagtactcaattattatcagccctcgggtctcccagagaatggccattgggtcctgggtgggagggactctagcatccctggcccacacagcctatgccatgcattttcccctctgtggcccccgggaactccacaacttcttctgtgaggtcaaagccattttgaagctgtcttgtgaggacatctcagcctatgagaaaggagtagtagtgactagtattgtggtggttcttctcccagtaagcttcatcttgacctcctatatcctcatcttccttcaggtcctgcgaataaactcccatgagggaaggataaaggctctggctacctgttcttcccatctgactgtggtcatcttttactatggtccagccatgctaatatatatgaggcctggatcttcccacacccccattctgaaccaggctctctttatgtttgacaccgtccttactcccatgctgaaccctatcatctacagtctaaggaacagggaggttgtagactcaatgaagaaggtaatggggaagttttccattcaaaataggtttgcacgtttcaatgaatag

SEQ ID NO: 192 - protein, 319 aa, Canis familiaris
MEIRNETLSTDFILLGLFSGMKHTRLLVSVVLLIYTIAITGNTTLIFLIWVDPHLHTSMYFLLSQLSLIDLAFISSIVPKMMVNFFSGKKNISLVGCGTQIFFTLTLGIAECLLLTLMAYDRYVAICNPLKYSIIISPRVSQRMAIGSWVGGTLASLAHTAYAMHFPLCGPRELHNFFCEVKAILKLSCEDISAYEKGVVVTSIVVVLLPVSFILTSYILIFLQVLRINSHEGRIKALATCSSHLTVVIFYYGPAMLIYMRPGSSHTPILNQALFMFDTVLTPMLNPIIYSLRNREVVDSMKKVMGKFSIQNRFARFNE

SEQ ID NO: 193 - DNA, 819 bp, Canis familiaris
gaccaaggaaatggatcctccaccacaggtttcattcttgtgggatttttctctgactttcggcatcctaaactcctcatctccattgtccatctgattcctggggtggccatccacaggatattccaacctggcactgctgatccagggtgatgcttgcctctacacccccatatacttcctgctcagacagctctttttcatggacataaagttagtcctcaccactctcatcaaatggccaccaacttctctggatatagatacatctgtcacattggctgtagagtccaaacctttctttctttgaagataggagtatctgaatgtgttgtcctgagtcttatggcctttgaccactatcacgccatctgtagtgtgctcagatacctggctatcatgacactctgaaactgtaagcaaatggccattggttcatgggctatcagtatgctcatctccttaatgtacacaaattatggcatgcacttctctgcttgtggccccaggaaaactgaccacttctgtgaagttctcattcttctcatcccttttgtactcattctgacatcctacatactcatttatcttactgttctctatgtaaatttccctgagagcaaaaacaaagctctagctacctgcttatcccatcttggtgtggtaagtctctactttggtccaaccatgcttatctacatgactccaggtttctctcttctcccagaggtggaccagcatctctttgtgtctggtgtaatcattatcccaatgcttaaccccctcatctacagcctgaggaacaaggagatgttgggg

SEQ ID NO: 194 - protein, 132 aa, Canis familiaris
MAIGSWAISMLISLMYTNYGMHFSACGPRKTDHFCEVLILLIPFVLILTSYILIYLTVLYVNFPESKNKALATCLSHLGVVSLYFGPTMLIYMTPGFSLLPEVDQHLFVSGVIIIPMLNPLIYSLRNKEMLG

SEQ ID NO: 195 - DNA, 924 bp, Canis familiaris
atgaataagagcattgtaacggaatttttgattctgggcttcacccaaaaacctgaactgcaaagagctctcttcattgtctttctcctcatctaccttgtggccttacttggcaatgcactgattgtcattgccataatctgtaacaccaccttgcatacacccatgtatgttttccttctggcactggctattgtggatatcatctgcacaacaagcattatacccaagatgctggggaccatgctaacaacgggaaggagtatttcctatgaaagctgcatgtcacagctcttcttcttcacgtggtccctgggggccgagatggttctcttcaccacaatggcctatgaccgctatgtggccatctgtttccctcttcgctacagaactatgatgaacccccatatgtgtgtggccttgcttggcattaccatggtgattgctgtaaccaattcctgggtacacactggtcttatcctgaggctgactttctgtgggccaaatatcattgaccacttcttctgtgagatacctccacttctgtctttgtcctgcagccctgtgaggatcaatgaggtgatggtgtatgttgctgatattaccctggccataggtgacttcacgctcacctgcatctcctatggtttcatcattgctgccattctccgcatccacacggcagaaggcaagaggaaggctttctcaacatgttcatcccacctcatagtggtgtccctttactactctcctgtgatctacacctatatccgccctgcttctagctactcatttgaaagggacaaggtgataactgcactctatactctcgtgaccccaacattaaacccaattgtgtatagtttccgaaataaggagatgcagacagggattcagaaggtatttgcatttctgagacattag

SEQ ID NO: 196 - protein, 307 aa, Canis familiaris
MNKSIVTEFLILGFTQKPELQRALFIVFLLIYLVALLGNALIVIAIICNTTLHTPMYVFLLALAIVDIICTTSIIPKMLGTMLTTGRSISYESCMSQLFFFTWSLGAEMVLFTTMAYDRYVAICFPLRYRTMMNPHMCVALLGITMVIAVTNSWVHTGLILRLTFCGPNIIDHFFCEIPPLLSLSCSPVRINEVMVYVADITLAIGDFTLTCISYGFIIAAILRIHTAEGKRKAFSTCSSHLIVVSLYYSPVIYTYIRPASSYSFERDKVITALYTLVTPTLNPIVYSFRNKEMQTGIQKVFAFLRH

SEQ ID NO: 197 - DNA, 939 bp, Canis familiaris
atggataaaagaaatgagtcttcaagtacagattttatcctcttgggcctctttcctggtataaaacacatcaacctccttgtctctgtcatccttctgatctacactgtagctctcaccacaaattccatccttatacttctgatctgggtggattctcacctccatacacccatgtactttctgcttagccaactggctctcatggacctgacattaatctctagcactgtacccaagatggcaagtgacttcttctcagtgaagaggactatatcacaggtggcctgtggtactcagatatttttcttcctgactgtaggaattgctgagtgtattatcataacccttatggcctttgaccgttatgtggccatctgcaaacctctgagatataccctgatcatgagccagaaagtatgtctgcaaatggctactgtctcctgggctggaggtgcccttatatcactcatgcacacagcatatgctatgcatttccccatctgcggttccagagagatttcccatttcctctgcgaggtcatggctatcctaaaattggcctgtgaggacatctctgcctatgagaaggctgtagtaatgacaagcattgtggtgctcctcatccctttgtcctttatcctgtcttcttatactctcatcttcctttccgtcctccgcatgaactccctggagggcaggaataaagccctggccacatgttcttcccacctgactgtggtgagcctctactttggtccagcgatgctggtttacatgaggcccagttcttaccacagtcccaagctggaccaggttctctttatgcttggtgccatcctcacccccatgatgaacccccttatatatagtctgaggaacaaggaggtagtgggtgttctgagaaacatgttgggaagctgcctaacctcacattag

SEQ ID NO: 198 - protein, 312 aa, Canis familiaris
MDKRNESSSTDFILLGLFPGIKHINLLVSVILLIYTVALTTNSILILLIWVDSHLHTPMYFLLSQLALMDLTLISSTVPKMASDFFSVKRTISQVACGTQIFFFLTVGIAECIIITLMAFDRYVAICKPLRYTLIMSQKVCLQMATVSWAGGALISLMHTAYAMHFPICGSREISHFLCEVMAILKLACEDISAYEKAVVMTSIVVLLIPLSFILSSYTLIFLSVLRMNSLEGRNKALATCSSHLTVVSLYFGPAMLVYMRPSSYHSPKLDQVLFMLGAILTPMMNPLIYSLRNKEVVGVLRNMLGSCLTSH

SEQ ID NO: 199 - DNA, 948 bp, Canis familiaris
atgaaaattatggaaaattacaaccaaacattaacagatttccttttattggggttgtttccatcatcaagaattggcctctttcttttcattctcatagtatttattttcttaatggctctttttggcaacctgtccatgatcatcctcatcatcgtggacactcatctccacacacccatgtattttctacttagccagctctccctcatggacctaaactacatctccaccattgtcccaaagatggtttctgattatctctttggaaacaagtccatctcacttattggttgtgaagttcagagcttcttcttcttgactttagcagttgcagaagcactactcttgacatctatggcttatgatcgttacgtggctatttgctttcctcttcactatcccattcgcatgagcaaaaaattgtgtgtgctgatgataacaggatcttggacaattggctctatcaactcctgtgctcacactgcatatgccttccatataccttactgtcgatccagaactatcaaccatttcttctgtgatgtcccagccatgttgacgttggcctgcatggacacctgggtctatgagtacacagtgtttgtaagcaccacactcttgattgtgtttcctttcattggcattgcatgctcctatggccaggtcctccttgccatctgccgcatgcaatcaacagaagggaggaagaaagcttattccacctgcagcactcacctcactgtggtgactttctactatgcaccctttgcttacacttatctacgcccaagatccctccgaaccccaacagaggacaaggctctagctgttctctacaccattctgaccccaatgctcaaccccatcatctacagcctgagaaacaaggaggtgataggggccctgagacgattgattcagaagatcagctttgtaaaaatgtag

SEQ ID NO: 200 - protein, 315 aa, Canis familiaris
MKIMENYNQTLTDFLLLGLFPSSRIGLFLFILIVFIFLMALFGNLSMIILIIVDTHLHTPMYFLLSQLSLMDLNYISTIVPKMVSDYLFGNKSISLIGCEVQSFFFLTLAVAEALLLTSMAYDRYVAICFPLHYPIRMSKKLCVLMITGSWTIGSINSCAHTAYAFHIPYCRSRTINHFFCDVPAMLTLACMDTWVYEYTVFVSTTLLIVFPFIGIACSYGQVLLAICRMQSTEGRKKAYSTCSTHLTVVTFYYAPFAYTYLRPRSLRTPTEDKALAVLYTILTPMLNPIIYSLRNKEVIGALRRLIQKISFVKM

SEQ ID NO: 201 - DNA, 939 bp, Canis familiaris
atggaaaataataacccaaattctacagatttcttcctattggggttatttccaccatcaagaattggcctgttcttcttcattctcattgttttcattttcttaatggcgctttttggcaacttgtgcatgatcatcctcatcttcctagacacccatctccacacacccatgtattttctacttagtcagctctccctcatggacctgagctacatctccaccattgtccctgagatggcttctaattatctctctgaaaacaagtctatttctttcattggttgtggggttcagagcttcttcttcctgactttagcaggtggagaaggattaatattggcctcaatggcctatgatcgttatgtggctatttgctttcctctccactatgccattcgtatgagcaaaagagtgtgtgtgctgatgataacaggatcttggataatgggctcaatcaactcctgtgcccacactgcatatgccctcaatataccttactgtcaatccagagccattaaccatttcttctgtgatgtcccagccatgttgacattggcctgcatggacacctggatctatgagtacacagtgtttgtaagcaccacactcttgattgtgtttcctttcattggcattgcatgctcctatggccgggtcctccttgccatttgccgcatgcaatcaacagaagggaggaagaaagcctattccacctgcagcactcacctcactgtggtgactttctactatgcacccttcgcttacacttatctacgcccgagatccctccgaagtccgacagaagacaaggctctagctgtcttctacaccatcctaactccaatgctcaatcccatcatctacagcatgagaaataaggaggtaatgggggccttgagacgactgattcagaggatcagctctgaaaagatgtag

SEQ ID NO: 202 - protein, 312 aa, Canis familiaris
MENNNPNSTDFFLLGLFPPSRIGLFFFILIVFIFLMALFGNLCMIILIFLDTHLHTPMYFLLSQLSLMDLSYISTIVPEMASNYLSENKSISFIGCGVQSFFFLTLAGGEGLILASMAYDRYVAICFPLHYAIRMSKRVCVLMITGSWIMGSINSCAHTAYALNIPYCQSRAINHFFCDVPAMLTLACMDTWIYEYTVFVSTTLLIVFPFIGIACSYGRVLLAICRMQSTEGRKKAYSTCSTHLTVVTFYYAPFAYTYLRPRSLRSPTEDKALAVFYTILTPMLNPIIYSMRNKEVMGALRRLIQRISSEKM

SEQ ID NO: 203 - DNA, 852 bp, Canis familiaris
atagatacattcctctttgttgccattgtaatcctcttttccatggctctgatggggaacatcatactggtccttctcattcaggtggacaccagactccacactccaatgtactttctactcagccagctctcctttatcgatatcatgtacatctccacaacagtgcccaagatgaccactaacttcttatcaaacagtaaacataaacagtaaacattattaggctttgagattcaaacctttgtattcttggcccttggtgggactgaagccctcctccttggtttcatgtcctatgatagatatgcatctatctgtcatcctttacattatcttgttctcatgagcaagaagacctgttggttcatgatcgcaagtgcatgggccagtagttctaccaaagttttagtgcatacactgtatgtatttcaactttggttctgtaggttttggatcattaaccactttttctgtgaaattccataacttttgccattggtctgtcaggatacttcccagtatgagtgtacaggcctcctcagtgtgcttatcattctgctgctaccattcatggccattctggcttcctatgcctgaatacttactattgtgttccagatgagctcaggtaaaggacagataaaagctgtctccacttgctcctctcacctgattgtggcaagcctattttatagaactactctctccacctatacaaggcctcactccatgcattctccagaacaggataaggcaggggtggtgttttatgccatcatcacacctcttctgaacccacttatctatagcctgaggaataaagaggtgatcagggccatagaaagaatg

SEQ ID NO: 204 - protein, 77 aa, Canis familiaris
MSSGKGQIKAVSTCSSHLIVASLFYRTTLSTYTRPHSMHSPEQDKAGVVFYAIITPLLNPLIYSLRNKEVIRAIERM

SEQ ID NO: 205 - DNA, 939 bp, Canis familiaris
atgaacatctggaacaccacctcagatttcattctcctgggactctttaactacacagaagcccacctatttctctttgtgatgattctgacaattgccttcagctccctggtgggcaatgccctcatgattctcctgattcaccaagatttccagctccacacacccatgtacttcctactgagtcaactctccctcatggacatgatgctgatctccaccattgtgcccaaaatggcagctgactacttgagtggcaagaagtccatctcccctgctggctgtgggcttcagatcttcttcttcatcactttggaagggagcgagtgcttcctcttagcatccatgtcctatgaccgctatgtggctgtttgccacccactgaggtaccccgttctcatgagctggcaattatgcctgagaatgaccgtggggtcctggtccctgggggcagctgatgggctcatgcaggctgctgccaccctgagttttccattctgtgatgcacatgagatcaatcatttcttctgtgaggcccccactctggtgcgtttggcttgtgctgacacgtttgtttttgagtatgtcatgtatatctgctgtgtattaatgctgctggttccgttttctctcatcctgatttcctatagtctcatccttgctgtggttctccagatgcgttctagagaagcccgcaagaaagcttttgccacctgctcctcacatctgactgtggtgggactcttttatggagcagctatttttatttacatgagacccaaatcctacaggtcagctaaccacgataaagtggtgtcagccttctatactatcttcaccccagtgctgaaccccattatctacagtcttagaaacagtgaagtcaaaggagccctgagaaagtgtatgggtcaatgtgctaccataaatcatgagtaa

SEQ ID NO: 206 - protein, 312 aa, Canis familiaris
MNIWNTTSDFILLGLFNYTEAHLFLFVMILTIAFSSLVGNALMILLIHQDFQLHTPMYFLLSQLSLMDMMLISTIVPKMAADYLSGKKSISPAGCGLQIFFFITLEGSECFLLASMSYDRYVAVCHPLRYPVLMSWQLCLRMTVGSWSLGAADGLMQAAATLSFPFCDAHEINHFFCEAPTLVRLACADTFVFEYVMYICCVLMLLVPFSLILISYSLILAVVLQMRSREARKKAFATCSSHLTVVGLFYGAAIFIYMRPKSYRSANHDKVVSAFYTIFTPVLNPIIYSLRNSEVKGALRKCMGQCATINHE

SEQ ID NO: 207 - DNA, 939 bp, Canis familiaris
atgaaaattgggaactccacctcagatttcattctcctgggactctttaactacacagaagcccacctgtttctctttgtgatggttctgacaattgctttcagctccctggtgggcaatgccctcatgattctcctgattcaccaggatgtccggctccacacacctatgtacttcctactgagtcaactctccctcatggacatgatgctgatctccaccattgtgcccaaaatggcagctgactacttgagtggcaagaagtccatctcccctgctggctgcgggttgcagatatttttcttccttactttggcagggggcgagtgcttcctcttagcagccatgtcctatgaccgctatgtggctgtttgccacccactgaggtaccccattctcatgagctggcaattatgcctgagaatgacagtggggtcctggtgcttgggggcagctgatgggctcatgcaggctgctgccaccctgagttttccattctgtgatgcacatgagatcaatcatttcttctgtgaggcccccactctggtgcgtttggcttgtgctgacacgtttgtttttgagtatgtcatgtatatctgctgtgtattaatgctgctggttccgttttctctcatcctgatttcctatagtctcatccttgctgtggttctccagatgcgttctagagaagcccgcaagaaggctttctccacctgctcctcacatctgactgtggtgggactcttttatggagcagctatttttatttacatgagacccaaatcctacaggtcagctaaccacgataaagtggtgtcagccttctatactatcttcaccccagtgctgaaccccattatctacagtcttagaaacagtgaagtcaaaggagccctgagaaagtgtatgggtcaatgtgctaccataaatcatgagtaa

SEQ ID NO: 208 - protein, 312 aa, Canis familiaris
MKIGNSTSDFILLGLFNYTEAHLFLFVMVLTIAFSSLVGNALMILLIHQDVRLHTPMYFLLSQLSLMDMMLISTIVPKMAADYLSGKKSISPAGCGLQIFFFLTLAGGECFLLAAMSYDRYVAVCHPLRYPILMSWQLCLRMTVGSWCLGAADGLMQAAATLSFPFCDAHEINHFFCEAPTLVRLACADTFVFEYVMYICCVLMLLVPFSLILISYSLILAVVLQMRSREARKKAFSTCSSHLTVVGLFYGAAIFIYMRPKSYRSANHDKVVSAFYTIFTPVLNPIIYSLRNSEVKGALRKCMGQCATINHE

SEQ ID NO: 209 - DNA, 939 bp, Canis familiaris
atgaacatctggaacaacacctcagatttcattctcctaggactctttaactacacagaagcccacctgtttctctttgtgatggttctgacaattgctttcagctccctggtgggcaatgccctcatgattctcctgattcatcaggatgtccatctccacacacccatgtacttcctactgagtcaactctccctcatggacatgatgctgatctccaccattgtgcccaaaatggcagctgactacttgagtggcaagaagtccatctcccctgctggctgcgggttgcagatatttttcttccttactttggcagggggcgagtgcttcctcttagcagccatgtcctatgaccgctatgtggctgtttgccacccactgaggtaccccattctcatgagctggcaattatgcctgagaatgacagtggggtcctggttcttgggggcagctgatgggctcatgcaggctgctgccaccctgagttttccattctgtgatgcacatgagatcaatcatttcttctgtgaggcccccactctggtgcgtttggcttgtgctgacacgtttgtttttgagtatgtcatgtatatctgctgtgtattaatgctgctggttccgttttctctcatcctgatttcctatagtctcatccttgctgtggttctccagatgcgttctagagaagcccgcaagaaggctttctccacctgctcctcacatctgtctgtggtgggactcttttatggagctggcatttttacctacatgggacccaaatcctataggtcagctaaccacgataaaatagtgtcagtgttctatacaatctttactcctttattgaaccccctgatctacagtatgaggaatagtgaagtcaagggagccctgagaaagtgtatgggtcaatgtgctgccttaagtcataactga

SEQ ID NO: 210 - protein, 312 aa, Canis familiaris
MNIWNNTSDFILLGLFNYTEAHLFLFVMVLTIAFSSLVGNALMILLIHQDVHLHTPMYFLLSQLSLMDMMLISTIVPKMAADYLSGKKSISPAGCGLQIFFFLTLAGGECFLLAAMSYDRYVAVCHPLRYPILMSWQLCLRMTVGSWFLGAADGLMQAAATLSFPFCDAHEINHFFCEAPTLVRLACADTFVFEYVMYICCVLMLLVPFSLILISYSLILAVVLQMRSREARKKAFSTCSSHLSVVGLFYGAGIFTYMGPKSYRSANHDKIVSVFYTIFTPLLNPLIYSMRNSEVKGALRKCMGQCAALSHN

SEQ ID NO: 211 - DNA, 993 bp, Canis familiaris
atggagaaatggaatcaaacttcaaatgatttcattttgttggggttgtttccctcaaatcaaactggcctgcttctcttgtccctcattatcttcatcttcattgtcgcctcagtgggtaactcagccatgattcatctcatacgcttagatgcccggctccacaccacaatgtacttcctcctcagccagctctccctcatggacctaatgtatatctccaccactgtcccaaagatggcattcgacttcctgtctggccagaaaggtatctccttcctgggatgtggggtgcaaagcttcttcttcctgaccatggcatgttctgaaggtttactcttgtcctccatggcctatgaccgttatgtggccatctgccaccctctccagtatactgtccgcatgagtaaaaccgtgtgtgtgaaaatgatcataggatcttggattttggggtctatcaactccttggcacacactgtctatgccctccatattccttattgccggtccagggccattaatcacttcttctgtgatgtgccagccatgttggccttggcctgtatagacacctgggcctatgagtacatggtttttgtgagtacaagtctctttctcctctttcctttccttggcattactgcttcctatggatgggttctttttgctgtctaccacatgcgctcaaaagagggaaggaaaaaggccttcacaacctgctcaacacatttaactgtagtgacgttttactatgcaccttttgtgtacacctacctgcggcccaggaatctccgctcaccagcagaagataagatcctggcagtcttctacaccatcctcacccccatgctcaatcccattatctacagcctgaggaataaggaggttctgggggctatgacaagacagtttggaatattctctgccaagaaacaaaagtcatggctgtcctttcccttcttttccttttccaggttaattagaacatcctag

SEQ ID NO: 212 - protein, 330 aa, Canis familiaris
MEKWNQTSNDFILLGLFPSNQTGLLLLSLIIFIFIVASVGNSAMIHLIRLDARLHTTMYFLLSQLSLMDLMYISTTVPKMAFDFLSGQKGISFLGCGVQSFFFLTMACSEGLLLSSMAYDRYVAICHPLQYTVRMSKTVCVKMIIGSWILGSINSLAHTVYALHIPYCRSRAINHFFCDVPAMLALACIDTWAYEYMVFVSTSLFLLFPFLGITASYGWVLFAVYHMRSKEGRKKAFTTCSTHLTVVTFYYAPFVYTYLRPRNLRSPAEDKILAVFYTILTPMLNPIIYSLRNKEVLGAMTRQFGIFSAKKQKSWLSFPFFSFSRLIRTS

SEQ ID NO: 213 - DNA, 945 bp, Canis familiaris
atggagaagagcaacacaaccatagatttcattctcctaggactctttaatcacacaagatcccacctttttctcttcattgtggtgatgacaatagccattgcttccctgaatggaaatgccctcattcttctcctgattctcctggattcccggttccacacacctatgtacttcttactaagccaactctctctcatggacatgacgttggtctccaccattgtgcccaaaatggcagctgactacttgagtggcaagaagtccatatcccctgctggctgtggattgcagatctttgtctcactcacactgggcggtggagaaagtttcctcttagcatccatgtcctatgaccgctatgtggctgtttgccacccactgagataccctgttctcatgagctggcaattatgcctgagaatgactgtggggtcttggttccttggggcagctgatgggctcatgcaggctgctgccaccctgagttttccattttgcagggctaatgaaattgatcatttcttctgtgaggcccccatactggtgcgtttggcttgtgctgacacgtcagtctttgaaaatgtcatgtacatctgctgtgtgttaatgcttctggtccccttttccctcatcctgacttcctatagtctcatcctctcatctgttcttcagatgcgtactacagaagcccgcaagaaggctttctccacctgctcctcacatctctctgtggtgggactcttttatggagctgctatttttatttacatgagacccaaatcatacaggtcagataaccatgataaagtggtctcagccttctatacgattttcacccctgtgttgaaccccctcatctacagtctaaggaatagtgaagtcaagggagccttgaaaagatggttgaggaaatgtgcaaatgtaaaaccccagtacacttag

SEQ ID NO: 214 - protein, 314 aa, Canis familiaris
MEKSNTTIDFILLGLFNHTRSHLFLFIVVMTIAIASLNGNALILLLILLDSRFHTPMYFLLSQLSLMDMTLVSTIVPKMAADYLSGKKSISPAGCGLQIFVSLTLGGGESFLLASMSYDRYVAVCHPLRYPVLMSWQLCLRMTVGSWFLGAADGLMQAAATLSFPFCRANEIDHFFCEAPILVRLACADTSVFENVMYICCVLMLLVPFSLILTSYSLILSSVLQMRTTEARKKAFSTCSSHLSVVGLFYGAAIFIYMRPKSYRSDNHDKVVSAFYTIFTPVLNPLIYSLRNSEVKGALKRWLRKCANVKPQYT

SEQ ID NO: 215 - DNA, 939 bp, Canis familiaris
atgaacatctggaacaccacctcagatttcattctcctgggactctttcaccacacagaagcccacctttttctcttttcaatggttctgacaattgcttttggctccctcatgggcaatgccctcatgattctcctgattcaccaggatgtccggctccacacacccatgtacttcctactgagtcaactctccctcatggacatgatgctgatctccaccattgtgcccaaaatggcagctgactacttgagtggcaagaagtccatctcccctgctggctgtgggcttcagatcttcttcttcatcactttggaagggagcgagtgcttcctcttagcatccatgtcctatgaccgctatgtggctgtttgccacccactgaggtaccccgttctcatgagctggcaattatgcctgagaatgaccgtggggtcctggtccctgggggcagctgatgggctcatgcaggctgctgccaccctgagttttccattctgtggtgcacatgagatcaatcatttcttctgtgaggcccccactctggtgcgtttggcttgtgctgacacgtttgtttttgagtatgtcatgtatatctgctgtgtattaatgctgctggttccgttttctctcatcctgatttcctatagtctcatccttgctgcagttctccagatgcattctagagaagcccgcaagaaagcttttgccacctgctcctcacatctctctgtggtgggactcttttatggagctgctatttttatctacatgagacccaaatcctataggtcagctaaccatgataaaatagtgtcagtgttctatacgatcttcactcctttattgaaccccatcatctatagtatgaggaacagtgaagtcaagggagccttgagaaagtgtatgggtcaatgtgctgccttacatcataaataa

SEQ ID NO: 216 - protein, 312 aa, Canis familiaris
MNIWNTTSDFILLGLFHHTEAHLFLFSMVLTIAFGSLMGNALMILLIHQDVRLHTPMYFLLSQLSLMDMMLISTIVPKMAADYLSGKKSISPAGCGLQIFFFITLEGSECFLLASMSYDRYVAVCHPLRYPVLMSWQLCLRMTVGSWSLGAADGLMQAAATLSFPFCGAHEINHFFCEAPTLVRLACADTFVFEYVMYICCVLMLLVPFSLILISYSLILAAVLQMHSREARKKAFATCSSHLSVVGLFYGAAIFIYMRPKSYRSANHDKIVSVFYTIFTPLLNPIIYSMRNSEVKGALRKCMGQCAALHHK

SEQ ID NO: 217 - DNA, 855 bp, Canis familiaris
atggacacgttcctctttgtcgccattgtaatccttttttctgtagctctgatggagaacatcatactggtccttctaattcaggtggacaccagactccacactccaatgtactttctactcagccagctctcctttattgacatgatgtacatatccacgaccgtgcccaagttgaccactaacttcctgtcaaacagtaagaatattacatttttgggatgtgaaattcaagcctttgtattcttggcccttggtgggactgaagctcttctccttggtttcatgtcttatgatcgatatttagccatctgtcaccctttacgttatcctatccttatgagcaagaagatctgttggttcatggttacaagtgcatggaccagtagttctaccaatgctttagtacatacactgtatgtatttcaacttccattttgtaggtctcggattgttaaccactttttctgtgaagttccatctctattgccactggtgtgtcaggatacttcccagtatgagtatacaatcctcctgagtggggtaattattctgctgctaccattcttggacatcctagcttcctatgcccaagtacttactgttgtgttccagataagcttaggtaaaggacagacaaaagctgtctccacttgctcctctcacctgattgtagcaagcctattctatgtgactactctctctacttataccaggccacactccatgcattctccagaacaagataaagcagtggcagtgttttacaccatcatcacacctcttctgaacccatttatctatagcctgaggaataaagagtttactagggccatgagaagattgttggcataa

SEQ ID NO: 218 - protein, 284 aa, Canis familiaris
MDTFLFVAIVILFSVALMENIILVLLIQVDTRLHTPMYFLLSQLSFIDMMYISTTVPKLTTNFLSNSKNITFLGCEIQAFVFLALGGTEALLLGFMSYDRYLAICHPLRYPILMSKKICWFMVTSAWTSSSTNALVHTLYVFQLPFCRSRIVNHFFCEVPSLLPLVCQDTSQYEYTILLSGVIILLLPFLDILASYAQVLTVVFQISLGKGQTKAVSTCSSHLIVASLFYVTTLSTYTRPHSMHSPEQDKAVAVFYTIITPLLNPFIYSLRNKEFTRAMRRLLA

SEQ ID NO: 219 - DNA, 936 bp, Canis familiaris
atggcattggacaatcagacttttaactctgatttcatccttctgggaatcttcaattacagccccactcacatcttcctcttttctatgcttttggtcatcttcacagtggtcttcatgggaaacactgctatgattctcctcatctacctggacactcagctccacacacccatgtacttctttctcagccaactgtccctcatggacctcatgctcatctgcaccactgtacccaagatggcttttaactatttgtctggcagcaattccatttctgtggtagagtgtgctacacaaattttcctctatacatcactacttggctgtgaacgtttcctatgggcagtaatggcttatgaccgctatattgccatttgctaccctctaagatatcctaatcttatgagccctaaaatttgtggacttatggctgcatcttcctggatcctgggctctactgattgtatcattgatgctgtagctacatttttcttcttctattgtgggtcccgggaaatagaccacttctgtgattttccttccctgctcatcatctcatgcaacgacacatcaacatttgaagaagttcttttctactgctgtataataatgattgttttccctgtagtgatcatcattgcttcctatactcatgttattgtggctgtcattcacatagcatctggagagggtcaccagaaagtttttgccacctgctcttctcacctcatggtggtgggaatgtattatggcacaactttgttcatatacatgcggcccgcttctgatcgttcccccacccaggacaagatggtctctgtcttctacaccattctcactcccatgccgaatcccctcgtctacagcctccgcaacaaggaagtggctagagcagccatgaaggtgttggagaagggcaggtctggacagtaa

SEQ ID NO: 220 - protein, 311 aa, Canis familiaris
MALDNQTFNSDFILLGIFNYSPTHIFLFSMLLVIFTVVFMGNTAMILLIYLDTQLHTPMYFFLSQLSLMDLMLICTTVPKMAFNYLSGSNSISVVECATQIFLYTSLLGCERFLWAVMAYDRYIAICYPLRYPNLMSPKICGLMAASSWILGSTDCIIDAVATFFFFYCGSREIDHFCDFPSLLIISCNDTSTFEEVLFYCCIIMIVFPVVIIIASYTHVIVAVIHIASGEGHQKVFATCSSHLMVVGMYYGTTLFIYMRPASDRSPTQDKMVSVFYTILTPMPNPLVYSLRNKEVARAAMKVLEKGRSGQ

SEQ ID NO: 221 - DNA, 858 bp, Canis familiaris
tcccactcacatattttttttttctcactggtcttgggcatcttttcaatggccttcttgggaaacactgtcctggttcttcttgtctacctggacacccatctccacatctccatgtacttcctcctcagccagctctccctcatggacctcatgttcatctgcaccattgtacccaggcaggtggccttcaactacttgtctggcagcaagtcaatatctctggcagattgtggagctcagatattcttctatgtgtccctgcttggagctgaatgtttcctgttggttgtcatggcctatgaccattatgtgactatatgccacccactttgatacaccatcctcatgaatcaggaactctgtgtcctcatgactgttacttcctggatcttgggcttttttgatagcattattgtgctagtagcagccctgtcactgtctttctgtagctctccggaaattcatcactttttctgtgatgttgctgcccttttccctctatcttgcacagacacctctgcttttgaaaggctgcttttcctctgctgtgtggtgatgctaatattaccagtgtctgtgatcattacttcctattcatatgtccttcaagctgtcctccacatgagctctagagaaagtcacctcaaagccttcaccacctgttcctcccacctgactgtggttggactgtactatggtgctgctatgttcatgtatatgagaccagcttctaaccatacaccagaccatgacaagatagtatttatcttctacaccatcctcacccccatgctgaaccctctcatctacagtctccacaacaaagaggtatccaggggacttcagaaactgttg

SEQ ID NO: 222 - protein, 170 aa, Canis familiaris
MNQELCVLMTVTSWILGFFDSIIVLVAALSLSFCSSPEIHHFFCDVAALFPLSCTDTSAFERLLFLCCVVMLILPVSVIITSYSYVLQAVLHMSSRESHLKAFTTCSSHLTVVGLYYGAAMFMYMRPASNHTPDHDKIVFIFYTILTPMLNPLIYSLHNKEVSRGLQKLL

SEQ ID NO: 223 - DNA, 933 bp, Canis familiaris
atgtcaaattccaccataatgatgggatttctcctcacaaagttttctgatgtattggaactacaagttttttatgccataaccttctctataatgtatgtagtcactctgatggggaacattctcattgttactgtcaccacccttgacaggagtcttcacatagccatgtacttcttccttagaaatctgtccatcttggatgtctgctacatttttgtgacagttcctaactcatgtgtcaattctctgcttaacagcagcaccatttcaaaggctgggtgtgtagttcaggtcttcctagtggttttctttgtatatgtggagcttctgtttctatcagcttctgtttctatcatggcccatgactgtcatgtggctatctgccaacctcttcactaccctgtgatcatgaaccctcaaatctgcatccaaatgactctggcatccatactcagtggtctcatttatgcaggtgtgcacactggcaacacattccggctccccttttgtcaatcccatgttatccatcagttttcttgtgatattccctctcttctaaagctctcctgctctgacactttcagcaataagatgctgatctcatcttgtttcatctttatcatcagattttacattcacatattttctactgttctcaaatttccaggtggagcagacagaaaaaaggctttttctgcctctgtccctcacatcattgtggtgtctgtcttcctcagctcaggcttttttgtatatctgagaccatctgaaaactcttccataatgcaggacatgatcttttctgttttctattccataatccctccactcttcaaccctattatctacagtcttagaaatgaacaaataaaataagccattaataaaatgaagagaatgtttattcaggaaatgtacaggaaattgctg

SEQ ID NO: 224 - protein, 292 aa, Canis familiaris
MSNSTIMMGFLLTKFSDVLELQVFYAITFSIMYVVTLMGNILIVTVTTLDRSLHIAMYFFLRNLSILDVCYIFVTVPNSCVNSLLNSSTISKAGCVVQVFLVVFFVYVELLFLSASVSIMAHDCHVAICQPLHYPVIMNPQICIQMTLASILSGLIYAGVHTGNTFRLPFCQSHVIHQFSCDIPSLLKLSCSDTFSNKMLISSCFIFIIRFYIHIFSTVLKFPGGADRKKAFSASVPHIIVVSVFLSSGFFVYLRPSENSSIMQDMIFSVFYSIIPPLFNPIIYSLRNEQIK

SEQ ID NO: 225 - DNA, 936 bp, Canis familiaris
atggcatgggggaatcagaccttcaactcaggcttcatcctgctgggaatcttcaattacagccccacccacatcttcctcttctccctagtcttgggcatcttcacagtggccttcatgggaaacactgctatgattctcttcatctacctggacactcagctccatacacccatgtacttcctcctcagccagctctctctgatggacctcatgcttgtctgcaccactgtacccaagatggccttcaactatatgtctggcagcaagtccatttctttggctggctgtggagcccagattttcttctatgtgtccctgcttggagcagaatgtttcctgttggctacaatggcctatgaccgttacgttgccatttgtcacccattacgatactcagttctcatgaatcagaaaatctattgtgttatggttgtttcttcctggaccattggctttcttgatggtataattgtcattgcagttgcactttctttcccatattgtggagcccgggaaataccccactttttctgtgatgtccctgctcttctcactctctcatgtactactacattgctctttgaaaggttaatgtttatttgttgtataattatgcctctctttcctgtagcagtaatcattgcttcctatgttcatgttattgtggctgtcattcacatggggtctggagagggatgacaaaaagcttttgccacatgttcctcccacctcatggtggtgggaatgtattatggagcagctatgttcatatacatgcggcctgtttctgatcgttcccccacccaggacaagatggtgtcagccttctacacgatcctcactcccatgctgaatcccctcatctatagcctccgcaacaaggaagtatccagagcattcatgaagatgttggggaagagcaagtctggagag

SEQ ID NO: 226 - protein, 233 aa, Canis familiaris
MAWGNQTFNSGFILLGIFNYSPTHIFLFSLVLGIFTVAFMGNTAMILFIYLDTQLHTPMYFLLSQLSLMDLMLVCTTVPKMAFNYMSGSKSISLAGCGAQIFFYVSLLGAECFLLATMAYDRYVAICHPLRYSVLMNQKIYCVMVVSSWTIGFLDGIIVIAVALSFPYCGAREIPHFFCDVPALLTLSCTTTLLFERLMFICCIIMPLFPVAVIIASYVHVIVAVIHMGSGEG

SEQ ID NO: 227 - DNA, 927 bp, Canis familiaris
gcatgggagaaccagaccttcaactcaggcttcatcctgctgggaatcttcaattacagccccacccacatcttcctcttctccctagtcttgggcatcttcacagtggccttcatgggaaacactgctatgattctcctcatctatctggacactcagctccatacacccatgtacttcctcctcagccagctctctctgatggacctcatgcttgtctgcaccactgtacccaagatggccttcaactatatgtctggcagcaagtccatctctctggctggttgtggagctcagatattcttctatgtgtccctgcttggagcagaatgtttcctgttggctacaatggcctatgaccgttatgttgccatttgtcacccattacgatactcaattctcatgaaccagaaaatctgtggtcttatggcagcttgttcatggattcttggctcccttgatggtataattgaagttgcagttgctttgtcattctcatattgtggagcccgggaaataccccactttttttgtgatgtccctgcccttctcattctctcatgcaccaacacattgttatttgaaaggatgatatttatctgttgtgttattatgcttcttttccctgtagcagtaatcattgcttcctatgttcatgttattgtggctgtcattcacatggggtctggggagggatgccggaaagcttttgccacctgctcctctcatctcacagtggtgggaatgtattatggagcagccatgttcatatacatgcggcccacttcagatcgttcccccactcaggacaagatgatctctgccttctacaccatccttactcccatgctgaatcccctcatctacagcctccgcaacaaggaagtagtcagagcattcttgaagatgttagggaagggtaagtct

SEQ ID NO: 228 - protein, 309 aa, Canis familiaris
AWENQTFNSGFILLGIFNYSPTHIFLFSLVLGIFTVAFMGNTAMILLIYLDTQLHTPMYFLLSQLSLMDLMLVCTTVPKMAFNYMSGSKSISLAGCGAQIFFYVSLLGAECFLLATMAYDRYVAICHPLRYSILMNQKICGLMAACSWILGSLDGIIEVAVALSFSYCGAREIPHFFCDVPALLILSCTNTLLFERMIFICCVIMLLFPVAVIIASYVHVIVAVIHMGSGEGCRKAFATCSSHLTVVGMYYGAAMFIYMRPTSDRSPTQDKMISAFYTILTPMLNPLIYSLRNKEVVRAFLKMLGKGKS

SEQ ID NO: 229 - DNA, 963 bp, Canis familiaris
atgaaaaacatgaactggatggccaattacactggagagtctgatttcatcctggtgggaatcttcagtcaatcaaatcacccagctctcctgtgtgtggtcatttttgtagttttcttgatggctttaactgggaatgctgtcctgattcttctgatacattttgatgctcacctccacactcctatgtactttttcatcagccagttgtctctcatggatgtaatgtacatttctatcactgtgcccaagatgctcatagaccagatcatgggtataagtaatatatcagcccctgagtgtggaatgcaaatgtttctctatgtgacactagcgggttcagaatgttttcttctagccaccatggcctatgatcgctatatggccatctgccatcctcttcattaccctgtcctcatgaaccacagattgtgtcttctactggcatctggctgctggtttctgggatctgtggatggatttatgctcacgcccatcactatgacgttccctttctgcagatcccgggagatccatcatttcttctgtgaagtccctgctgtaatgaagctctcctgctcagatacctccctttatgagacagtcatgtacctgtgctgtgtcctcatgctcctcatccctgtgacagtcatttcaagctcctattatttcatcctcctcaccatccacaggatgaatttagcagagggtcagaagaaggcctttgccacttgttcttcccatatgactgtggtcattctcttctatggggctgctgtctatacctacatgctccccacctcctatcacacctctgagaaggacatgattgtatctgtcttttataccatcctcactcctggattaaatcctttaatctacagtctcaggaataagaatgtcatgggagcactgaagaaaatgttgaatgtgggacctgtttttcaagaaactataaaatag

SEQ ID NO: 230 - protein, 320 aa, Canis familiaris
MKNMNWMANYTGESDFILVGIFSQSNHPALLCVVIFVVFLMALTGNAVLILLIHFDAHLHTPMYFFISQLSLMDVMYISITVPKMLIDQIMGISNISAPECGMQMFLYVTLAGSECFLLATMAYDRYMAICHPLHYPVLMNHRLCLLLASGCWFLGSVDGFMLTPITMTFPFCRSREIHHFFCEVPAVMKLSCSDTSLYETVMYLCCVLMLLIPVTVISSSYYFILLTIHRMNLAEGQKKAFATCSSHMTVVILFYGAAVYTYMLPTSYHTSEKDMIVSVFYTILTPGLNPLIYSLRNKNVMGALKKMLNVGPVFQETIK

SEQ ID NO: 231 - DNA, 960 bp, Canis familiaris
atggacaacaaaacttggatgatcagtgacagtggacaatctgatttcatcctggtgggaattttcagtcagtcaaaacacccaacttttctctgtgtgatcatttttattgttttcttgttggtattgtctggaaactctctcctgatatttctgatatactctgatgctcacctccacactcccatgtattttttcatcagccagttgtctctcatggatgtaatgtacatttccatcactgtacccaaaatgcttatgaaccaggttttgagtatgaataagatctcaaccctagaatgtgggatgcaaatgtttctctatgtaacactaggaggttcagaatgttttcttctagccaccatggcttatgatcgctatgtagccatctgccatcctcttcattaccctgtcctcatgaaccatagattgtgtcttctactggcatctggctgctggtttctgggatctgtggatggattcatgctcacgtccatcaccatgaccttccccttctgcagaactcgagagatccatcatttcttctgtgaagtccctgccatagtgaagctttcttgctcagatacttccctctatgagacagtcatgtacctgtgctgtgtcctcatgcttcttatccctgtagcagtcatttcaagctcttattctttcatccttttcaccattcacaggataaactcagcaaaaagccagaaatcctttgccacgtgttcctcccatatgacggtggtcattctcttttatggggctggagtctacaactatatgcttcccagtttttaccacacccctgaaaaagacataatggtgtctgtcttttataccatacttactccattgctaaaccctttaatctatagtctgaggaataaagatgtcacagaagctttaaagaaaatggtgaatgtaggacctgtctttcaagaaattataaaatag

SEQ ID NO: 232 - protein, 319 aa, Canis familiaris
MDNKTWMISDSGQSDFILVGIFSQSKHPTFLCVIIFIVFLLVLSGNSLLIFLIYSDAHLHTPMYFFISQLSLMDVMYISITVPKMLMNQVLSMNKISTLECGMQMFLYVTLGGSECFLLATMAYDRYVAICHPLHYPVLMNHRLCLLLASGCWFLGSVDGFMLTSITMTFPFCRTREIHHFFCEVPAIVKLSCSDTSLYETVMYLCCVLMLLIPVAVISSSYSFILFTIHRINSAKSQKSFATCSSHMTVVILFYGAGVYNYMLPSFYHTPEKDIMVSVFYTILTPLLNPLIYSLRNKDVTEALKKMVNVGPVFQEIIK

SEQ ID NO: 233 - DNA, 963 bp, Canis familiaris
atggagaacatcaactggctggctaaccacactgggaggtcagatttcatcctagtgggactcttcaataaatccaaacacccagctctcctttgtttggtcatttttgtggttttcctaatggccttgtctggaaacaccatcctgattctactgatacattctgattcccacctccacacccctatgtacttttttatcagccaactatctctcatggacatgatgtatatttccgttactgtgcccaagatgctcatggaccaagtcatgggtatgaataagatctcagccacggaatgtgggatacagatgtttctctatgtgacactagcaggttcagaattttttcttctagcctccatggcctatgaccgctatgtggccatctgccatcctctccgttaccctatcctcatgaaccatcaggtgttgctcatcctagcatctggctgctggttcctgggctcagtggatggcttcttgttcactcccatcaccatgaccttccccttttgcagatctcgggagattcatcatttcttctgtgaagtccctgctgtattgaaactctcttgttcagacacttccatctatgaggttttcatgtatctgtgctgtgtgctcatgcttctcattcctgtgacagtcatttcaggctcttactactttatcctcatcaccatccacaggatgaactcagcagaaggccagaagaaggcctttgccacttgttcttcccacatgactgtggtcatcctcttctatggggctgccatttatacttacatgctccccaattcctaccatacacctgagaaggacatgatggtatctgtcttttacaccatactcactcctgtgctaaaccctttgatctatagcttaagaaataaggatgttatgggagcgctgaagaaaatgctgaatgtgggacctggttttcaagaaactataaagtag

SEQ ID NO: 234 - protein, 320 aa, Canis familiaris
MENINWLANHTGRSDFILVGLFNKSKHPALLCLVIFVVFLMALSGNTILILLIHSDSHLHTPMYFFISQLSLMDMMYISVTVPKMLMDQVMGMNKISATECGIQMFLYVTLAGSEFFLLASMAYDRYVAICHPLRYPILMNHQVLLILASGCWFLGSVDGFLFTPITMTFPFCRSREIHHFFCEVPAVLKLSCSDTSIYEVFMYLCCVLMLLIPVTVISGSYYFILITIHRMNSAEGQKKAFATCSSHMTVVILFYGAAIYTYMLPNSYHTPEKDMMVSVFYTILTPVLNPLIYSLRNKDVMGALKKMLNVGPGFQETIK

SEQ ID NO: 235 - DNA, 960 bp, Canis familiaris
atggatggagacaatcaaacctcttccagtgacttcatcctcacagggctcttcactcacagtgcaatctcagtcttccttttcagcatcatctgtgccatcttcttcatggccatgattgctaatggtgtcatgatcttcctgatccatatagactctcacctccacacccccatgtatttcctgctcagtcatctctcttttattgacatgatgtacatctctaccattgtgcccaagatgctgatcgattatctcgtgggcaaggggactatctccttcattgcctgtacagcccagtactttctctacatgggctttgtgggggctgagtttttcctgttgggactcatggcttatgaccgctatgtggccatctgcaacccccttcgctatcctgtccttatgagccaccaggtctgttggatgatcttggccagctcttggttaggtggtgctttggacagctttctcctcacccctatcaccatgagtctcccattctgcagttcccacaagatcaatcacttcttctgtgaaggacccaccatgctaaggctggcatgcggtgacaaagctgcctatgaaatggtcatgtacatttgctgtgtcatgatgttgctgatccccttctctgtggtgattgcttcctatgctcagattctcatcacggtgcaccagataaagtcagatgaaggaaagaagaaggcttttgctacctgttcatcacacataatggtggtgacattgttttatggggctgccctatacacatatatgcttccccaatcctaccacacaccaatcaaagacaaagtcttctctgctttttacaccattctcactcctttgttaaatcctctcatctacagcttgaggaacacagatgtaactgaagcttttaaaagaattttggcaagatgtcaaggagctcctggtgtgacaaggagagaattctga

SEQ ID NO: 236 - protein, 319 aa, Canis familiaris
MDGDNQTSSSDFILTGLFTHSAISVFLFSIICAIFFMAMIANGVMIFLIHIDSHLHTPMYFLLSHLSFIDMMYISTIVPKMLIDYLVGKGTISFIACTAQYFLYMGFVGAEFFLLGLMAYDRYVAICNPLRYPVLMSHQVCWMILASSWLGGALDSFLLTPITMSLPFCSSHKINHFFCEGPTMLRLACGDKAAYEMVMYICCVMMLLIPFSVVIASYAQILITVHQIKSDEGKKKAFATCSSHIMVVTLFYGAALYTYMLPQSYHTPIKDKVFSAFYTILTPLLNPLIYSLRNTDVTEAFKRILARCQGAPGVTRREF

SEQ ID NO: 237 - DNA, 957 bp, Canis familiaris
atggagatgcacaacacatcctctacggacttcaccttcatggggctgttcaacaggaaggacatctccggccttctttttctcattatctctatcatctttttcactgcactgatggccaacggagtcatgatcttcctgattcgcaccgattcacgacttcacacacccatgtacttcttgctcagccacctctccttcattgacatgatgtacatctccaccattgtgccaaagatgctggttgattacctacttggtcaaagaaccatctcctttatggggtgcacagctcagcacttcctctacctcaccctggtgggagctgagttctttctgctgggcctcatggcctatgatcgttatgtggccatctgcaaccctcttcgctatcctgttcttatgagccgccaggtctgttggatgatcatagcaggttcctggtttgggggctctttggatggctttcttctaactcctatcaccatgagctttcctttctgcaactcgcgagagattaatcatttcttctgtgaggcacctgcagtcttgaagttggcatgtgcagacacagccctctatgagacagtaatgtatgtgtgctgtgttctgatgctgctgattcctttctctgtggtgatttcttcctatgctcgaattctgaccacagtccaccacatgagttcagtggaagggaggaaaaaggcatttgccacctgctcatctcacataacagtggtgaccttgttctatggggctgccatgtacacctacatgctgccacactcttaccacaggccagcccaggacaaagtcttttctgtgttctacacaatccttacaccaatgctaaatccactcatctacagtctgaggaacaaggatgtgactggagctctgaaaaaagcattggccaggttcaagggtacacaaagggtggcaggagaagtgttttga

SEQ ID NO: 238 - protein, 318 aa, Canis familiaris
MEMHNTSSTDFTFMGLFNRKDISGLLFLIISIIFFTALMANGVMIFLIRTDSRLHTPMYFLLSHLSFIDMMYISTIVPKMLVDYLLGQRTISFMGCTAQHFLYLTLVGAEFFLLGLMAYDRYVAICNPLRYPVLMSRQVCWMIIAGSWFGGSLDGFLLTPITMSFPFCNSREINHFFCEAPAVLKLACADTALYETVMYVCCVLMLLIPFSVVISSYARILTTVHHMSSVEGRKKAFATCSSHITVVTLFYGAAMYTYMLPHSYHRPAQDKVFSVFYTILTPMLNPLIYSLRNKDVTGALKKALARFKGTQRVAGEVF

SEQ ID NO: 239 - DNA, 939 bp, Canis familiaris
atggaaaattatactcaaacatcaactgatttcatccttttgggcttgttcccatcaacaagaattggcctgttcctttttattgtcatcgttcttgttttcctaatggctctgtttggcaacctgtccatgattcttctcatcttcctagacactcatctccacacacccatgtatttcttactcagtcagctctctctcattgacctaaactacatctccacaattgtccccaagatggcttacaattttgtgtttggaaacaagtctatctccttcattgggtgtggggctcagagcttcttcttcttgacattaggaggagcagaagcattgctcctaatatctatggcctatgatcgttatgtggctatttgctttcctctccactattccattcgtatgaacaaaaaagtgtgcatgttgatgataacaggatcttggataatgggatcaatcaactcctgtgcccacactgcatatgccttccatataccttactgtcgatccagaactatcaaccacttcttctgtgatgtcccagccatgttgactctggcctgcatggacacctgggtctatgagtacacagtgtttgtcagtaccatcctcttccttgtgtttcctttcatttgcattactttttcctatatccgggtcctcctagctatctgccgcatgcagtctacagaagggaggaagaaagcttattccacctgcagcacccacctaactgtggtgactttctactatgtaccttttgcttacacttatttacgcccaagatcacttagatctccaacagaggacaaggccttggctgtcttctacaccatcttgactccaatgctcaaccccatcatctacagcctgagaaacaaggaggtgatgggagccatgaggcgatcaattcagagagcctgctttgtaaaaatgtag

SEQ ID NO: 240 - protein, 312 aa, Canis familiaris
MENYTQTSTDFILLGLFPSTRIGLFLFIVIVLVFLMALFGNLSMILLIFLDTHLHTPMYFLLSQLSLIDLNYISTIVPKMAYNFVFGNKSISFIGCGAQSFFFLTLGGAEALLLISMAYDRYVAICFPLHYSIRMNKKVCMLMITGSWIMGSINSCAHTAYAFHIPYCRSRTINHFFCDVPAMLTLACMDTWVYEYTVFVSTILFLVFPFICITFSYIRVLLAICRMQSTEGRKKAYSTCSTHLTVVTFYYVPFAYTYLRPRSLRSPTEDKALAVFYTILTPMLNPIIYSLRNKEVMGAMRRSIQRACFVKM

SEQ ID NO: 241 - DNA, 954 bp, Canis familiaris
atggagctgggcaactattccatgtatgctgactttgttctcctgggcttgttcagcaacacccgttttccctggcttctctctgccctcatcctcttggtctttgtcatctccatagccagcaacaccatcatgatcattctcatccacatggactcccacctccacacccccatgtactacttgctcagccagctctcccttatggatatcttgtacatttctaccattgtgccaaagatgctggttgaccagatagtgggccagagggccatatcctttgcaggatgcacttcccagcacttcatttacttgaccttggcaggggctgagtttttcctcttaggattaatgtcctatgaccgctatgtagccatctgcaaccctctgcgctaccctgtccttatgagtcgaaaggtctgcttgttaattgtggtggcagcctggctgggagggtccatagatggcttcctgctcactccagtgaccatgcagttccctttctgtgcctctcgagaaatcaatcacttcttctgtgaggtccctgctcttctgaagctctcctgtactgacacatcaacctatgaaacagccatgtatgtctgctgcatcatgatgctcctcatccctttctctgtcatctcagcctcttatacaaggattctcatcactgtttatagaatgaatgaagcagaaggaaggcgaaaggcggtggccacttgctcctcacacatggtggttgtcagcctcttttatggtgctgccatgtacacctatgtgttgcctcactcttaccatactcctgagaaggacaaggccgtatctgccttctacactatcctcacacccttgctcaacccactcatctatagcctcaggaacaaggatgttagcagggctttaaagaaaactctgggcaagtgtttgtcctcaggaagtgtatccaccttctaa

SEQ ID NO: 242 - protein, 317 aa, Canis familiaris
MELGNYSMYADFVLLGLFSNTRFPWLLSALILLVFVISIASNTIMIILIHMDSHLHTPMYYLLSQLSLMDILYISTIVPKMLVDQIVGQRAISFAGCTSQHFIYLTLAGAEFFLLGLMSYDRYVAICNPLRYPVLMSRKVCLLIVVAAWLGGSIDGFLLTPVTMQFPFCASREINHFFCEVPALLKLSCTDTSTYETAMYVCCIMMLLIPFSVISASYTRILITVYRMNEAEGRRKAVATCSSHMVVVSLFYGAAMYTYVLPHSYHTPEKDKAVSAFYTILTPLLNPLIYSLRNKDVSRALKKTLGKCLSSGSVSTF

SEQ ID NO: 243 - DNA, 975 bp, Canis familiaris
atgagcatggaggccattctccagaactccactgattttatccttctgggccttatcacccatcctgcatttcctgggattatctttgcagtggttttctccatttttttggtggctgtcacagccaatgtggtcatgattctactcatccatgttaactctcggctccatacacccatgtactttttactcagccagctttccatcatggacactgtttacatttgcatcactgttcccaagatgcttcaagaccttctgtccaaggaaaagatgatctccttcttgggatgttcccttcagatcttcctctacctgactctaattggaggtgaatttttcctgctaggcctcatggcctatgaccggtatgtagctgtgtgcaaacccctgcgataccctctcctcatgaaccgcagaatttgcttattcatggtggtgggttcctgggttggtgggtccttagatggattcatgctgacaccctttactatgagtttcccctactgtgggtcccgagaaatcaatcactttttctgtgaaatcccagcagtactgaaactgtcatgtgttgacacatcactctatgagactctgatgtatgcctgctgtgtgctaatgctgctcattcccatatccattatctctatttcctacacacacatcctactcactgtccatcgaatgaactctgctgagggccggcataaagcctttgctacctgttcttcccacattatggtggtgagcattttctatggagcagccttctacactaatgtgctgccccattcctaccacacaccagagaaagacaaggttgtatccgccttctataccatcctcaccccaatgctcaacccactcatctacagcttgagaaacaaagatgtggccacagctctaagaaaagtgctggggagatgcccctcttctcagagaataagagtggtggatttgtccaggaaatactag

SEQ ID NO: 244 - protein, 324 aa, Canis familiaris
MSMEAILQNSTDFILLGLITHPAFPGIIFAVVFSIFLVAVTANVVMILLIHVNSRLHTPMYFLLSQLSIMDTVYICITVPKMLQDLLSKEKMISFLGCSLQIFLYLTLIGGEFFLLGLMAYDRYVAVCKPLRYPLLMNRRICLFMVVGSWVGGSLDGFMLTPFTMSFPYCGSREINHFFCEIPAVLKLSCVDTSLYETLMYACCVLMLLIPISIISISYTHILLTVHRMNSAEGRHKAFATCSSHIMVVSIFYGAAFYTNVLPHSYHTPEKDKVVSAFYTILTPMLNPLIYSLRNKDVATALRKVLGRCPSSQRIRVVDLSRKY

SEQ ID NO: 245 - DNA, 960 bp, Canis familiaris
atgtcaatgaagaatataactttatcctctgactttatcctcctggggcttctggtgaacaataaagctacagggatcgtttttgctgttatttttgctattttcatggtggctgtaactgcaaatctggtcatgatattcttgattcaaatggactctcgtctccatacacctatgtatttcctgctcagccagctgtccatcatggacacctttttcatttgtaccactgtcccaaaacttctggttgacatggtttctaaagagaagaccatttcctttgtaggttgtggtatccagatcttcctctacttgaccatgattggctcagagttctttctcttaggcctcatggcctatgaccgctacgtggctgtctgtaaccctcttaggtatccagtcctgatgaaccgcagggtgtgtctcctgctggctgctggtgcctggtttggtgggtccctggatggctttctgctcacccccatcaccatgaatgtcccttactgtggctcccacagtatcaaccattttttctgtgagatccctgcagttctcagactagcctgtgctgacacatccttgtatgaaaccctaatgtacatctgctgtgtactcatgttactcatccctatctctatcatctcaacctcctactctctcatcttgttaactgtccaccgaatgcgctctgctgaaggccggaaaaaagctttcaccacttgcttttcccacttaaccgtagtcagcattttctatggagctgccttctacacttatgttctaccccagtcctttcacactcctgagcaggacaaggtagtgtcagccttatataccattgtcacccccatgctcaatcctcttatctacagcctcagaaacaaggatgtcatgggggcatttaaaaagatgtttttgcaatactcatctgctcaaaaaatagcctcaagtgatgtttaa

SEQ ID NO: 246 - protein, 319 aa, Canis familiaris
MSMKNITLSSDFILLGLLVNNKATGIVFAVIFAIFMVAVTANLVMIFLIQMDSRLHTPMYFLLSQLSIMDTFFICTTVPKLLVDMVSKEKTISFVGCGIQIFLYLTMIGSEFFLLGLMAYDRYVAVCNPLRYPVLMNRRVCLLLAAGAWFGGSLDGFLLTPITMNVPYCGSHSINHFFCEIPAVLRLACADTSLYETLMYICCVLMLLIPISIISTSYSLILLTVHRMRSAEGRKKAFTTCFSHLTVVSIFYGAAFYTYVLPQSFHTPEQDKVVSALYTIVTPMLNPLIYSLRNKDVMGAFKKMFLQYSSAQKIASSDV

SEQ ID NO: 247 - DNA, 963 bp, Canis familiaris
atggagaacactacttggatggccaactatactgtacgatcagattttgaactagtgggactcttcagtcaatccaaacacccagctgtcctttgtgtggtcattttcctggctttcctgatggccctctctggaaacaccatcctgatccttctgatacactgtgatgctcacctccacacccccatgtacttttttatcacccagttgtctctcatggacgtgatgtacatttctgtcactgtgcccaagatgctcatggaccaggtcatgggtgtgaataagatctcagcccctgaatgtgggatgcagatgtttttctatttgacactaggaggttcagaattttttcttctagctgccatggcctatgaccgctatgtggccatctgccatccactccgttatcctatcctcatgaaccatagagtgtgtcttctcttggtgtcttcctcctggattttgggatctgtagatggatttatgctcactcctgtcaccatgaccttccccttctgcagatcccgagagattcaccatttcttctgtgaggttcctgctgtaatgaagctctcctgctcagacacttccctctatgagacactcatgtacctgtgctgtgtcctcatgctcttcatcactgtgacagtcattttaagctcctattctttcatcctctttaccatccacaggatgaactcagcagagggacggaagaaggcttttgccacttgttcttcccacatgatggtggttatctccttctatggtgcttctgtctacacctacatgctccccacctcctatcacacccctgagaaggacatgattgtatctgtcttttacaccatactcactcctgttctaaatcctttaatttatagtcttagaaataaggatgtcacaaggggtctaaaaaaaatgttgaatgtgggatctgtctttcaggaaactctaaagtaa

SEQ ID NO: 248 - protein, 320 aa, Canis familiaris
MENTTWMANYTVRSDFELVGLFSQSKHPAVLCVVIFLAFLMALSGNTILILLIHCDAHLHTPMYFFITQLSLMDVMYISVTVPKMLMDQVMGVNKISAPECGMQMFFYLTLGGSEFFLLAAMAYDRYVAICHPLRYPILMNHRVCLLLVSSSWILGSVDGFMLTPVTMTFPFCRSREIHHFFCEVPAVMKLSCSDTSLYETLMYLCCVLMLFITVTVILSSYSFILFTIHRMNSAEGRKKAFATCSSHMMVVISFYGASVYTYMLPTSYHTPEKDMIVSVFYTILTPVLNPLIYSLRNKDVTRGLKKMLNVGSVFQETLK

SEQ ID NO: 249 - DNA, 963 bp, Canis familiaris
atggagaacatcatgtgggtgaccaactatactgaacgatcagattttgaactagtgggactcttcagtcaatccaagcacccaactctcctctgtgtggtcattttcgtggttttcctgatggccctctctggaaacaccatcctgatccttctgatacactgtgatgctcacctccacacccccatgtacttttttatcacccagttgtctctcatggacgtgatgtacatttctgttactgtgcccaagatgctcatggaccaggtcatgggtgtgaataagatctcagtccctgaatgcgggatgcagatgtttctctacttaactctagtaggctcagaattcttccttctggctgccatggcctatgaccgctatgtggccatctgccatccactccgttatcctatcctcatgaaccatagagtgtgtcttctcttggtgtcttcctcctggattttgggatctgtggatggatttatgctgactcccgtcaccatgaccttccccttctgcagatcccgggagattcaccatttcttctgtgaggttcctgctgtaatgaagctctcctgctcagacacttccctctatgagacactcatgtacctgtgctgtgtcctcatgcttctcatccctgtgacagtcatttcaagctcctattctttcatcctcttcaccatccacaggatgaactcagcagagggacggaagaaggcttttgccacttgttcttcccacatgatggtggtcatcctcttctatggtgctgccgtctacacctacatgctccccacctcctatcacacccctgagaaggacatgattgtatctgtcttttacaccatactcactcctgttctaaatcctttaatttatagtcttagaaataaggatgtcacaagggctcttaaaaaaatgttgaatgtggtatctgtcttacaggaacctataaaatag

SEQ ID NO: 250 - protein, 320 aa, Canis familiaris
MENIMWVTNYTERSDFELVGLFSQSKHPTLLCVVIFVVFLMALSGNTILILLIHCDAHLHTPMYFFITQLSLMDVMYISVTVPKMLMDQVMGVNKISVPECGMQMFLYLTLVGSEFFLLAAMAYDRYVAICHPLRYPILMNHRVCLLLVSSSWILGSVDGFMLTPVTMTFPFCRSREIHHFFCEVPAVMKLSCSDTSLYETLMYLCCVLMLLIPVTVISSSYSFILFTIHRMNSAEGRKKAFATCSSHMMVVILFYGAAVYTYMLPTSYHTPEKDMIVSVFYTILTPVLNPLIYSLRNKDVTRALKKMLNVVSVLQEPIK

SEQ ID NO: 251 - DNA, 945 bp, Canis familiaris
atggacaatctcacagaagtgacagagttcctgctcatggggttttctgacatctgcgagctacagatacttcatgctggactctttctgctgatttatctgacagcagtggtgtggaacgttctcatcatgattatcattacttttgatcagtatcttcaccggcctatgtacttctttctgaagaacctctcctttttagatttgtgctatgtttcagtcactgtgcctaagtcaatccacagctccctgactcacagtaactccatctcttaccttggctgtgtggctcaagtctattttttctttgcttttgcatctgctgagctggcctttctcactgtcatgtcctatgatcgctatgttgccatttgccaccccctccaatatgaagccattatgacatcagaaaaatgccaccacatagcagccattgcctggctgagttgctttatttatgcatctgtccacactggcaacatattttgggagcccatatcaagatacagaaaaatccaccagttcttctgtgacatctcccacgttttggccctggtttcccatgaggttttctttgctgagtttgtgagcctggctctgagctcctgctttgtgctggtttgctttgttcttatgatcatctcctatatccagatcttctcaacagtgctcagaatcccttcagtagagagtagggcaaaagcgttttctacctgctctccacagctgattgttattatgctcttccttactacagggctctttggtgccttgggaccaattgccaagacttcatccattcaagatttggtgattgctgtggcttacacagttttgcctcccttcctaaatcccatcatatatagtcttcgaaacaaggagattaaagcagctatttggaggatatttgagaagataaattctttgcaaattagaaacaattag

SEQ ID NO: 252 - protein, 314 aa, Canis familiaris
MDNLTEVTEFLLMGFSDICELQILHAGLFLLIYLTAVVWNVLIMIIITFDQYLHRPMYFFLKNLSFLDLCYVSVTVPKSIHSSLTHSNSISYLGCVAQVYFFFAFASAELAFLTVMSYDRYVAICHPLQYEAIMTSEKCHHIAAIAWLSCFIYASVHTGNIFWEPISRYRKIHQFFCDISHVLALVSHEVFFAEFVSLALSSCFVLVCFVLMIISYIQIFSTVLRIPSVESRAKAFSTCSPQLIVIMLFLTTGLFGALGPIAKTSSIQDLVIAVAYTVLPPFLNPIIYSLRNKEIKAAIWRIFEKINSLQIRNN

SEQ ID NO: 253 - DNA, 948 bp, Canis familiaris
atggaggaaagcaacaacagttctgaaaagggatttcttctgctgggattcgcagatgatccccaactagaaaggatcctttttgtcataattttgcttttctacatcttgaacattctggggaacactgccatcattttggtgtcttatttagcccccatactccacactccaatgtactttttccttagcaatctctcttgtgtggacatctgctttaccaccagcgttgccccacagttgctggttaccatgaataaaaaagaaaaaaacatgagctatggtggatgtgtggcccagctctatgtggctatggggttgggatcctctgaatgtattcttttggcagtcatggcttatgatcgatatgctgctgtctgccggcctctgcaatacataactattatgcatcctcagctttgtgcttccctggccatcatagcatggctcagtggtcttatcacctccttaattcaatgctcccttactgtgcagctgcccctttgtggtcatcgcaaactggaccacattgtctgcgaggttcctgtgctcatcaaactggcctgtgtggacacaacaatcaatgaaatagaactctttgtggccagtgtgatttttctaattgtccctgtgtcactcatcctagtctcctatggctttataacaaaaactgtgctgaggataaaatcagcagcagggcgccggaaggcctttgggacttgttcttcccacctgattgtggtcatcattttttatggaaccatcatctttatgtaccttcagccagccaaaagtagctcaaaaaaccagggaaagtttgtttctcttttctacaccatagtcaccccagtcttaaaccccattatctatactctgagaaacaaagatgtgaaaggggccttgagaacactggtgatgagaaatgttttagtttcaaaaaatacatga

SEQ ID NO: 254 - protein, 315 aa, Canis familiaris
MEESNNSSEKGFLLLGFADDPQLERILFVIILLFYILNILGNTAIILVSYLAPILHTPMYFFLSNLSCVDICFTTSVAPQLLVTMNKKEKNMSYGGCVAQLYVAMGLGSSECILLAVMAYDRYAAVCRPLQYITIMHPQLCASLAIIAWLSGLITSLIQCSLTVQLPLCGHRKLDHIVCEVPVLIKLACVDTTINEIELFVASVIFLIVPVSLILVSYGFITKTVLRIKSAAGRRKAFGTCSSHLIVVIIFYGTIIFMYLQPAKSSSKNQGKFVSLFYTIVTPVLNPIIYTLRNKDVKGALRTLVMRNVLVSKNT

SEQ ID NO: 255 - DNA, 957 bp, Canis familiaris
atgccaaaagcactaggaattacaaacaacagtttccaagttggctttatacttctgggcttctctgaatggccccatctagaaatgattctcttctggattgtgatcatcttgtacaccatgatcatcctctccaactcaaccattatcttgctctcttatgtggaccctcatctctacacccccatgtacttctttcttagcaatctttctttcttggatctctgcttcactacaactgctgtgccccagatgttgtacaatttgtgggggccagacaagagcatcacctacacaggctgtgtcatccaactctctgtgttgctctgtcttggtgccacagaaggtgtcatgttggtggtgatggcatttgaccgctatgtagctatttgtcagcccctgcactatacaatcatcatgcatcatcagttctgttggaagctggtgctcatagcctggatgtctggattgatggaatctgtgacccaatcccccatcacattccaacttcctttatacacccaccaccatttggatgattttatttgtgaagttcctgctttcatacgcctggcatgtggaaatacctctgccattgaatggcaaatgaccatctctgctgaccttttcaccattgtgccaatggggttaatcctgacttcttatggctacatagctcaagccttaggtaaaatccaatccaaggatggaaggcagaaggccattgccacctgttcttctcatctcactgtggtcctcatgttttatgggacagtggccatggtttatacagaccctaagaatgactttgcttcaaattatggcaagttattcactttcttctacactttagtcacaccattgttgaaccctctcatctataccctaaggaacaaagaagtgaaggatgctctgcaaagactcctgaagaagtggatgtgtaaatggaaaaagtag

SEQ ID NO: 256 - protein, 318 aa, Canis familiaris
MPKALGITNNSFQVGFILLGFSEWPHLEMILFWIVIILYTMIILSNSTIILLSYVDPHLYTPMYFFLSNLSFLDLCFTTTAVPQMLYNLWGPDKSITYTGCVIQLSVLLCLGATEGVMLVVMAFDRYVAICQPLHYTIIMHHQFCWKLVLIAWMSGLMESVTQSPITFQLPLYTHHHLDDFICEVPAFIRLACGNTSAIEWQMTISADLFTIVPMGLILTSYGYIAQALGKIQSKDGRQKAIATCSSHLTVVLMFYGTVAMVYTDPKNDFASNYGKLFTFFYTLVTPLLNPLIYTLRNKEVKDALQRLLKKWMCKWKK

SEQ ID NO: 257 - DNA, 945 bp, Canis familiaris
atgccaaaagtaccagtgatgaccaacaagagtttcccaatgggcttcattcttctgggcttctctgaatggccccatctagaaatgattctcttctggattgtgatcatcttgtacaccatgatcatcctctccaactcaataattatcttactctcttgtgtggaccctcatctctacacccccatgtacttctttcttagcaatctttctttcttggatctctgctttaccacaaccactgtgccccatatgttgtccaacttgtgggggccaggcaagatcatcacccacacaggctgtgtcatccaactctgtatgttgctctgccttggtgccacagaatgtgtcatgttggtagtgatggcctttgaccgctacattgctatctgccagcccttgcactataccatcatcatgcatcatcagttctgttggaagctggtgctcatagcctggctctctggcctgatagaatctgttactcaaattcctgtcacacttcagcttccattctgcacccaccaccgcctagatgactttctgtgtgaggttccagccctcatacggttgacatgtggagacacctctgccattgaatggcaaatgaccatctctgctattcttttcaccatcgtgccactggcattgatcctgacttcttatggctacatagctcaagctttaggtaaaatccaatccaaagatggaaggcagaaagccattgccacatgttcctcccaccttactgtggtattcatgttttacggaactgtggcaccagtgtatacatatcctaagaatcactttgcttcaacatatagcaaattctttaccttcttctacactgtggtcacaccattgttaaatcctcttatctattccctgaggaacaaagacgtaaagaatgctatgctacaactgctgagaagaggatcaccatga

SEQ ID NO: 258 - protein, 314 aa, Canis familiaris
MPKVPVMTNKSFPMGFILLGFSEWPHLEMILFWIVIILYTMIILSNSIIILLSCVDPHLYTPMYFFLSNLSFLDLCFTTTTVPHMLSNLWGPGKIITHTGCVIQLCMLLCLGATECVMLVVMAFDRYIAICQPLHYTIIMHHQFCWKLVLIAWLSGLIESVTQIPVTLQLPFCTHHRLDDFLCEVPALIRLTCGDTSAIEWQMTISAILFTIVPLALILTSYGYIAQALGKIQSKDGRQKAIATCSSHLTVVFMFYGTVAPVYTYPKNHFASTYSKFFTFFYTVVTPLLNPLIYSLRNKDVKNAMLQLLRRGSP

SEQ ID NO: 259 - DNA, 936 bp, Canis familiaris
atggaaaattttaaccagacatctggtttcttcttattggggctgtttccaccatcaagaattggcctgtgctttttcattctcattgttcttattttcctaatggctgtgtttggcaacctgtccatgatcatcctcatctttgtggacactcatctccacacacccatgtattttctacttagtcagctctccctcatggacctgagctacatctccaatattgtccccaagatggcttctaattatctctctggaaacaagtctatttctttcattaagtgtggagttcagagcttcttcttcattgctttagctggtgcagaaggactaatattggcctcgatggcttatgatcgttatgtggctatttgctttcctcttcactatcccattcgtataagcaaaaaagtgtgcgtgctgatgataacgggatcttggatagtgggctcagtcaactcctgtgcccacactgtatatgccttcaatataccttactgtcaatccaggactatcaatcacttcttctgtgaagtcccagccatgttgacgctggcctgcatggatacctgggtctatgagtacacggtgtttgtgagcaccacactcttgattgtaattcctttcattggcattgcatgttcctatggacgtgttctccttgccatcttccacatgcagtccacagaagggaagaagaaggcctattccacctgcagcacccacctcactgtggtgactttctactatgcaccctttgcttacacttatttacgcccaagatccctccgaactccaacagaggacaaggccttggctgtattctacaccatcttgaccccaatgcttaacccaattgtttacagcctgagaaataaggaagtgatgggtgctctgagaagagtgattctgaagttctgctctatagaaatgtag

SEQ ID NO: 260 - protein, 311 aa, Canis familiaris
MENFNQTSGFFLLGLFPPSRIGLCFFILIVLIFLMAVFGNLSMIILIFVDTHLHTPMYFLLSQLSLMDLSYISNIVPKMASNYLSGNKSISFIKCGVQSFFFIALAGAEGLILASMAYDRYVAICFPLHYPIRISKKVCVLMITGSWIVGSVNSCAHTVYAFNIPYCQSRTINHFFCEVPAMLTLACMDTWVYEYTVFVSTTLLIVIPFIGIACSYGRVLLAIFHMQSTEGKKKAYSTCSTHLTVVTFYYAPFAYTYLRPRSLRTPTEDKALAVFYTILTPMLNPIVYSLRNKEVMGALRRVILKFCSIEM

SEQ ID NO: 261 - DNA, 939 bp, Canis familiaris
atggaaaactatactcaaacatcaactgatttcaccctactgggcttgttcccaccaacaagaattggcctgttcctctttattgtcatcgttctcgttttcctaatggctctgtttggcaacctgtccatgattcttcttatcttcagagacacacatctccacacacccatgtatttcttactcagtcagctctctctcattgacctaagctatatctccacgattgtccccaaaatgacctacaattttgtgtgtggaaacaagtctatctccttcattgggtgtggagttcagagctactttttcttgactttagcaggtgcagaagctttgctcctgatatctatggcctatgatcgttatgtggctatttgctttcctcttcactatcccattcgtatgagcaaaaaagtatgcatgctgatgataacaggatcttggataatgggctcagtcaatgcttgtgcccacactgtatacgccttccatataccttactgtcgatccaggaacatcaaccatttcttctgtgatgtcccagccatgttgactttagcctgcatggacacctgggtctatgagtacacagtgtttgtgagcaccatcctcttccttgcatttccattcattggcattgtatgttcctatggccgggtcctcctagctatctgccacatgcagtccacagaagggaggaagaaggcctattccacctgcagcacccaccttactgtagtgactttatactatgcaccttttgtttacacatatttatgcccgagatcctttcgatctccaacagagaacaaggtcctagctgttttctacactatcctgaccccagtgctcaaccccataatctactgcctgagaaacaaggaggtgatgggagccctgagacgattgattcagagaatctcctttgttaaaatgtag

SEQ ID NO: 262 - protein, 312 aa, Canis familiaris
MENYTQTSTDFTLLGLFPPTRIGLFLFIVIVLVFLMALFGNLSMILLIFRDTHLHTPMYFLLSQLSLIDLSYISTIVPKMTYNFVCGNKSISFIGCGVQSYFFLTLAGAEALLLISMAYDRYVAICFPLHYPIRMSKKVCMLMITGSWIMGSVNACAHTVYAFHIPYCRSRNINHFFCDVPAMLTLACMDTWVYEYTVFVSTILFLAFPFIGIVCSYGRVLLAICHMQSTEGRKKAYSTCSTHLTVVTLYYAPFVYTYLCPRSFRSPTENKVLAVFYTILTPVLNPIIYCLRNKEVMGALRRLIQRISFVKM

SEQ ID NO: 263 - DNA, 408 bp, Canis familiaris
atgatgggacatgagaatcacatttttaccagtgacttcattctcttaggactctttgcttcttcccatacaagccaaattttcttcccctttatattcatcatttttatggtgtctttaacagaaaacacaatcatgatcctccttatcctcagggactcgagactccatactccaatgtatttcctgctcagccacctctctttcatggacatcttgcatatttccaacattgttcccaaaatgatcaccaactttctctcaggcagaactatttcatttgcaggttgtggcttccagatatttctatccctcctcctggatggtgagtgcctcctcctggcggcaatgtcttatgatcgctatgtagccatctgtcatgcactgcactatcccatacttctatcc

SEQ ID NO: 264 - protein, 136 aa, Canis familiaris
MMGHENHIFTSDFILLGLFASSHTSQIFFPFIFIIFMVSLTENTIMILLILRDSRLHTPMYFLLSHLSFMDILHISNIVPKMITNFLSGRTISFAGCGFQIFLSLLLDGECLLLAAMSYDRYVAICHALHYPILLS

SEQ ID NO: 265 - DNA, 945 bp, Canis familiaris
atggaaaatgcaaatgacactactgagataaactttattcttctagggctctttaaacacactccaatccatttgttcctcttttccatggtgctcatgttcttcctcacctctctgatgggcaatgccctcatgatcatgctcatctatgaggacccccggctgcacacgcccatgttcttcttgctcagccagctttctgtcatggacatgatgctggtctccaccatagtccccaaaatggcagccaactacctgatgggcaccgggtccatctctcctgctggctgtggagcccagatcttcctgtttctcacactgggagggggtgagtgctttctcttagcagccatggcctatgatcgctatgtggccatatgtcatcccctgcgctaccacatcctcatgaatcagaagctctgcttgcacatgaccgcaggttcctggattctgggaggagtagatggactgatgcaggctggtgtcactctgagcttcgcttactgccattctcgggaaataaaccacttcttttgtgaggcacccacacttgtgcgccttgcctgtgctgacactatgttttttgagttgttcatgtatgtatgctgtgttctgatgctcttgatcccactgtctcttattctggcctcctacagtctcatccttgctgctgtactccgcatgcagtccacagcagcccaaaagaaagcctttgccacttgctcctctcacctggctgttgtggggcttttctatggtgccataatattcatctacatgcggcccaaatcctaccattcagtggcctatgacaaggtgatctctgctttttataccatcttcacacctgtgttgaatccccttatatacagtgtgaggaataaagaagtcaagggggctttgagaaagtggctggagaaacattttctgggacaactacagtga

SEQ ID NO: 266 - protein, 314 aa, Canis familiaris
MENANDTTEINFILLGLFKHTPIHLFLFSMVLMFFLTSLMGNALMIMLIYEDPRLHTPMFFLLSQLSVMDMMLVSTIVPKMAANYLMGTGSISPAGCGAQIFLFLTLGGGECFLLAAMAYDRYVAICHPLRYHILMNQKLCLHMTAGSWILGGVDGLMQAGVTLSFAYCHSREINHFFCEAPTLVRLACADTMFFELFMYVCCVLMLLIPLSLILASYSLILAAVLRMQSTAAQKKAFATCSSHLAVVGLFYGAIIFIYMRPKSYHSVAYDKVISAFYTIFTPVLNPLIYSVRNKEVKGALRKWLEKHFLGQLQ

SEQ ID NO: 267 - DNA, 939 bp, Canis familiaris
atgatgggatgtgagaatcaaaatttcaccactgatttcattcttttaggactcttttcttcctcccaatcaagtcaaattttcttttcctttatattcatcatttttatgatgactttaacagaaaacacaatcatgatccttcttgtcctcagggactcgagactccatactccaatgtatttcctgctcagccacctctctttcatggacatcttgcatatttccaacattgttcccaaaatgatcatcaactttctctcaggcagcagaactatttcatttgcaggttgtggcttccaaatatttctatccctcaccctcctgggtggtgagtgccttctcctggcggcaatgtcttatgatcgctatgtagccatctgtcatccactgcactatcacattcttatgaatgactatgtccgcaatctcatggctgcagggtcctggattgttgggaccgtcaactccatagctcacacggtttatgccctgcactttcctttctgtggctcgagagccattgatcactttttctgtgaagtccctgccatgttgaaattgtcttgtgaggacacaacactctatgaacaaggagtttatgtaagtggtttaatttttctacttgtccctttctccctaatctttgtttcttatgtgcaaattcttcttactgtccttaaaatgaaatcatcagaagcacgtaaaaagtcattttctacctgttccttccacatgattgtggtcacaatgtactatgggccatttattttcacatacatgagacccaaagcataccacacaccaggccaggacatgtatttggcaatattctacaccatcatcacacctacactcaaccctatcatctacagctttaggaataaagatgttctggaggcaatgaaaaatatgttaaaaagtaaatttctccattaa

SEQ ID NO: 268 - protein, 312 aa, Canis familiaris
MMGCENQNFTTDFILLGLFSSSQSSQIFFSFIFIIFMMTLTENTIMILLVLRDSRLHTPMYFLLSHLSFMDILHISNIVPKMIINFLSGSRTISFAGCGFQIFLSLTLLGGECLLLAAMSYDRYVAICHPLHYHILMNDYVRNLMAAGSWIVGTVNSIAHTVYALHFPFCGSRAIDHFFCEVPAMLKLSCEDTTLYEQGVYVSGLIFLLVPFSLIFVSYVQILLTVLKMKSSEARKKSFSTCSFHMIVVTMYYGPFIFTYMRPKAYHTPGQDMYLAIFYTIITPTLNPIIYSFRNKDVLEAMKNMLKSKFLH

SEQ ID NO: 269 - DNA, 939 bp, Canis familiaris
atgcaggaactcaaccggtccagtgtgacagaatttgttctgttgggcttcacccccaaccccaggaccaaccctctgctcttcaccttctttctcactttttacctgctaatcctcatgagcaacagcctcctcatcatcctcatctgcgaggactcccgcctccacacacccatgtactttttcatcagtgtcctctccatgctggacatgtgctacacgaccactactgtgccccagatgctcatgcacattctcagcaagaagagggccatctcttttgctagatgtgtggcccagatgtacatcttcctcctctttggtgtcacggagtcctggcttttctccatcatgtctgtggacaggtacgtggctatttgccatcctctccgatacaaggtcatcatgagccgctggatgtgtctcctcatggtgggcatctgtggagtttatggcgtggtgggtagcctgtgctacactttctttgcgatgcgcctgccctactgtggccctaatgaaattgaccactacttctgtgaggtccctgccatcctgaagctggcctgtgcagacacatccctcaatgacttggtggacttcatcacgggcttcaatgtcattgtggtcccactgaccctggttgtcattgtctatgccaacatctttgccaccatcatgaagatccactcagcccagggacagatcaaagccttctccacctgtgcctcccacatcaccgtggtcaccatgttcgctatcccatgcatcatcatgtacatgagccctggctctgactccttgtcaaacagtggaaagaaaatggcccttttctataacattgccacagccttcctcaaccctgtcatctatagtctgaggaacaaggacgtaaaaaaggctttcctcaaattgatgggatggagcagggccccagagtga

SEQ ID NO: 270 - protein, 312 aa, Canis familiaris
MQELNRSSVTEFVLLGFTPNPRTNPLLFTFFLTFYLLILMSNSLLIILICEDSRLHTPMYFFISVLSMLDMCYTTTTVPQMLMHILSKKRAISFARCVAQMYIFLLFGVTESWLFSIMSVDRYVAICHPLRYKVIMSRWMCLLMVGICGVYGVVGSLCYTFFAMRLPYCGPNEIDHYFCEVPAILKLACADTSLNDLVDFITGFNVIVVPLTLVVIVYANIFATIMKIHSAQGQIKAFSTCASHITVVTMFAIPCIIMYMSPGSDSLSNSGKKMALFYNIATAFLNPVIYSLRNKDVKKAFLKLMGWSRAPE

SEQ ID NO: 271 - DNA, 948 bp, Canis familiaris
atgcagagccttggcaaggagaaccacagctctgtgtttgagttcatcctcctgggcttctccagtgactcacaggtcagaatatccctgttctccttcttccttctcctctacctcatcactattctgggaaatggactcattgtgaccctgatctacctggactcacacctccacatgcccatgtactactttctcagtgtcctctctttggtggacatgagttatgtcactaccaccatgccccagatgttgattaatatggtgtgtccaaagaaaaccatctcttggggagcttgtgtagcccagatgtttatcttcttggtcttgggcattgctgagtgcgtcctctatgccattatggcctatgacaggtatgtggccatttgctttccccttcattatccccttctcatgagccgccccatttgtatcaagatggtcacaggttgttggaccattagcatagctggcgccctgatctacactgtcttcaccatgcatctgccttattgtggtccccacaagataaaccacttcttctgtgaggtccctgccgtcttgaagttggcctgtgcagatacatctttcaatgaccgcttggacttcatcttgggattcatcctactcttggtcccattctccctcatcctggcctcctatgtccgaatctttgcctccatcttaagaatccactcatcccaagggaggctcaagtctttctccacatgtgcttcccacatcactgtggttatcatgttctatgggccagccatgatcatgtacatgaggcctggctcctggtatgacccagagcgggacaagaagctagcactgttctacaatgttgtctctgccttcctcaaccccatcatctacagcctccggaacaaagatgtaaaaggggcctttatgaatgtactcggtaacagaaggacatctcagtga

SEQ ID NO: 272 - protein, 315 aa, Canis familiaris
MQSLGKENHSSVFEFILLGFSSDSQVRISLFSFFLLLYLITILGNGLIVTLIYLDSHLHMPMYYFLSVLSLVDMSYVTTTMPQMLINMVCPKKTISWGACVAQMFIFLVLGIAECVLYAIMAYDRYVAICFPLHYPLLMSRPICIKMVTGCWTISIAGALIYTVFTMHLPYCGPHKINHFFCEVPAVLKLACADTSFNDRLDFILGFILLLVPFSLILASYVRIFASILRIHSSQGRLKSFSTCASHITVVIMFYGPAMIMYMRPGSWYDPERDKKLALFYNVVSAFLNPIIYSLRNKDVKGAFMNVLGNRRTSQ

SEQ ID NO: 273 - DNA, 942 bp, Canis familiaris
atgatggaagagtttaaccagtcctctgtgactgaattcatccttctaggcttctccttcaaccccaggaccactcctctgctcttcacagtcttcctgatgacctacctgttgattattctgggcaacagcttaatcaccatcctcatctgcctggactcacacctccacacacccatgtacttctttattggtatcctttccatattggatctgggctacaccactacaactgtgccccagatgctggcacatttagccagccagaagaagaccatctcttttgccagctgtgtggcccaaatgtacattttcttggtgctaggcatcactgagtcatggctctttgccatgatgtctatagacaggtatgtagccatctgccaccccctcagatacaaggtcatcatgagcccgtggctatgtggggtaatggtcattttctgtggactcatgggcataatctctgctcttatctacactgtctttgccatgtgtctgccatactgtggtcccaacaagatcaaccacttcttttgtgaagtccctgcagtcttaaagctagcttgtgcggacacatcagtcaatgactgggtagacttcattctcggctttagtgtcatcctggtcccactctccctcatccttgtcatttatgtcaacatcttcgttgccatcttgaggatccgttcagcccaggggcgactgaaggccttctccacttgtgcctctcatatcattgtggtcaccacgttctgtgtaccagccatggtcatgtatatgaagcctggctctgaggcctccctggaagaggacaagagattggcactgttctacaatgttgtctctgctttcctcaaccccatcatctacagcctccggaataaggatgtgaagagggctttcctcaaggtggcaggttggagcagggccccagaataa

SEQ ID NO: 274 - protein, 313 aa, Canis familiaris
MMEEFNQSSVTEFILLGFSFNPRTTPLLFTVFLMTYLLIILGNSLITILICLDSHLHTPMYFFIGILSILDLGYTTTTVPQMLAHLASQKKTISFASCVAQMYIFLVLGITESWLFAMMSIDRYVAICHPLRYKVIMSPWLCGVMVIFCGLMGIISALIYTVFAMCLPYCGPNKINHFFCEVPAVLKLACADTSVNDWVDFILGFSVILVPLSLILVIYVNIFVAILRIRSAQGRLKAFSTCASHIIVVTTFCVPAMVMYMKPGSEASLEEDKRLALFYNVVSAFLNPIIYSLRNKDVKRAFLKVAGWSRAPE

SEQ ID NO: 275 - DNA, 948 bp, Canis familiaris
atgcagaacttcccctgggacaaccacagctctgtgtctgaattcattcttctgggcttctccagggattcccaaattaacgcaatcctcttcaatatcttcctctttctctacctctctacacttgtgggcaatgggctcattatcaccttgatctacttggactcccgcctccacacacccatgtacttcttcctcagtgtcctctccatgctggacatgagctatgtcaccaccactgtgccccagatgttggtgcatctgatctgccagaagaaaactatctcttatgttgggtgtgtggctcagatgtacatctttctggtgttgggcatcactgagggctggctcttctccgtcatggcctatgacagatatgtagccatctgttacccactcaggtacaaggttatcatgaccccatggctgtgtggggcaatggtggtcttttgtggattgtggggaatcagctgttccctggtctacactgtcttcacaatgcgcctgccctattgtggccctaatgagatcaatcacttcttctgcgaggtccctgctgttctgaagctggcatgtgcagacacatccctcaacgaccaagtagatttcatcctgggtttcatccttctcctggtacctctttccttcattctggcctcttatgtctgcatctttgccactatcttgaagatccgctcggcccaaggccgactcaagaccttctccacctgtgcctcccacatcactgtggtcaccatgttctgtgggcctgccatgtttatgtacatgaaccctggggccaatgcctccccagagcgggacaagaaactggctctgttctacaatgttatctctgcctttctcaaccccatcatctatagccttagaaacaaagatgttaagagggcttttctcaagttaacaggctggggcagggcctctgagtaa

SEQ ID NO: 276 - protein, 315 aa, Canis familiaris
MQNFPWDNHSSVSEFILLGFSRDSQINAILFNIFLFLYLSTLVGNGLIITLIYLDSRLHTPMYFFLSVLSMLDMSYVTTTVPQMLVHLICQKKTISYVGCVAQMYIFLVLGITEGWLFSVMAYDRYVAICYPLRYKVIMTPWLCGAMVVFCGLWGISCSLVYTVFTMRLPYCGPNEINHFFCEVPAVLKLACADTSLNDQVDFILGFILLLVPLSFILASYVCIFATILKIRSAQGRLKTFSTCASHITVVTMFCGPAMFMYMNPGANASPERDKKLALFYNVISAFLNPIIYSLRNKDVKRAFLKLTGWGRASE

SEQ ID NO: 277 - DNA, 924 bp, Canis familiaris
atggaaaataacaacagtacggtggtgaaagaattcatccttcttagtctaacccagtctcgaaatattcagctcttggtctttgtgctagttttaatcttctatttcatcatcctccctggaaacttcctcatcatcctcaccatcagaacagatcctggcctcacagcccccctctacttctttctgggcaacttggctttcctggatgcatcctactccttcattgtggctcccaggatgctggtggacttcctttctgagaagaaggtaatctcctacaggggttgcatcactcagctctttttcttgcacttccttggaggaggggaaggattactccttgttgtgatggcctttgaccgctacattgccatctgtcggcctttacactattcaactgtcatgaaccctagagcctgctatgccttgctattggctctgtggcttggaggctttgtccactccattatccaggtggccctcatcctccgcttgcccttctgtggcccaaaccgactggataacttcttctgtgatgtgccgcaggtcatcaagctggcctgcacggacacctttgtggtggagcttctgatggtcttcaatagtggtctgatgaccctcttgtgcttcctgggccttctggcctcatatgcagtgatcctctgccgtgtacatgggtcctcctctgaggggaagaacaaggcagtatccacatgcaccacccatatcattgttatatttcttatgtttgggcccggcatcttcatctacactcgccccttcagagccttcccagctgacaaagtggtttctctttttcacacagtgatctttcctttgttgaatcctgtgatttatacccttcgtaaccaggaagtaaaagcttctatgaagaggctatttaatcagaatagagcctaa

SEQ ID NO: 278 - protein, 307 aa, Canis familiaris
MENNNSTVVKEFILLSLTQSRNIQLLVFVLVLIFYFIILPGNFLIILTIRTDPGLTAPLYFFLGNLAFLDASYSFIVAPRMLVDFLSEKKVISYRGCITQLFFLHFLGGGEGLLLVVMAFDRYIAICRPLHYSTVMNPRACYALLLALWLGGFVHSIIQVALILRLPFCGPNRLDNFFCDVPQVIKLACTDTFVVELLMVFNSGLMTLLCFLGLLASYAVILCRVHGSSSEGKNKAVSTCTTHIIVIFLMFGPGIFIYTRPFRAFPADKVVSLFHTVIFPLLNPVIYTLRNQEVKASMKRLFNQNRA

SEQ ID NO: 279 - DNA, 969 bp, Canis familiaris
atgaaaaacccagtcgaaaataaccactctgactctgtgagtgaattcattcttcttggattcccttgtccctgggagattcagatcctcctcttctcattcttctttgtgatctatgtcctgacactaactggaaatctgtgtattatctctgcagtgtggtgggatgagtatctccacacccccatgtatatcctgctggccaatttttccttcctggagatctggtatgtcacttctactgtcccaaatatgctagccaacttgctatctgagaccagtaccatctccttctatggctgcttcctccaattctacttcttcttctccatgggcaccactgagaccttcttcttgtctgccatggcctttgacaggtatcttgctatctgcaggcccctgcattactccactgtcatgactgttcagcgttgcatcagaataggagccgggtgctgggtgtgtggcttctcctgttttctcctcccagtttaccttatctctcaacttcctttttgtggtcctaatacaattgatcattttttatgtgatccagggccccttatgaagctgtcctgtgtgccagctactgctactgaggtcatctgtgccgtctttaactcagtcctcattttctccaccttccttttcattaccagctcctatactctggttatcagagctgtgctgagggtcccctcagcagaaggccggcataaggccttctccacatgtggctcccatcttgctgttgtgtctctgttctatggctctatcatggtgatgtatgtgagcccaacagcaggcaatccagcagggattcagaaaattgtgactttattttattctgtgatgactccactttttaatcccttgatctacagcctccggaataaggagatgaagatggccctgagaaaattgtttaggattatgagatttggtcaaaaacagcctttcaagaactag

SEQ ID NO: 280 - protein, 322 aa, Canis familiaris
MKNPVENNHSDSVSEFILLGFPCPWEIQILLFSFFFVIYVLTLTGNLCIISAVWWDEYLHTPMYILLANFSFLEIWYVTSTVPNMLANLLSETSTISFYGCFLQFYFFFSMGTTETFFLSAMAFDRYLAICRPLHYSTVMTVQRCIRIGAGCWVCGFSCFLLPVYLISQLPFCGPNTIDHFLCDPGPLMKLSCVPATATEVICAVFNSVLIFSTFLFITSSYTLVIRAVLRVPSAEGRHKAFSTCGSHLAVVSLFYGSIMVMYVSPTAGNPAGIQKIVTLFYSVMTPLFNPLIYSLRNKEMKMALRKLFRIMRFGQKQPFKN

SEQ ID NO: 281 - DNA, 969 bp, Canis familiaris
atgtcttccagaccaatgaatgcgtccagcacagaaaccaccaactccgttagccacttcatcctcctgggctttccctcaagcccagaaatgcaactgctctactttgggctcttctcagtagtctacaccctgactctgatggggaacgcagccattgtctgtgctgtgcagtgggatcggcgtcttcacactcccatgtacatcttcttggggaatttctctcttctggaaatatgttatgtcaccacgactgttcctaacatgttggccaatttcctctctacaagtaagtccatttcctttgtgagctgcttcacacagttctatttcttcttctcttttggatatgatgaaggcttcttcctttgcatcatggcctttgacaggtaccttgccatttgtaatcctctccattacccacgcatcatgactaagcagctatatactggccttgtcatcttcgggtggtcgagtgggttcttcctcttcctaaccccagttgttctcatttcacagttgccctactgtggcccaaataccatcaaccattttttatgtgaccccgtcccactgatgatgctgtcctgttctgaagatgccatcactcagctcatttactctactttcaatgctattttcatgattggcacctttctctttatcctttgctcctatgctctggtgattctgactgtgctgtggatgccctcacaggctggcaaacgcaaggctttctccacttgtgcttctcatttggcagttgtcaccctgttttatggctctattatggtgatgtatgttagtcctggatcaggacacccagtgaaaattcaaaaattcattaccttattttattcagtgataacacccctctgcaatcctctaatctatagccttaggaacaaggaaatgaagaatgctctgaggaaaatctttgggactgaacatggtgttcataaagtgtaa

SEQ ID NO: 282 - protein, 322 aa, Canis familiaris
MSSRPMNASSTETTNSVSHFILLGFPSSPEMQLLYFGLFSVVYTLTLMGNAAIVCAVQWDRRLHTPMYIFLGNFSLLEICYVTTTVPNMLANFLSTSKSISFVSCFTQFYFFFSFGYDEGFFLCIMAFDRYLAICNPLHYPRIMTKQLYTGLVIFGWSSGFFLFLTPVVLISQLPYCGPNTINHFLCDPVPLMMLSCSEDAITQLIYSTFNAIFMIGTFLFILCSYALVILTVLWMPSQAGKRKAFSTCASHLAVVTLFYGSIMVMYVSPGSGHPVKIQKFITLFYSVITPLCNPLIYSLRNKEMKNALRKIFGTEHGVHKV

SEQ ID NO: 283 - DNA, 738 bp, Canis familiaris
atgccttccagaccaatgactgcgtccagcacagaaaccaccaactccattagccacttcatcctcctgggctttccctcaagcccagaaatgcagctgctctactttgggctcttctcagtagtctacaccctgaccctgatggggaacacagccattgtctgtgctgtgcactgggaccggcatcttcacactcccatgtacatcttcttggggaatttctctcttctggaaatatgttatgtcaccaggaccgttccctatatgtcagccaatttcctgtccacaagcaagtctatctcctttgtgtgctgtttcacacagttctatttcttcttctcttcggggtgtgatgaaggcttcttcctttgcatcatggcctttgacaggtaccttgccatttgtcatcctctccattacccacgcatcatgactaagcagctatacactggccttgtcatcttcgggtggtcgagtgggttcttcctcttcctaaccccagttgttctcatttcacagttgccctactgtggcccaaataccatcaaccattttttatgtgaccccgtcccactgatgattctgtactgttctgaagattccatcactcagctcatttactctactttcaatgctattttcatgattagcacctttctctttctcttttgcttctatgctctggtgattgtggctgtgctacggatgccctcaggagcaagcaaacagcaaggcttt

SEQ ID NO: 284 - protein, 246 aa, Canis familiaris
MPSRPMTASSTETTNSISHFILLGFPSSPEMQLLYFGLFSVVYTLTLMGNTAIVCAVHWDRHLHTPMYIFLGNFSLLEICYVTRTVPYMSANFLSTSKSISFVCCFTQFYFFFSSGCDEGFFLCIMAFDRYLAICHPLHYPRIMTKQLYTGLVIFGWSSGFFLFLTPVVLISQLPYCGPNTINHFLCDPVPLMILYCSEDSITQLIYSTFNAIFMISTFLFLFCFYALVIVAVLRMPSGASKQQGF

SEQ ID NO: 285 - DNA, 969 bp, Canis familiaris
atgagtatctcaggagccaacaatatctctgggtctgtgagtgagttcattctcctgggcttcccctgccgcagggagctccaggtcctgctctttgtcatcttctcaatcatctaccttctgactctcatggggaacacatccatcatctgcgccgtggcgtcaagccggaaactccacacgcccatgtacatcctgctggccaacttctctttgctggagatctgctatgtcagttctgatgtgcccaagatgttggccaacatcatctcccagaccaagagcatctcctacgccggctgcctgctccagttctatttcttcttctccatgtgtgccgctgagggctactttctgtctgcgatgtcctatgatcggttccttgctatctgtcgacctctacattaccccaccatcatgactcaccatctatgtgcccgattagtggttttctgctgggtaggtggctttctatccatactgatacctgcaattcttatgtcccaggtgcccttctgtggccctaatatcattgaccattttttctgtgacctgggaccactgctggctctgtcctgtgctccagttcccaaaactactctaacttgtgctaccgtaagctcccttatcatcttcatcacttttctctacatccttggatcctataccttagttttgcgagccgtacttcgagtcccagctggctcaggtaggaacaaagctttttctacatgtgcttcacatttcttggtggtttccttgttctatggctcagtcatggtgatgtatgtgagtccaggatccaggagccatcctgggacacagaaatttgtgaccttgttttactgcatggcaacccctttctttaatcctctgatctacagccttcgaaacaaagatatgaaagatgcactcaagaaagtcctgggagcatcatcaaaagaaatttctaaaaatacagagaaatga

SEQ ID NO: 286 - protein, 322 aa, Canis familiaris
MSISGANNISGSVSEFILLGFPCRRELQVLLFVIFSIIYLLTLMGNTSIICAVASSRKLHTPMYILLANFSLLEICYVSSDVPKMLANIISQTKSISYAGCLLQFYFFFSMCAAEGYFLSAMSYDRFLAICRPLHYPTIMTHHLCARLVVFCWVGGFLSILIPAILMSQVPFCGPNIIDHFFCDLGPLLALSCAPVPKTTLTCATVSSLIIFITFLYILGSYTLVLRAVLRVPAGSGRNKAFSTCASHFLVVSLFYGSVMVMYVSPGSRSHPGTQKFVTLFYCMATPFFNPLIYSLRNKDMKDALKKVLGASSKEISKNTEK

SEQ ID NO: 287 - DNA, 942 bp, Canis familiaris
atgacctcagaggccagaaacgcttcccgtagtgggcaggacttcatcctcctgggcttcccttgcagccgggaagtccaattcctcctcttctctatattctttgtgacctacacgctgacgctccttggaaacacggtcatcgtgtgtgcggtgcacggggaccgccggcttcacaccccgatgtatgtcctgctggccaacttctccttcctggagatctgctacgtcaactccgatgtgcccaacatgctggccaacctcctctcccagaccaaaaccatctccttcgctcggtgcctgctccagttgtacttcttcttctccctgggcacaaccgaatgcttgtttctgtccatcatggcctatgaccgcttccttgccatctgccgccccctgcactatcccactgtcatgactattaagttctgtgtccgtctggtcatcttttgctgggtctatggttttctctggtttctgatccctgtgatactcgtgacccagctaccgttttgcggcccgaatgtaattgatgactttctgtgtgacctgggtcctctgctggccttggcttcagcctgtgtcccaatcccagggactgttctcatctgtggcaccatgagttccctcctcatctttgccaccttcctgtacataatcggctcctacagcctggtggtgtgggttgtagtgcaggtgccctccagagccggccggaagaaagccttttctacctgctgctcacatctggctgtcgtgtttctattctatggttccgtcatgatgacatatgtgagcccagggtcaggacaagcagagggaatgcagaagttcacgactctattctactcagttttgaccccttttttcaaccccatgatctacagcctccggaataaagaaatgaaggctgccttgaagaaaattctgggaggttcctaa

SEQ ID NO: 288 - protein, 313 aa, Canis familiaris
MTSEARNASRSGQDFILLGFPCSREVQFLLFSIFFVTYTLTLLGNTVIVCAVHGDRRLHTPMYVLLANFSFLEICYVNSDVPNMLANLLSQTKTISFARCLLQLYFFFSLGTTECLFLSIMAYDRFLAICRPLHYPTVMTIKFCVRLVIFCWVYGFLWFLIPVILVTQLPFCGPNVIDDFLCDLGPLLALASACVPIPGTVLICGTMSSLLIFATFLYIIGSYSLVVWVVVQVPSRAGRKKAFSTCCSHLAVVFLFYGSVMMTYVSPGSGQAEGMQKFTTLFYSVLTPFFNPMIYSLRNKEMKAALKKILGGS

SEQ ID NO: 289 - DNA, 939 bp, Canis familiaris
atgtcaggagtcagcacagtgactgaattcatactcctgagttttctctgctccagaaaggttcaggtcctcctcttcctgctgttctttgtgtcctacatcctgacactgatggggaatggggccattgtctgtgcagtgaagctggatcccagacttcatacccccatgtaccttctgctggccaacttctcgttcctggagatctgttacatcaacaccaccgttcccaatatgttacagaacttcctatctgagaccaaaaccatctctttcacagcctgtttctttcagttctacttcttcttctccatgggcaccactgagactttcttactgcccctcatggcttttgatcggtacttggccatctgccagcctctccattatcctatcatcatgaacaaccgcctctgcatgaacctggtggccctgtgctgggtcacagccttcctctgctatccgatccctatctattttatcacacagctccccttctgtggccccaacgccattgaccactttgtctgtgaccccggtcctcttctggccctgtcctgcatccctgcccctggaattgagctttcctgttctctattgagctctctcattatcttcatcaccttcttcttcatccttggttcgtacacactggttctcagagcagtgttgcgtgtcccctcagcagctggtcgacgtaaggccttctccacctgtggttcccacttggttgtggtctctcttttctatggagccctcatggtaatgtacatcagcccaacctctggaaatccatctgggatacagaagattgtaaccttgttctactcatcagtgaccccacttataaacccactgatctacagtctacggaacaaagacatgaaagctgccttgagaaaaattcatatgagcacaaaaattagtcaaagcaaataa

SEQ ID NO: 290 - protein, 312 aa, Canis familiaris
MSGVSTVTEFILLSFLCSRKVQVLLFLLFFVSYILTLMGNGAIVCAVKLDPRLHTPMYLLLANFSFLEICYINTTVPNMLQNFLSETKTISFTACFFQFYFFFSMGTTETFLLPLMAFDRYLAICQPLHYPIIMNNRLCMNLVALCWVTAFLCYPIPIYFITQLPFCGPNAIDHFVCDPGPLLALSCIPAPGIELSCSLLSSLIIFITFFFILGSYTLVLRAVLRVPSAAGRRKAFSTCGSHLVVVSLFYGALMVMYISPTSGNPSGIQKIVTLFYSSVTPLINPLIYSLRNKDMKAALRKIHMSTKISQSK

SEQ ID NO: 291 - DNA, 936 bp, Canis familiaris
atgaaagtctccagcaccaccaacacatccagcaccatctccggcttcatcctcctgggcttcccttgctccagggaggggcagctcctcctctttgggctcttctccgttctctacctcctcaccctcatgggcaatgggtctatcatctgtgccgtgcgctgggaccagagactccacactcccatgtacatcctgctcgccaacttctccttcctagagatctggtacgtcacctcgactgtccccaacatgctggccaacttcctctctgacaccaaggtcatctccttctccgggtgctttctccagttctactttttcttctccttgggttctacagaatgttttttcttggctattatggcgtttgatcggtaccttgccatctgccggcctctacactacccaaccattatgacaggacgtctctgtgccagtcttgtggtcagttgctgggtacttggtttcttctggttcttgattcccatcatcatcatctcccaaatgtccttctgtggatccaggatcattgaccacttcctatgtgatccaggtcccctgttggccctcacctgtactagagcccctgtgatagagttaactagctccaccttaagttctctgctcttgtttattccctttctctttatcatggtgtcctacactctggtcctgaaagctgtgttgaaagtcccttctgcagctggacgaagaaaggctttctccacctgtgggtctcatctggccgtggtttcactgttctatggctcagtgatggtcatgtatgtgagcccaacatctgagcatgaagctgggatgcagaagatggtgactttgttttattccatagttactccacttatcaaccctgtaatatatagtctaaggaacaaagatatgaaacatgctatgaagaaattactgagaacataa

SEQ ID NO: 292 - protein, 311 aa, Canis familiaris
MKVSSTTNTSSTISGFILLGFPCSREGQLLLFGLFSVLYLLTLMGNGSIICAVRWDQRLHTPMYILLANFSFLEIWYVTSTVPNMLANFLSDTKVISFSGCFLQFYFFFSLGSTECFFLAIMAFDRYLAICRPLHYPTIMTGRLCASLVVSCWVLGFFWFLIPIIIISQMSFCGSRIIDHFLCDPGPLLALTCTRAPVIELTSSTLSSLLLFIPFLFIMVSYTLVLKAVLKVPSAAGRRKAFSTCGSHLAVVSLFYGSVMVMYVSPTSEHEAGMQKMVTLFYSIVTPLINPVIYSLRNKDMKHAMKKLLRT

SEQ ID NO: 293 - DNA, 936 bp, Canis familiaris
atgaaagtctccagcaccaccaacacgtccagcaccatctccggcttcatcctcctgggcttcccttgctccagggaggggcagctcctcctctttgggctcttctccgttctctacctcctcaccctcatgggcaacgggtctatcatctgtgccgtgcgctgggaccagagactccacactcccatgtacatcctgctctccaacttctccttcctagagatctggtacgtcacctcgactgtccccaacatgctggccaacttcctctctgacaccaaggtcatctccttctccgggtgctttctccagttctactttttcttctccttgggttctacagaatgttttttcttggctattatggcgtttgatcggtaccttgccatctgccggcctctacactacccaaccattatgacaggacgtctctgtgccagtcttgtggtcagttgctgggtacttggttttctctggttcccagtccctatcattgttatttcccaaatgtccttctgtggatccaggatcattgaccacttcctatgtgatccgagtcccctattagcactcacctgtgccagagctccagtaatggagtttttttggatgattttaagttccttgctcttatttattcctttcttctgcatcatggggtcctatactctggtcttgagagctgtgttgagggccccttctgcagctggacgaagaaaagctttctctacctgtgggtcccatctggctgtggtttcactgttctatggctcagtgatggtcatgtatctgagcccgacatctgagcatgaatctgggatgcagaagatggtgactctgttttattctgtaggaaccccactcattaatcctgtgatctatagtctaaggaacaaagatatgaaatgtgccctgcagaaatttctaggaatataa

SEQ ID NO: 294 - protein, 311 aa, Canis familiaris
MKVSSTTNTSSTISGFILLGFPCSREGQLLLFGLFSVLYLLTLMGNGSIICAVRWDQRLHTPMYILLSNFSFLEIWYVTSTVPNMLANFLSDTKVISFSGCFLQFYFFFSLGSTECFFLAIMAFDRYLAICRPLHYPTIMTGRLCASLVVSCWVLGFLWFPVPIIVISQMSFCGSRIIDHFLCDPSPLLALTCARAPVMEFFWMILSSLLLFIPFFCIMGSYTLVLRAVLRAPSAAGRRKAFSTCGSHLAVVSLFYGSVMVMYLSPTSEHESGMQKMVTLFYSVGTPLINPVIYSLRNKDMKCALQKFLGI

SEQ ID NO: 295 - DNA, 936 bp, Canis familiaris
atgaaagtctccagcaccaccaacacgtccagcaccatctccagcttcatcctcctgggcttcccttgctccagggaggggcagctcctcctctttgggctgttctccgttctctacctcctcaccctcatgggcaacgggtctatcatctgtgccgtgtgctgggaccagagactccacactcccatgtacatcttgctcgccaacttttccttcctagagatctggtacgtcacctcgactgtccccaacatgctggccaacttcctctctgacaccaaggtcatctccttctccgggtgctttctccagttctactttttcttctccttgggttctacagaatgttttttcttggctattatggcgtttgatcggtaccttgccatctgccggcctctacactacccaaccattatgacaggacgtctctgcgccaggcttgtggtcagttgctgggtacttggtttcttctggttcttgattcccatcatcatcatctcccaaatgtccttctgtggatccaggatcattgaccacttcctatgtgatccaggtcctcttctagcactcacttgcaaaaaagctcctgtggtagagcttgtcttctccactctaagtcctctgcccctcattattccctttctcttcatcatgggatcctacactctggtcctaagagcagtcctgaaagtcccttccacagctggacgaagaaaggctttctccacctgtgggtctcatctggccgtggtttcactgttctatggctcagtgatggtcatgtatgggagcccaacatctgagcatgaagctggaacacagaagatcgtcactctgttttattctgtagtgaccccactccttaatcctgtgatatacagtcttaggaacaaagatatgaagcatgccctgaagaaacttctaggaatataa

SEQ ID NO: 296 - protein, 311 aa, Canis familiaris
MKVSSTTNTSSTISSFILLGFPCSREGQLLLFGLFSVLYLLTLMGNGSIICAVCWDQRLHTPMYILLANFSFLEIWYVTSTVPNMLANFLSDTKVISFSGCFLQFYFFFSLGSTECFFLAIMAFDRYLAICRPLHYPTIMTGRLCARLVVSCWVLGFFWFLIPIIIISQMSFCGSRIIDHFLCDPGPLLALTCKKAPVVELVFSTLSPLPLIIPFLFIMGSYTLVLRAVLKVPSTAGRRKAFSTCGSHLAVVSLFYGSVMVMYGSPTSEHEAGTQKIVTLFYSVVTPLLNPVIYSLRNKDMKHALKKLLGI

SEQ ID NO: 297 - DNA, 906 bp, Canis familiaris
atgaacaattcagagacaagcactgtggctgaatttgtcctcttaggcttcactggttgtcaggaattgcaaagtttccttttctcgttgttctttgggatctatatatttaccataatgggaaacgggaccattgtctgtgctgtgatgctggatcaacggctccatactccgatgtatattctcctagggaacttcgctttcctcaaaatcttgtacgttatgtccacggtacccaggatgctagccaatttcctctcggagacaaaaaccatctcctttgttggctgtttcctccagttatatttttttacttcccttggtacaagtgaaacctatttcctctgcatcatggcgtacgatcagtacctggctatctgccatccactgcactactcaaccaccatgactcaacaattctgctatatcttgatgtctctttcctgggcattggggtttcttagttactctgtctccaccgtacagctctctcaattgcctttctgtggacccaacaccattgatcactttgtgtgtgacatggacccactgatggctctgtcctgtgccccaaatctagtcatggagatcatcctctatatcctaagctccctcattatcatcctcacacttctgtacattcttggctcttatacttttttactgatagttgtgttaaaagtgccttcagctgctggccggcaaagggccttctccacctgtggataacatctgacagtggtatgcttattctttggggcccttttggcaatgtatgtgagccccacagctgataacccagctgaagttcagaagattttgactttgttctattccgtggtgactcccttcttaaaccctctgatttacagtttatgaaacaaggaaatgaaggttgcactaaaa

SEQ ID NO: 298 - protein, 242 aa, Canis familiaris
MNNSETSTVAEFVLLGFTGCQELQSFLFSLFFGIYIFTIMGNGTIVCAVMLDQRLHTPMYILLGNFAFLKILYVMSTVPRMLANFLSETKTISFVGCFLQLYFFTSLGTSETYFLCIMAYDQYLAICHPLHYSTTMTQQFCYILMSLSWALGFLSYSVSTVQLSQLPFCGPNTIDHFVCDMDPLMALSCAPNLVMEIILYILSSLIIILTLLYILGSYTFLLIVVLKVPSAAGRQRAFSTCG

SEQ ID NO: 299 - DNA, 927 bp, Canis familiaris
atggaggcagaaaatagcacagtggtgaaagaattcatccttcttggtctaacccagtctcgaaatattcagctcttggtctttgtgctagttttaatcttctatttcatcatcctccctggaaacttcctcatcatcctcaccatcagaacagatcctggcctcacagcccccctctacttctttctgggcaacttggctttcctggatgcatcctactccttcattgtggctcccaggatgctggtggacttcctttctgagaagaaggtaatctcctacaggggttgcatcactcagctctttttcttgcacttccttggaggaggggaaggattactccttgttgtgatggcctttgaccgctacattgccatctgtcggcctttacactattcaactgtcatgaaccctagagcctgctatgccttgctattggctctgtggcttggaggctttgtccactccattatccaggtggccctcatcctccgcttgcccttctgtggcccaaaccgactggataacttcttctgtgatgtgccgcaggtcatcaagctggcctgcacagacacctttgtggtggagcttctgatggtcttcaatagtggtctgctcactctcctgtgcttcttggggctcttgtcttcctatgcagtcatcctctgccatgtacatgggtctgcttgtgaagggaagagcaaagcagtgtccacgtgtaccactcatgtcatgattatacttctcatgtttgggcctgccatcttcatctacactcgccccttcagggctttatcagctgacaaggtagtttccttctttcacactgtgatctttcctttgttgaatcctgtgatttatacccttcgcaaccaagaagtgaaaacttccatgaggaggttattgagtcggcatgtggtctgctga

SEQ ID NO: 300 - protein, 308 aa, Canis familiaris
MEAENSTVVKEFILLGLTQSRNIQLLVFVLVLIFYFIILPGNFLIILTIRTDPGLTAPLYFFLGNLAFLDASYSFIVAPRMLVDFLSEKKVISYRGCITQLFFLHFLGGGEGLLLVVMAFDRYIAICRPLHYSTVMNPRACYALLLALWLGGFVHSIIQVALILRLPFCGPNRLDNFFCDVPQVIKLACTDTFVVELLMVFNSGLLTLLCFLGLLSSYAVILCHVHGSACEGKSKAVSTCTTHVMIILLMFGPAIFIYTRPFRALSADKVVSFFHTVIFPLLNPVIYTLRNQEVKTSMRRLLSRHVVC

SEQ ID NO: 301 - DNA, 993 bp, Canis familiaris; identical to SEQ ID NO: 15

SEQ ID NO: 302 - protein, 330 aa, Canis familiaris; identical to SEQ ID NO: 45

SEQ ID NO: 303 - DNA, 945 bp, Canis familiaris
atgaataagtcagagatatctactgtgacacagtttgtcttgttgggttttcctggtccctggaaaatacagatcatgcttttctcaatgattttgttggtctatatcttgactctaactgggaatacggccatcatttgtgcagtgagatgggaccatcgactccatacccctatgtatgtgctcctggcaaacttctccttcctagaaatctggtatgtgacttgcaccattcccaacatgctggtcaatttactttccaaaacaaagaccatatcgttctctggttgcttcgctcagttctacttcttcttttccctgggcacaactgagtgcttcttcctctgtgtcatggcgtatgataggtacctggccatctgccatccactgcactacccctccattatgactgggcatctctgtgtcattctggtgttgctttgttggctcattggtttccttggacatgggatcactatattcttcatttctcaactacccttttgtggtcccaacattattgaccactttctgtgtgatgtggacccactgatcacattgtcctgtgcccccgcacacatcatagagcatgtatcccattctgtgagctctcttatcatcattctcaccattttgtacattcttgggtcctatgccctggtgctcagagctgtgcttcaggttccttcttcagctggacggcaaaaggccttctctacctgtggatctcacttagttgtggtgtctctgttttacggaaccataatggcaatgtatgtaagtcccacatctggcaactcagttgctatgcataaggtcatcacactgatatactctgtagtgacaccagtcttaaaccccttcatctacagcctacgcaacagggacatgaaattcgccctccgtcaggtcatttgtggaatgaaaatcctcaaaccctcatga

SEQ ID NO: 304 - protein, 314 aa, Canis familiaris
MNKSEISTVTQFVLLGFPGPWKIQIMLFSMILLVYILTLTGNTAIICAVRWDHRLHTPMYVLLANFSFLEIWYVTCTIPNMLVNLLSKTKTISFSGCFAQFYFFFSLGTTECFFLCVMAYDRYLAICHPLHYPSIMTGHLCVILVLLCWLIGFLGHGITIFFISQLPFCGPNIIDHFLCDVDPLITLSCAPAHIIEHVSHSVSSLIIILTILYILGSYALVLRAVLQVPSSAGRQKAFSTCGSHLVVVSLFYGTIMAMYVSPTSGNSVAMHKVITLIYSVVTPVLNPFIYSLRNRDMKFALRQVICGMKILKPS

SEQ ID NO: 305 - DNA, 945 bp, Canis familiaris
atgaatgtgtcaggagtcagcacagtgactgaattcatactcctgagttttccgtgctccagagaggttcagatcctcctcttcctgctgttctttgtgtcctacatcctgacactgatggggaatggggccattgtctgtgcagtgaagctggatcccaggcttcacacccccatgtaccttctgctggccaacttctcgttcctggagatctgttacatcaacaccaccgttcccaatatgttacagaacttcctatctgagaccaaaaccatctctttcacagcctgtttcttccagttctacttcttcttctccatgggcatcaatgagaccctcttactgcccctcatggcttttgatcggtacttggccatctgccagcctctccattatcctatcatcatgaacaaccgcctctgcatgaacctggtggccctgtgctgggtcacagccttcctctgctatccgatccctatctattttatcacacagctccccttctgtggccccaacgccattgaccactttgtctgtgaccccggtcctcttctggccctgtcctgcatccctgcccctggaattgagctttcctgttctctattgagctctctcattatcttcatcaccttcttcttcatccttggttcgtacaccctggttctcagagcagtgttgcgtgtcccctcagcagctggccgacgtaaggccttctctacctgtggttcccacctggctgttgtgtctcttttttatggatccatcatggttatgtacatcagcccaacctctgcgaatccagctgggatacagaagattataaccctgttctactcatcagtgaccccacttataaacccactgatctacagtctacggaacaaagacatgaaagctgccttgagaaaaattcatatgtgcggagaaattagtcaagacaaatga

SEQ ID NO: 306 - protein, 314 aa, Canis familiaris
MNVSGVSTVTEFILLSFPCSREVQILLFLLFFVSYILTLMGNGAIVCAVKLDPRLHTPMYLLLANFSFLEICYINTTVPNMLQNFLSETKTISFTACFFQFYFFFSMGINETLLLPLMAFDRYLAICQPLHYPIIMNNRLCMNLVALCWVTAFLCYPIPIYFITQLPFCGPNAIDHFVCDPGPLLALSCIPAPGIELSCSLLSSLIIFITFFFILGSYTLVLRAVLRVPSAAGRRKAFSTCGSHLAVVSLFYGSIMVMYISPTSANPAGIQKIITLFYSSVTPLINPLIYSLRNKDMKAALRKIHMCGEISQDK

SEQ ID NO: 307 - DNA, 951 bp, Canis familiaris
atgaacaggtcagcgacacacattcacgttgtaaccgagtttgtcctcctgggattccccggttgctgggagatacagattttcctcttctccttctttttggtggtttatgtcttgaccctgctgggaaatggaaccattatctgtgcagtgagatgggagccgcgattacacacccccatgtactttctgctgggcaacttcgccttccttgagatctggtatgcttcctccactgttcccaatgtcctggccaacatcctctccaaaaccaaggccatctcattttctggctgcttcctccagttctacttcttcttttccctgggcacgactgaatgtctcttcctggcagtaatggcttatgatcgttacctggccatctgccacccactgcactaccccaccgtcatgactgggaaactctgtagaactctggtgtctctctgctggctcactggattccttggctacccaatccccattttcctcatctcccgactccctttctgtggatccaatatcattgatcacttcctgtgtgacatggaccccctgatggccctgtcttgtgctccagcccccattactgaacttattttctacactcagagctcccttgttctcttttttactattatgtacattcttcgatcctacatcttgttactcagagctgtttttctggtcccttctgcagctggccggagaaaggccttttccacctgtggttctcatttagctgtggtgtctcttttttatgggacagtcatggtaatgtatgtgagtcctacatatggcatcccaactttgatgcagaagattctcacactggtatattcgataatgacgcctctctttaatccgctgatctatagtcttcgcaataaggacatgaaactcgccctgagaaacatcctgtttagaatgagaattagtcaaaactcttga

SEQ ID NO: 308 - protein, 316 aa, Canis familiaris
MNRSATHIHVVTEFVLLGFPGCWEIQIFLFSFFLVVYVLTLLGNGTIICAVRWEPRLHTPMYFLLGNFAFLEIWYASSTVPNVLANILSKTKAISFSGCFLQFYFFFSLGTTECLFLAVMAYDRYLAICHPLHYPTVMTGKLCRTLVSLCWLTGFLGYPIPIFLISRLPFCGSNIIDHFLCDMDPLMALSCAPAPITELIFYTQSSLVLFFTIMYILRSYILLLRAVFLVPSAAGRRKAFSTCGSHLAVVSLFYGTVMVMYVSPTYGIPTLMQKILTLVYSIMTPLFNPLIYSLRNKDMKLALRNILFRMRISQNS

SEQ ID NO: 309 - DNA, 996 bp, Canis familiaris
atggctcctggcgagaaccagagcagcggtgtgaccgagttcatcttggcaggcttcccaaatctcaacaacacaaaagcagaagtgttctctgtcttccttcttgtctacctgctgactctaacaggcaacgtgctgattgttggggtggtgggagcggatgctcgcctgcagacccccatgtacttcttcctgggcaacctgtcctgcctcgagatcttgctcacttccgtcatcattcccaagatgctgagcaatttcctttccaggcaacacaccatctcctttgctgcatgcattactcaattctatttctacttctttcttggggcctctgagttcctgctgttggccgtcatgtctgtggatcgctacctggccatctgtcaccctctgcactatcccttgctcatgaatggtgctgtgtgctctcgggtggccttggcctgctggatggggggacttgtccctgtgcttggccccacggtggctgtggccttacttcccttctgtgaacagcacactgtggtgcagcatttcttctgtgacagtggccctctgctccgcctggcatgcaccaacaccaagaagctggaggaaacagacttcgtgctggcctctctggtcatcatatcctcgctgatgattactgctgtgtcctatggccacatagctctggctgtcctgcgcattccctctgtttccggccgtcagaaggccttctctacctgtacctctcacttgatggtggtgaccctcttctatggaagtgccatttttctctatgtgcgaccatcacagagtggctctgtgaataccaactgggcagtgacagtggtaacaacgtttgtgacaccgctgctgaatccattcatctatgccttacgcaatgagcgagtcaaggaagctttgaaggatatgttcaggaagatgggagtaggcttttgggggaatcttctactcactaagaatttcagtaagaagacagtgaagtga

SEQ ID NO: 310 - protein, 331 aa, Canis familiaris
MAPGENQSSGVTEFILAGFPNLNNTKAEVFSVFLLVYLLTLTGNVLIVGVVGADARLQTPMYFFLGNLSCLEILLTSVIIPKMLSNFLSRQHTISFAACITQFYFYFFLGASEFLLLAVMSVDRYLAICHPLHYPLLMNGAVCSRVALACWMGGLVPVLGPTVAVALLPFCEQHTVVQHFFCDSGPLLRLACTNTKKLEETDFVLASLVIISSLMITAVSYGHIALAVLRIPSVSGRQKAFSTCTSHLMVVTLFYGSAIFLYVRPSQSGSVNTNWAVTVVTTFVTPLLNPFIYALRNERVKEALKDMFRKMGVGFWGNLLLTKNFSKKTVK

SEQ ID NO: 311 - DNA, 948 bp, Canis familiaris
atgaaaaaaagcaatgattctaaggtgacagaatttgttcttctgggcctatcatcctcctgggagctacagctgtttctcttcttcatatttttattgttttacatgactgttattctgggaaacctgttgataatggtaacagtgcgagctgatgctcacctgctccaatctcccatgtactattttttgggtcatctgtctttcattgacctatgcctaggctgtgttaccgtgcccaagatgttaagagattttctacaacaaggaaagatcatctctttttcaggatgtttgacccagatctacttcctgcactttctgggagccaatgagacatttctgttgacggtcatggcctatgataggtatgtggccatatgtaatcccttgcactacctgacagtcatgaaccgccagctgtgctttcagttggtttttacctgttggtttgggggtttcatccactctatatcacaggtcacactggtaatccagctgcccttctgtggccccaatgaactggacaacttctactgtgacgtccctcaggtcatcaagctcgcgtgcatggatacatatgtagtagaggtgctcatggtctcaaacagtggtcttctctctctcatctgcttctttgtcttgctgttctcttacgccatcatcctgaccactctgagaactcgcttccaccagggccggagcaaggcactctctacctgtgcctctcacctaacagtggtcagcctgatctttgtgccatgtgtattcatctacctgagacctttctgcagcttctccgtggataagatattctctgtcttttacacagtgatcacacctatgttgaacccgcttatctacacactcagaaatgctgacatgaagagagccatgaaaaagctaagaaaaaagtatgcggcattcttcttccatagtaaaggatga

SEQ ID NO: 312 - protein, 315 aa, Canis familiaris
MKKSNDSKVTEFVLLGLSSSWELQLFLFFIFLLFYMTVILGNLLIMVTVRADAHLLQSPMYYFLGHLSFIDLCLGCVTVPKMLRDFLQQGKIISFSGCLTQIYFLHFLGANETFLLTVMAYDRYVAICNPLHYLTVMNRQLCFQLVFTCWFGGFIHSISQVTLVIQLPFCGPNELDNFYCDVPQVIKLACMDTYVVEVLMVSNSGLLSLICFFVLLFSYAIILTTLRTRFHQGRSKALSTCASHLTVVSLIFVPCVFIYLRPFCSFSVDKIFSVFYTVITPMLNPLIYTLRNADMKRAMKKLRKKYAAFFFHSKG

SEQ ID NO: 313 - DNA, 930 bp, Canis familiaris
atggaagtggctaacaatgtcactgagtttatattcctaggcctctcccaggatcctggaatgcagttgatgttctttgccttgttcctcttcttctacatcgtgatcatggtgggaaacctgctcattctacttacggtcttctctgatccccggctccacacacccatgtatttcttcctcagtaacctgtcctttgtggacattgcctattcctcagccacagcacccaagatgattgcagactttgtttctgagaaaaagaccatttcctactggggctgtgtaactcagatgtttaccttccacttttttggttgtgctgagatttttgtcttgactgttatggcttttgaccgttatgctgccatctgccagcctctccgttatacgaccatcatgagtgccaatgcttgtatcatgctggcatcactgtcctggctgggagcgctgggtcattcctttgttcagaccctcctgacctttcagctgcctttctgccataatcaggtcattgaccactacttctgtgatgtccacccagtcctaaagcttgcctgtgctgatacaaccctggtaaatatgttggtgattgccaacagtggtctcatctctttagggtgcttcctcattcttctggcctcctacactgtcattctctttagtcttcgcaagaggtcttcagagagccggcgcaaggctctttctacctgtgggtctcatttcactgtagtaacgttcttctttgtcccttgtatctttatttacctccgtccatccactactttccccctggataaggctgtgtctgtgttctatactaccatcaccccaatgctgaacccgctcatctacactctgaggaatgaggatgtaaagaatgccatgaaacgcatatggaataacatggtctccttgaaggaaaagtaa

SEQ ID NO: 314 - protein, 309 aa, Canis familiaris
MEVANNVTEFIFLGLSQDPGMQLMFFALFLFFYIVIMVGNLLILLTVFSDPRLHTPMYFFLSNLSFVDIAYSSATAPKMIADFVSEKKTISYWGCVTQMFTFHFFGCAEIFVLTVMAFDRYAAICQPLRYTTIMSANACIMLASLSWLGALGHSFVQTLLTFQLPFCHNQVIDHYFCDVHPVLKLACADTTLVNMLVIANSGLISLGCFLILLASYTVILFSLRKRSSESRRKALSTCGSHFTVVTFFFVPCIFIYLRPSTTFPLDKAVSVFYTTITPMLNPLIYTLRNEDVKNAMKRIWNNMVSLKEK

SEQ ID NO: 315 - DNA, 951 bp, Canis familiaris
atggaacctgcaaattacactagggtgacggaatttgttctcactggcttatcccagactcgagaggtacaactagtcctatttgttatatttctgtccttctatctgttcatcctcccaggaaatgttcttattatttgcaccatcaggctggaccctcacctgacctcacccatgtatttcctgctggctaacctggccttccttgacatttggtactcctccatcacggcccctaaaatgctcgtagacttctttgtggaaagaaagaggatttctttcggtgggtgcattgcacagctcttctttttgcacttcgttggggcctccgagatgttcctgctcacagtaatggcctttgaccgctatgctgctatctgccgccctctccactatgctactatcatgaatcgacgtctctgctgtatcctggtggctctctcctggttggggggcttcattcattctataatacaagtggtcctcatcgtccgacttcccttctgcgggcccaatgagttagacagttacttctgtgatatcacgcaggtcgtccgcattgcctgtgccaataccttccccgaggagttagtgatgatttttagcagtggtctgatctctgtagtatgcttcattgctctcctaatgtcctatgccttcctcctggccatgttgaggaaacactcaggctcaggtgagagtaccagtcgggccatgtccacctgctattcccacatcacgattgtggtgttcatgtttggaccatctatctacatttatgctcgaccatttgactcgttttccctcgataaggttgtgtctgtgttccatactgtgatattccctttacttaatcccattatctacaccttgagaaataaagaagtaaagacggccatgaggaagttggtcaacagatatattttatgtagagaagtgaaagataagtga

SEQ ID NO: 316 - protein, 316 aa, Canis familiaris
MEPANYTRVTEFVLTGLSQTREVQLVLFVIFLSFYLFILPGNVLIICTIRLDPHLTSPMYFLLANLAFLDIWYSSITAPKMLVDFFVERKRISFGGCIAQLFFLHFVGASEMFLLTVMAFDRYAAICRPLHYATIMNRRLCCILVALSWLGGFIHSIIQVVLIVRLPFCGPNELDSYFCDITQVVRIACANTFPEELVMIFSSGLISVVCFIALLMSYAFLLAMLRKHSGSGESTSRAMSTCYSHITIVVFMFGPSIYIYARPFDSFSLDKVVSVFHTVIFPLLNPIIYTLRNKEVKTAMRKLVNRYILCREVKDK

SEQ ID NO: 317 - DNA, 948 bp, Canis familiaris
atgaaaaaaagcaatgattctaaggtgacagaatttgttcttctgggcctatcatcctcctgggagctacagctgtttctcttcttcatatttttattgttttacatgactgttgttctgggaaacctgttgataatggtaacagtacgagctgatgctcacctgctccaatctcccatgtactattttttgggtcatctgtctttcattgacctatgcctgggctgtgttaccgtgcccaagatgttaagagattttctacaacgaggcaagatcatctctttctcaggatgtttggcccagatctacttcctgcactttctgggagccagtgagatgtttctgttgacggtcatggcctatgataggtatgtggccatatgtaatcccttgcactacctgacagtcatgaaccgccagttatgctttcagttggtttttgcctgttggtgtgggggtttcatccactctatcacacaggtcatgctggtgatccagctgcccttctgtggccccaatgaactggacaacttctactgtgacgtccctcaggtcatcaagctcgcgtgcatggatacatatgtagtagaggtgctcatggtctcaaacagtggtctgctctctctcatctgtttcttggtcttgctgttctcttacgccatcatcctgaccactctgagaactcgcttccgccagggccggagcaaggcactctctacctgtgcctctcacctaacagtggtcagcctgatctttgtgccatgtgtattcatctacctgagacctttctgcagcttctctgtggataaggttttctctgtcttttacacagtgatcacacctatgttgaaccctcttatctacacactcagaaatgctgacatgaagacagccatgaaaaagctaagaaaaaagtatgcagcatccttcttccatagtaaaggatga

SEQ ID NO: 318 - protein, 315 aa, Canis familiaris
MKKSNDSKVTEFVLLGLSSSWELQLFLFFIFLLFYMTVVLGNLLIMVTVRADAHLLQSPMYYFLGHLSFIDLCLGCVTVPKMLRDFLQRGKIISFSGCLAQIYFLHFLGASEMFLLTVMAYDRYVAICNPLHYLTVMNRQLCFQLVFACWCGGFIHSITQVMLVIQLPFCGPNELDNFYCDVPQVIKLACMDTYVVEVLMVSNSGLLSLICFLVLLFSYAIILTTLRTRFRQGRSKALSTCASHLTVVSLIFVPCVFIYLRPFCSFSVDKVFSVFYTVITPMLNPLIYTLRNADMKTAMKKLRKKYAASFFHSKG

SEQ ID NO: 319 - DNA, 744 bp, Canis familiaris
atcctgactctcatgggaaatggagctattattggtgctgtgtgttgggaccagcatctccacacccccatgtagatcctgctggggaattttgcattcctggagatctggtatgtcaatctcactgttgcaaacacactgatcaacttcctttcagacttcttttccatgggctccactgagtgcttctttctctcagcaatggcctttgattgctactctgccatctgccatcctctgtattatgccacaattatgtctggacaacgttgtttcaacttagtgatctcttgttgggcctgtggctttctctgctatctggtacctgttatcctcatctcccaactgcctttctgtggtcctaatgcaattgatcattttgtatgtgactcaggcccattgctgaccctttcatgtgctcctgtccctatgtccaagctcatcagctgtaccctaagctccctcaacatcctccttagcttctttttcatcctcatctcctgtgccctggttctacttgctgtgcttcggttgccctcagcatccattaggcataaggctttttcagtgtgtgggtcccatttgtcaatggtgttgctattctacaggaccattatggtgatgcatgagagccctggatcccaccactctgccctgatgccaaagatcatgaccttgttctatgcaatgataactccattcttcaaccttttgatttacagtctcaggaataaggagatgaaa

SEQ ID NO: 320 - protein, 192 aa, Canis familiaris
MGSTECFFLSAMAFDCYSAICHPLYYATIMSGQRCFNLVISCWACGFLCYLVPVILISQLPFCGPNAIDHFVCDSGPLLTLSCAPVPMSKLISCTLSSLNILLSFFFILISCALVLLAVLRLPSASIRHKAFSVCGSHLSMVLLFYRTIMVMHESPGSHHSALMPKIMTLFYAMITPFFNLLIYSLRNKEMK

SEQ ID NO: 321 - DNA, 870 bp, Canis familiaris
atgcagctgatgttctttgccttgttcctcttcttctacatcgtgatcatggtgggaaacctgctcattctacttatggtcttctctgatccccggctccacacacccatgtatttcttcctcagtaacccgtcctttgtggacattgcctattcctcagccacagcacccaagatgattgcagactttgtttctgagaaaaagaccatttcctactggggctgtgtaactcagatgtttaccttccacttttttggttgtgctgagatttttgtcttgactgttatggcttttgaccgttatgctgccatctgccagcctctccgttatacgaccatcatgagtgccaatgcttgtatcgtgctggcatcactgtcctggctgggagtgctgggtcattcctttgttcagaccctcctgacctttcagctgcctttctgccataatcaggtcattgaccactacctctgtgatgtccacccagtcctaaaacttgcctgtgctgatacaaccctggtaaatatgttggtgattgtcaacagtggtctcattgctctagggtgcttcctcattcttctggcctcctacactgtcattctctttagtcttcgcaagaggtcttcagagagccggcgcaaggctctttctacctgcgggtctcatttcactgtagtaatgttcttctttgtcccttgtttctttatttacctccgaccatccaccactttccccctggataaggctgtgtctgtgttctatactaccatcaccccaatgctgaacccgctcatctatactctgaggaatgaggatgtaaagaatgccatgaaacagatatggagtcacatggtctccttgaaggaaaagtag

SEQ ID NO: 322 - protein, 289 aa, Canis familiaris
MQLMFFALFLFFYIVIMVGNLLILLMVFSDPRLHTPMYFFLSNPSFVDIAYSSATAPKMIADFVSEKKTISYWGCVTQMFTFHFFGCAEIFVLTVMAFDRYAAICQPLRYTTIMSANACIVLASLSWLGVLGHSFVQTLLTFQLPFCHNQVIDHYLCDVHPVLKLACADTTLVNMLVIVNSGLIALGCFLILLASYTVILFSLRKRSSESRRKALSTCGSHFTVVMFFFVPCFFIYLRPSTTFPLDKAVSVFYTTITPMLNPLIYTLRNEDVKNAMKQIWSHMVSLKEK

SEQ ID NO: 323 - DNA, 993 bp, Canis familiaris
atgactgacccagtgaatgtctctgagccatattccagcttcgcttctgtaagagaatttatactcctaggtttctcttgtgagtggaagattcagatcctcctcttctcactcttcactacaacgtatactttgacggtaacagggaatggggccattgtttgtgctatttggtgtgaagggagactccatagccccatgtacatgttcctggggaatttctcctttctagagatctggtatgtctcttctacagtccccaatatgttggccaatttcctctcagaaaaaaagaccatctcctttactggatgtttcgtccaattttatttctttttctctttgggaacttctgaatgtttgctcttggccatcatggcctttgatcggtaccttgctatctgccgtcccttgcactaccctaatatcatgactaggtatttatctaccaaactggtcattatctgctgggtttgtggttttctgttgttcctgatccccattgcattcatctctcagatgcccttctgtggtccaaacattattgaccatgttgtgtgtgacccagggccactgtttgcattggcatgtgcatctgccccaacaatccaacagctttgctatagtctaagctcattagttatctttggtaacttccttttcatccttgggtcctatacacttgtcctgttagctgtgttgcacatgccttcaaccctcgggagacataaggccttctctacctgtggttctcatttggctgtggtatcactattctatggctctctgatgatcatgtatgtgagcccaggacttgggcattctgcaggtatacagaaagttgcaactttgttctatgctatggtaactccactcttcaacccgctcatctatagcctccggaataaggagataaaggcagccctgaggaaagttctggggcgttgctacatgacccaagatgtactatgtgattgctccaggtcagtatag

SEQ ID NO: 324 - protein, 330 aa, Canis familiaris
MTDPVNVSEPYSSFASVREFILLGFSCEWKIQILLFSLFTTTYTLTVTGNGAIVCAIWCEGRLHSPMYMFLGNFSFLEIWYVSSTVPNMLANFLSEKKTISFTGCFVQFYFFFSLGTSECLLLAIMAFDRYLAICRPLHYPNIMTRYLSTKLVIICWVCGFLLFLIPIAFISQMPFCGPNIIDHVVCDPGPLFALACASAPTIQQLCYSLSSLVIFGNFLFILGSYTLVLLAVLHMPSTLGRHKAFSTCGSHLAVVSLFYGSLMIMYVSPGLGHSAGIQKVATLFYAMVTPLFNPLIYSLRNKEIKAALRKVLGRCYMTQDVLCDCSRSV

SEQ ID NO: 325 - DNA, 927 bp, Canis familiaris; identical to SEQ ID NO: 17

SEQ ID NO: 326 - protein, 308 aa, Canis familiaris; identical to SEQ ID NO: 47

SEQ ID NO: 327 - DNA, 948 bp, Canis familiaris
atggaagcgggggacctactcaatcaaaccaccttagtgacacacattcggcttagaggcttatctgtagatcagagggtgcagatggctgtgtttgccatgttcctcactttctacgtcctgacactggctgggaacatcctcattgtcataactattatctacgaccgccggcttcatacccccatgtatttcttcctcagtaacctgtcttttatcgatgtgtgccactccactgtcactgtccccaagatgctggtagacacatgggcagaagagaagcttatctcctttgacggctgcgtcactcagatgtttttcctgcacctcttcgcctgcaccgagatctttctgctcaccgtcatggcctacgaccggtatgtggccatttgcaagcccctgcagtacctgacggtgatgagctggagagtgtgtgtgctgctggctgtagccctgtgggtgggggggacaatccactccatatcgctgacctccctcaccatcacgctgccctactgtggtcctgatgagattgacagcttcttctgcgatgtgcctcaggtgatcaaactggcctgcacggatacccacatcattgaaatcctcatcgtctccaacagcggcctgatctccgtggtgtgtttcgtggtcctcgtggtgtcctacgcggtcatcctggtgagcctgcggcagcagatctccgaaggcaggcgcaaggccttatccacctgtgcggcccacctcaccgtcgtcacactgttcctgggacattgcatcttcatctattcccgcccatccaccagcctcccggaagacaaggtggtgtctgtgtttttcacggccgttacccccctgctgaaccccatcatctatactcttaggaatgaagacatgaagaatgccttgaacaagttaatgggaaggttggaggggaaaggtaaaaaatga

SEQ ID NO: 328 - protein, 315 aa, Canis familiaris
MEAGDLLNQTTLVTHIRLRGLSVDQRVQMAVFAMFLTFYVLTLAGNILIVITIIYDRRLHTPMYFFLSNLSFIDVCHSTVTVPKMLVDTWAEEKLISFDGCVTQMFFLHLFACTEIFLLTVMAYDRYVAICKPLQYLTVMSWRVCVLLAVALWVGGTIHSISLTSLTITLPYCGPDEIDSFFCDVPQVIKLACTDTHIIEILIVSNSGLISVVCFVVLVVSYAVILVSLRQQISEGRRKALSTCAAHLTVVTLFLGHCIFIYSRPSTSLPEDKVVSVFFTAVTPLLNPIIYTLRNEDMKNALNKLMGRLEGKGKK

SEQ ID NO: 329 - DNA, 942 bp, Canis familiaris
atgggagaaaatcagaccgtggtcacagagtttattctactaggattttgtcttggcccaagaattcagatggttctctttgggctctttaccctgttctacaccctcaccctgctgggaaatgggctcatcctggggctcatttcactggacctcagactgcacacccccatgtacttcttcctctcccacctggccatcgtcgacatagcctatgcctgcaacacagtgccccagatgctggtgaacctcctgaggccagacaagcccatctcctttgctggctgcctgacgcagacctttcttttcttgagttttgctcatactgaatgtcttctcctggtggtgatgtcctatgaccggcatgtggccatctgccaccccctccactattgtgtcatcatgagctggagagtctgcatcaccctggtggtggcttcttgggcatgtggcttcctgctggctctggtccatgtgagcctcatcctgaggctgcccttctgtgggcctcatgaaatcaaccacttcttctgtgaaatcctgtctatcctcaagctggcctgtgctgacacccggcttaaccaagtggtcatctttgttgcctgcatgtttatcttagtggtgcccctctgtttggtgctggtgtcctactcgcgaatcctgttggccatcctgaggatccagtctggggagggccgcagaaaggccttctccacctgctcctcccacctctgtgtggtggggctcttctttggcagcgccattgtcatgtacatggtccccaaatcccgccaccctgaagaacagcagaagatccttttcttattttacagttttttcaaccctatgctgaaaccactgatctacagcctgagaaatgcagaggtcaagggtgccctgaagagagtgctatacaaggagagtcattcccaattggagtga

SEQ ID NO: 330 - protein, 313 aa, Canis familiaris
MGENQTVVTEFILLGFCLGPRIQMVLFGLFTLFYTLTLLGNGLILGLISLDLRLHTPMYFFLSHLAIVDIAYACNTVPQMLVNLLRPDKPISFAGCLTQTFLFLSFAHTECLLLVVMSYDRHVAICHPLHYCVIMSWRVCITLVVASWACGFLLALVHVSLILRLPFCGPHEINHFFCEILSILKLACADTRLNQVVIFVACMFILVVPLCLVLVSYSRILLAILRIQSGEGRRKAFSTCSSHLCVVGLFFGSAIVMYMVPKSRHPEEQQKILFLFYSFFNPMLKPLIYSLRNAEVKGALKRVLYKESHSQLE

SEQ ID NO: 331 - DNA, 933 bp, Canis familiaris
atggcgggaaatcagacctctgtcacagagttcatcctattgggctttcccctcagcccagagattcagatggttctctttgggctcttcaccctgttctacgccttcaccctgctggggaatgggctcatcctggggctcatctcactggaccccagactgcacacccccatgtacttcttcctctcccacctggccatcgtcgacatagcctatgcctgcaacacggtgccccagatgctggtgaacctcctgaggccagacaagcccatctcctttgctggctgcttgacgcagacctttcttttcttgacctttgctcatactgagtgtcttctcctggtggtgatgtcctatgaccggtacgtggccatcagccaccccctccactattctgtcatcatgagctggagagtctgcatcaccctggcattgactgcctggattttaggagtgctcctggccctagtacatctagggttactcataccattgcctttctgtggaccccagaaagtcaaccactttttctgtgaaattatagctgtcctcaaacttgcctgtgcagatacccacgttaatgagattatggtattgactggggccgtgtctgtgctggtagggccttttacctcaattgtgatatcatacattcatattctacgtgccatcctgaagattcagtcaggggaggggcgccagaaagccttctccacctgctcatcccatctctgtgtggttggactcttttatggcacagccattataatgtatgttgggcccagatatgggaaccccaaggagcaaaagaaatacctgctcctgtttcacagccttttcaatcccatgctcaatccccttatctatagtctgaggaacaaagaagtcaaagctgctctgaagaggattcttgaaaaagaaagaacttcatga

SEQ ID NO: 332 - protein, 310 aa, Canis familiaris
MAGNQTSVTEFILLGFPLSPEIQMVLFGLFTLFYAFTLLGNGLILGLISLDPRLHTPMYFFLSHLAIVDIAYACNTVPQMLVNLLRPDKPISFAGCLTQTFLFLTFAHTECLLLVVMSYDRYVAISHPLHYSVIMSWRVCITLALTAWILGVLLALVHLGLLIPLPFCGPQKVNHFFCEIIAVLKLACADTHVNEIMVLTGAVSVLVGPFTSIVISYIHILRAILKIQSGEGRQKAFSTCSSHLCVVGLFYGTAIIMYVGPRYGNPKEQKKYLLLFHSLFNPMLNPLIYSLRNKEVKAALKRILEKERTS

SEQ ID NO: 333 - DNA, 933 bp, Canis familiaris
atgacagaaaatcaaacatgggtcccagaattcattctcctgggattcccactcagcccaaagctgcgggtgttcctctttgggctcttcaccctgttctacgccttcaccctcctggggaacagcatcatcctggggctcatctcactggactcccgactgcacacccccatgtactttttcctctcccacctggccatcgttgatatagcctatgcttcaaataatgtcccaaagatgctggcaaaccttctaaacaaggaaaaaactatctcctttgtcccatgcataatgcagacctttttatacatggcttttgctcacacggagtgtctcatcttagtaatgatgtcctatgaccggtacgtggcaatctgccatcccctacattactctgtcatcatgagctggagagtgtgcactgttcaggctgtcacttcctgggcatgtggctccctgctggccctggtccatgtgattctcatcctgaggctgcccttctgtgggcctcatgaaatcaaccacttcttctgtgaaatcctgtctgtcctcaagctggcctgtgctgacactaggctcaaccaagtggtcatttttgctgcttctgtgtttatcttagtggggcccctctgcttggtgctggtgtcctactcgcgcatcctgtttgccatcctgaggatccagtctggggaaggccgcagaaaggccttctccacctgctcctcccacctctgtgtggtggggctcttctttggcagcgccattgtcatgtacatggcccccaaatccaaccaccctgaggagcagcagaagatcctttctctgttttatagccttttcaaccctatgctgaacccactgatctacagcctgaggaacacagaagtcaagggtgccctgaagagagtgctatggaaggagagatcattgtga

SEQ ID NO: 334 - protein, 310 aa, Canis familiaris
MTENQTWVPEFILLGFPLSPKLRVFLFGLFTLFYAFTLLGNSIILGLISLDSRLHTPMYFFLSHLAIVDIAYASNNVPKMLANLLNKEKTISFVPCIMQTFLYMAFAHTECLILVMMSYDRYVAICHPLHYSVIMSWRVCTVQAVTSWACGSLLALVHVILILRLPFCGPHEINHFFCEILSVLKLACADTRLNQVVIFAASVFILVGPLCLVLVSYSRILFAILRIQSGEGRRKAFSTCSSHLCVVGLFFGSAIVMYMAPKSNHPEEQQKILSLFYSLFNPMLNPLIYSLRNTEVKGALKRVLWKERSL

SEQ ID NO: 335 - DNA, 927 bp, Canis familiaris
atggaagtggagaaccagacccaggtcaccaagttcattctggtggggtttcctgggaactggggcatgcgggtagcagtgttcctgatgttcctcatggcctatattgtgacagtggctgaaaatgtggtcatcatcctgctggtgcagcaaaaccggccactgcacaagcctatgtacttcttcctggccaacctgtctttcttggagacctggtacatctctgtgactgtgcctaaattactatttagtttttggtctgtgaacaacagtatctccttcactcactgtatgatacaactttacttcttcattgccctcatgtgcacagaatgtgtgctcctggctgccatggcctttgatcgttatgtagccatctgccgtccactccactaccccaccattatgagccatgggctttgcttccgcttggctcttggttcctgggccattggctttggcatctccttagctaagatttactttatctctcgcctcagtttctgtggccccaatgtcatcaatcacttcttctgtgacatctctccagtacttaacctctcctgcacagacatgtctgtagctgagctggtagactttgtcctggcattggtcatctttctcttccccctctctatcactgttctgtcctatggatgcatcctggccactgttctacgcatgcctaccggaaagcagaaagcgttctctacttgtgcctcccaccttgtggtggtcaccatcttctattcagccacgattttcatgtatgccaggccccgagccatccatgccttcaacatgaacaaagtgatttccatcttctatgctattgtcacccctgcactcaaccctttcatttattgcctaaggaacagagaggtcaaagaggctctgaagaaactggcctattgccaagctatctga

SEQ ID NO: 336 - protein, 308 aa, Canis familiaris
MEVENQTQVTKFILVGFPGNWGMRVAVFLMFLMAYIVTVAENVVIILLVQQNRPLHKPMYFFLANLSFLETWYISVTVPKLLFSFWSVNNSISFTHCMIQLYFFIALMCTECVLLAAMAFDRYVAICRPLHYPTIMSHGLCFRLALGSWAIGFGISLAKIYFISRLSFCGPNVINHFFCDISPVLNLSCTDMSVAELVDFVLALVIFLFPLSITVLSYGCILATVLRMPTGKQKAFSTCASHLVVVTIFYSATIFMYARPRAIHAFNMNKVISIFYAIVTPALNPFIYCLRNREVKEALKKLAYCQAI

SEQ ID NO: 337 - DNA, 942 bp, Canis familiaris
atgggccaggaaaataaaacccagacatgggtgagtgagttcgttctgctgggattgtccagtgactgggaaactcaagtcttcctctttctcctggtcctgaccatgtacttggtgactcttgtgggaaatgtcctcattcttcttctgatcagactggacagcaggcttcataaccccatgtacttcttccttagtgttttatcctttgtggacctttgttatgcaaatagtattgccccacaaatgctggcccacctgctctcagcccagaagtccatcccattctataactgtgtgctccaactctatacctccttggcattgggtgggtctgagttcttcctgctgggagccatggcctatgaccgctatgtggcagtgtgccatccactgcactacacagtcatcatgcatggagagctgtgcctggggttggctgccggctgcttggtggctggtttcacaaattcgctgatggaaacaatcattacattccggcttcccttgtgtcacaatgttattaatcactttgcctgtgagaccctagcagtgctacggctagcttgtgtggacgtctccttcaacaaggtcatggtggccacctcaggatttttggtgatcatgcttccctgttccctggttctgttctcctatggtcgtatagttattaccattctgcatatccattctactcagggacgtagcaaagcctttgggacttgtgcctcccacctcactgtggtttgcatgtgctttggggctaccatcttcacctacttgggtccacggtcagcctcttcagtggaagaggagaagatggttgctctattctatgctgtggtggcgcctatgttgaaccccttgatctatagcttgaggaataaggaagttatggctgctcttcaaaaggttctcaagaaattcagagataaagagtaa

SEQ ID NO: 338 - protein, 313 aa, Canis familiaris
MGQENKTQTWVSEFVLLGLSSDWETQVFLFLLVLTMYLVTLVGNVLILLLIRLDSRLHNPMYFFLSVLSFVDLCYANSIAPQMLAHLLSAQKSIPFYNCVLQLYTSLALGGSEFFLLGAMAYDRYVAVCHPLHYTVIMHGELCLGLAAGCLVAGFTNSLMETIITFRLPLCHNVINHFACETLAVLRLACVDVSFNKVMVATSGFLVIMLPCSLVLFSYGRIVITILHIHSTQGRSKAFGTCASHLTVVCMCFGATIFTYLGPRSASSVEEEKMVALFYAVVAPMLNPLIYSLRNKEVMAALQKVLKKFRDKE

SEQ ID NO: 339 - DNA, 936 bp, Canis familiaris
atgggcagggaaaaccagacatggatgagtgagttcattctgctggggctgtccagctgctgggacacccaggtgtccttatttgtccttttcctgatcatgtatctggtgaccgtgctggggaacttcctcatcatcctcctcatcagactggacagtaggctgcacacacccatgtactttttcctcagtgtcttgtcattggtggacatctgttacaccaacagcactgtcccacagatgcttgttcacttcctgtcagcctggaagtccattccattccacagctgtgtgctccagctgtttatctccctggcgatgggcagctcagagttcttcctgctgggagccatggcctatgaccgctacgtggcagtgtgtcatccgttgcactacacagtcatcatgcatggagagctgtgcctgggcttggctgccggctgcttgggggctggtttcattaattcaatgatgcaggcaatcatcatctttcggctacctttgtgccataatgttatcaatcactttgcctgtgagatgttggctgtactgaggctgacctgtgtggacgtctcgttcaacaaggtcatggtggccatctcagggtctctggtgatcatgcttccctgtttcctggtcctgttctcctatgttcgtatagttgctgccattctgcatattcactctgcccaaggacgctgcagagcatttgagacctgtgcttcccacctcactgtggtttccatgtgctttggaacagccatcttcacatacttgcgaccttctgctggctcctcggcagagcaagagaagatggtcgctctgttctatgctgtggtgaccccaatgctaaatcccttaatctacagcttgaggaacaaggaggtaatgagtgccctaaggagactgttgggaaaatgtagtgaaaaaaggtaa

SEQ ID NO: 340 - protein, 311 aa, Canis familiaris
MGRENQTWMSEFILLGLSSCWDTQVSLFVLFLIMYLVTVLGNFLIILLIRLDSRLHTPMYFFLSVLSLVDICYTNSTVPQMLVHFLSAWKSIPFHSCVLQLFISLAMGSSEFFLLGAMAYDRYVAVCHPLHYTVIMHGELCLGLAAGCLGAGFINSMMQAIIIFRLPLCHNVINHFACEMLAVLRLTCVDVSFNKVMVAISGSLVIMLPCFLVLFSYVRIVAAILHIHSAQGRCRAFETCASHLTVVSMCFGTAIFTYLRPSAGSSAEQEKMVALFYAVVTPMLNPLIYSLRNKEVMSALRRLLGKCSEKR

SEQ ID NO: 341 - DNA, 954 bp, Canis familiaris
atgggaacaaataaccagacatggatgagagaatttattctccttggcttgtccagtgactgggacacacaggtctccctctttgtcctgctcttagtcatgtacttggtgacagtgctgggaaacttcctcatcgttcttctcatcagactggacagccgactccacactcccatgtatttctttctcaccaacctctccttcgttgacgtctcttatgccacaagcatcgttcctcagatgttggcacatcttcttgcagcccataaagcaatgccatttgtgagctgtgccgcccagttattcttctccctgggcttgggtgggattgagtttgttctactggcagtgatggcctatgaccgctatgtggctgtgtgtgaccccctgcgatactcggtcatcatgcacggagggctctgtactaggttggccatcacctcctgggtcagtggctctatgaactctctcatccatactgccatcacatttcagctgcccatgtgcacaaacaagtacattgatcacatatcatgtgaaattttggctgtggtcagactggcttgtgtggatacttcctccaacgagattgcaatcacggtttcgagcattgttctgctgatgacacctttctgcctggttctcctgtcctacatccagatcatctccaccatcctaaagatccagtccacagagggaagaaagaaagccttccacacctgtgcctctcacctcacagtggttgtcctgtgctatggtatggcgattttcacttacatccagccccgctccagcccctctgtccttcaggagaagttgatctctctcttctatgctgttttgacacccatgctgaaccccatgatttatagtgtaaggaataaggaggtgaagggagcctggcagaaactattagggcagttatctggaataacgtcaaaactggcaacttga

SEQ ID NO: 342 - protein, 317 aa, Canis familiaris
MGTNNQTWMREFILLGLSSDWDTQVSLFVLLLVMYLVTVLGNFLIVLLIRLDSRLHTPMYFFLTNLSFVDVSYATSIVPQMLAHLLAAHKAMPFVSCAAQLFFSLGLGGIEFVLLAVMAYDRYVAVCDPLRYSVIMHGGLCTRLAITSWVSGSMNSLIHTAITFQLPMCTNKYIDHISCEILAVVRLACVDTSSNEIAITVSSIVLLMTPFCLVLLSYIQIISTILKIQSTEGRKKAFHTCASHLTVVVLCYGMAIFTYIQPRSSPSVLQEKLISLFYAVLTPMLNPMIYSVRNKEVKGAWQKLLGQLSGITSKLAT

SEQ ID NO: 343 - DNA, 954 bp, Canis familiaris
atgggaacaggtaaccagacttgggtgagagagtttgttctccttggcctgtccagtgactgggacacagaggtgtccctctttgtcctgttcttgatcacatacatggtgacagtgctgggaaacttcctcatcattcttctcatcagactggacagccgactccacactcccatgtatttctttctcaccaacctctccctcgttgacgtctcttatgccacaagcatcattcctcagatgttggcacatcttcttgcagcccataaagcaatcccatttgtgagctgtgccgcccagttattcttctccttgggcttgggtgggattgagtttgttctactggcagtgatggcctatgaccgctatgtggccgtgtgtgaccccctgcgatactcggtcatcatgcacggagggctctgtactaggttggccatcacctcctgggtcagtggctctatgaactctctcatgcagactgtcatcacatttcagctgcccatgtgcacaaacaagtacattgatcacatatcctgcgaacttctagctgtggtcagactggcttgtgtggatacttcctccaacgagattgcaatcatggtttctagcattgttctgctgatgacacctttctgcctggttctcctgtcctacatccagattatctccaccatcctaaagatccagtccacagagggaagaaagaaagccttccacacctgtgcctctcacctcacagtggttgtcctgtgctatggtatggcgattttcacttacatccagccccgctccagcccctctgtccttcaggagaagttgatctctctcttctattctgttttgacaccaatgctgaaccccatgatttatagtgtaaggaataaggaggtgaagggagcctggcagaaactattagggcaattaactggaataacttcaaaactagcaacttga

SEQ ID NO: 344 - protein, 317 aa, Canis familiaris
MGTGNQTWVREFVLLGLSSDWDTEVSLFVLFLITYMVTVLGNFLIILLIRLDSRLHTPMYFFLTNLSLVDVSYATSIIPQMLAHLLAAHKAIPFVSCAAQLFFSLGLGGIEFVLLAVMAYDRYVAVCDPLRYSVIMHGGLCTRLAITSWVSGSMNSLMQTVITFQLPMCTNKYIDHISCELLAVVRLACVDTSSNEIAIMVSSIVLLMTPFCLVLLSYIQIISTILKIQSTEGRKKAFHTCASHLTVVVLCYGMAIFTYIQPRSSPSVLQEKLISLFYSVLTPMLNPMIYSVRNKEVKGAWQKLLGQLTGITSKLAT

SEQ ID NO: 345 - DNA, 954 bp, Canis familiaris
atggacacagaaaaccagacttgggtgagagagtttattctccttggcttgtccagtgactgggacacacaggtctccctctttgtcctcttcttgatcatgtacatggtgacagtgctgggaaacttcctcatcattcttctcatcagactggacagccgactccacactcccatgtatttctttctcaccaacctctccttcgttgacgtctcttatgccacaagcattgttcctcagatgttggcacatcttcttgcagcccataaagcaatcccatttgtgagctgtgccgcccagttattcttctccctgggcttgggtgggattgagtttgttctactggcagtgatggcctatgaccgctatgtggccgtgtgtgaccccctgcgatactcggtcatcatgcacggagggctctgtactaggttggccatcacctcctgggtcagtggctctatgaactctctcatgcagactgtcatcacatttcagctgcccatgtgcacaaataagtacattgatcacatatcatgtgaaatcctagctgtaatcaggctggcctgtgtagacatctcctccaacgagattgcaatcatggtttctagcattgttctgctgatgacacctttcttcctggttctcctgtcctacatccagatcatctccaccatcctaaagatccagtccacagagggaagaaagaaagccttccacacctgtgcctctcacctcacagtggttgtcctgtgctatggcatgaccatcttcacttacatccagccccgctccagcccctctgtccttcaggagaagttgatttctctcttctatgccattttgatgcctgtgctgaaccccatgatttatagtgtaaggaataaggaggtgaagggagcctggcagaaactattagggcaattatctggaataacgtcaaaactggcaacttga

SEQ ID NO: 346 - protein, 317 aa, Canis familiaris
MDTENQTWVREFILLGLSSDWDTQVSLFVLFLIMYMVTVLGNFLIILLIRLDSRLHTPMYFFLTNLSFVDVSYATSIVPQMLAHLLAAHKAIPFVSCAAQLFFSLGLGGIEFVLLAVMAYDRYVAVCDPLRYSVIMHGGLCTRLAITSWVSGSMNSLMQTVITFQLPMCTNKYIDHISCEILAVIRLACVDISSNEIAIMVSSIVLLMTPFFLVLLSYIQIISTILKIQSTEGRKKAFHTCASHLTVVVLCYGMTIFTYIQPRSSPSVLQEKLISLFYAILMPVLNPMIYSVRNKEVKGAWQKLLGQLSGITSKLAT

SEQ ID NO: 347 - DNA, 468 bp, Canis familiaris
ctcagcatgtccagtgacacaggggtctccctctttgttctcgtcttgattacatacatggtaacaatgctgggaaaattcctcatcactcttctcatcagactggacagctgactccacactcccatgtatttctttcctgccaatatctttgtcattgatgtctcttatgccacaagcatcattcctcagatgctggtgaatcttcttgcagcccataaagcaatctcatttgtgagctgtgccgctcagttatttttctccctgggtttgggtgggtttgaggttctagtggcagtgatggcctataacaggtctgtggctatatgtgaaccactgcaatactcagtcatcatgcatggaagtctctgtattagattggccattatatcctgggtcaatgtctccttgagcatgttcatgcaagagctcaaaaataaaataattatgtgcaatcctaaccatgta

SEQ ID NO: 348 - protein, 114 aa, Canis familiaris
MYFFPANIFVIDVSYATSIIPQMLVNLLAAHKAISFVSCAAQLFFSLGLGGFEVLVAVMAYNRSVAICEPLQYSVIMHGSLCIRLAIISWVNVSLSMFMQELKNKIIMCNPNHV

SEQ ID NO: 349 - DNA, 954 bp, Canis familiaris
atggaaatagataaccagacatgggcgagagagtttattctccttggcctgtccagtgactgggacacagaggtgtccctctttgtactgttcttgatcacatacatggtgacagtgctgggaaacttcctcatcattcttctcatcagactggacagccgactccacactcccatgtatttctttctcaccaacctctccctcgttgacgtctcttatgccacaagcatcgttcctcagatgttggcacatcttcttgcagcccataaagcaatcccgtttgtgaaatgtgccgcccagttattcttctccctgggcttgggtgggattgagtttgttctactggcagtgatggcctatgaccgctatgtggctgtgtgtgaccccctgcgatactcggtcatcatgcacggagggctctgtactaggttggccatcacctcctgggtcagtggctctatgaactctctcatgcagactgccatcacatttcagctgcccatgtgcacaaacaagtacattgatcacatatcctgcgaactcctagctgtggtcagactggcttgtgtggatacttcctccaacgagattgcaatcatggtttctagcattgttctgctgatgacacctttctgcctggttctcctgtcctacatccagatcatctccaccatcctaaagatccagtccacagagggaagaaagaaagccttccacacctgtgcctctcacctcacagtggttgtcctgtgctatggcatgaccatcttcacttacatccagccccattctggcccctctgtccttcaggagaagttaatctctctcttctatgccattttaatgcccatgctgaaccctatgatttatagtctaaggaataaggaggtgaagggagcctggcagaaactattagggcagttatctgggttaatatcaaaactggcaacttga

SEQ ID NO: 350 - protein, 317 aa, Canis familiaris
MEIDNQTWAREFILLGLSSDWDTEVSLFVLFLITYMVTVLGNFLIILLIRLDSRLHTPMYFFLTNLSLVDVSYATSIVPQMLAHLLAAHKAIPFVKCAAQLFFSLGLGGIEFVLLAVMAYDRYVAVCDPLRYSVIMHGGLCTRLAITSWVSGSMNSLMQTAITFQLPMCTNKYIDHISCELLAVVRLACVDTSSNEIAIMVSSIVLLMTPFCLVLLSYIQIISTILKIQSTEGRKKAFHTCASHLTVVVLCYGMTIFTYIQPHSGPSVLQEKLISLFYAILMPMLNPMIYSLRNKEVKGAWQKLLGQLSGLISKLAT

SEQ ID NO: 351 - DNA, 942 bp, Canis familiaris
atggagaaaaatcaaacaatggttacagaattcatcctattgggattttgtcttggtccaagaattcagatggttctctttgggctcttcaccctgttctacgccttcaccctgctggggaatgggctcatcctggggctcatctcactggaccccagactgcacacccccatgtacttcttcctctcccacctggccatcgtcgacatagcctatgcctgcaacacggtgccccagatgctggtgaacctcctgaggccagacaagcccatctcctttgctggctgcctgacgcagacctttctctttttgacttttgctctgatagaatgtcttctcctggtggtgatgtcctatgaccggtatgtggccatttgccaccccctccgctattctgtgatcatgaactggagagtctgtatcaccctgatggtggcttcctgggcatgtggctccctgctggccctggtccatgtgagcctcatcctgaggctgcccttctgtgggcctcatgaaatcaaccacttcttctgtgaaatcctgtctatcctcaagctggcctgtgctgacacccggcttaaccaagtggtcatctttgttgcctgcatgtttatcttagtggtgcccctctgcttggtgctggtgtcctactcacgcatcctgttggccatcctgaggatccagtctggggagggccgcagaaaggccttctctacctgttcctcccacctctgtgtggtggggctcttctttggcagtgccattgtcatgtacatggcccccaaatcccaccaccctgaagagcagcagaagatccttttcttgttttacagccttttcaaccctatgctgaacccactgatctacagcctaagaaatacagaagtcaagagtgccctgagaagagcaatgtgcaagaaaagtcattcccaattggagtga

SEQ ID NO: 352 - protein, 313 aa, Canis familiaris
MEKNQTMVTEFILLGFCLGPRIQMVLFGLFTLFYAFTLLGNGLILGLISLDPRLHTPMYFFLSHLAIVDIAYACNTVPQMLVNLLRPDKPISFAGCLTQTFLFLTFALIECLLLVVMSYDRYVAICHPLRYSVIMNWRVCITLMVASWACGSLLALVHVSLILRLPFCGPHEINHFFCEILSILKLACADTRLNQVVIFVACMFILVVPLCLVLVSYSRILLAILRIQSGEGRRKAFSTCSSHLCVVGLFFGSAIVMYMAPKSHHPEEQQKILFLFYSLFNPMLNPLIYSLRNTEVKSALRRAMCKKSHSQLE

SEQ ID NO: 353 - DNA, 966 bp, Canis familiaris
atggacggtcccggcaacgccagcgtgccccgaggctttctccttcagggcttctctgagttcccacacctgaggcccgtgctcttcttgctgctgctggccgtgcacctggccaccgtgggcgggaacctgctcatcctggtggccgtggcctcggtgcccagccggccgcccatgctgctcttcctgtgccagctgtcagccatcgagctctgttacacgctggtggtggtgccccgctccctggccgacctggccgcgccggggccccccgggggcagccccatctccttcctgggctgcgcgctgcagatgcagatgttcgtggcactgggtggggccgagtgcttcctgctggccaccatggcctacgaccgctacgtggccgtctgccacccgctgcgctacgcggcggtggtcaccccggggctgtgcgcgcggctggccctggcctgctgcctcgggggcctggcggtgtccgtggggctggcgggggccgtcttccacctgcccttctgcggctcccgcctgctggtgcacttcttctgcgacatcacggcgctgctggagctggcctgcacgcggagctacgcggacgagctgcccctgctgggcgcctgcctgctgctgctgctgctgccctcgctgctcatcctggcctcctacggggccatcgccgccgccctgcaccgcctgcgctgcccccgcggccggcgcaaggccgcctccacctgcgcctcgcacctggccgtcacctgcctgcactacggctgcgccaccttcatgtacgcgcgccccaaggccagctactccccgcggcgggaccgcacgctggcgctggtctacaccaacgtcaccccgctgctgtacccgctcatctacagcctgcgcaatcgcgaggtcaccgcggccatccgcagggtgctggggcgggggcggcaggcgcaaggtctgcgtgagccctga

SEQ ID NO: 354 - protein, 321 aa, Canis familiaris
MDGPGNASVPRGFLLQGFSEFPHLRPVLFLLLLAVHLATVGGNLLILVAVASVPSRPPMLLFLCQLSAIELCYTLVVVPRSLADLAAPGPPGGSPISFLGCALQMQMFVALGGAECFLLATMAYDRYVAVCHPLRYAAVVTPGLCARLALACCLGGLAVSVGLAGAVFHLPFCGSRLLVHFFCDITALLELACTRSYADELPLLGACLLLLLLPSLLILASYGAIAAALHRLRCPRGRRKAASTCASHLAVTCLHYGCATFMYARPKASYSPRRDRTLALVYTNVTPLLYPLIYSLRNREVTAAIRRVLGRGRQAQGLREP

SEQ ID NO: 355 - DNA, 942 bp, Canis familiaris
atgaggagggacaacctgacctgggagagtgaatttgtcctcttggggctctccagcgacaggcagacccaggttggattctttgtcctatttggggccgcctacctgctgactctgctgggcaacgggctcatcatcctcctgatcggactggatgcacgactgcacctgcccatgtacttcttcctctgcaacctctcggtggtggacatttgctacacctctagcggggtcccccagatgctggtgcacttcctcctggagaagaagaccatctccttcatccgatgtggggcccagctcttcttctcactggccctagggggtaccgaattcctgctgctggccgctatggcctacgaccgctacgtggctgtctgtgaccccctgcgctatgtagcagtgatgagcccaaggtgctgtgttgggctggccgctgtctcttggctcataggcctggtgaactctgtggtggagacggtggtcaccatgcgcctgcccacctgtgggcaccacgtgctgaaccacgtggcctgtgagactctggcattggtccgcctggcctgcgtggacatcaccctcaaccaggtgttcatcgtggcctccagtgtggtggtgctgctgctgccctgctgcctggtctcactgtcctatgcctacattgtggctgccattctgcggatccactccaccgggggacgtcgcaaagccttcgggacctgtgcgtcccacctcacagtggtctccatgtcttacgggatggccctggttacctacatgcagccccactccacggcctctgcccagcaggacaaggtggtggtgctcttttatgccgtggtgacccccatgctgaatccactcatctacagtctgcgcaaccaggagatgaaggctgctctgagtcgagttctgatgaggagttctgaatcaaaactttag

SEQ ID NO: 356 - protein, 313 aa, Canis familiaris
MRRDNLTWESEFVLLGLSSDRQTQVGFFVLFGAAYLLTLLGNGLIILLIGLDARLHLPMYFFLCNLSVVDICYTSSGVPQMLVHFLLEKKTISFIRCGAQLFFSLALGGTEFLLLAAMAYDRYVAVCDPLRYVAVMSPRCCVGLAAVSWLIGLVNSVVETVVTMRLPTCGHHVLNHVACETLALVRLACVDITLNQVFIVASSVVVLLLPCCLVSLSYAYIVAAILRIHSTGGRRKAFGTCASHLTVVSMSYGMALVTYMQPHSTASAQQDKVVVLFYAVVTPMLNPLIYSLRNQEMKAALSRVLMRSSESKL

SEQ ID NO: 357 - DNA, 429 bp, Canis familiaris
ggggctctccatgacaggcaggcccaggctggattctttgtcctatttggagccgcctacctgctgatcctgctgggcaacgggctcatcatcctcctgaccggactggatgcacgactgcacctgcccatgtactttttcctctgcaacctcttggtgttggatgtctgatacacttctgttcctcagatgctggcacactttctcctggagaagaagaccatcttcttcatctgatgtgggatccagctcttcttctcactggccctgagggataccaagatcctgctactggctcctatggcctgtgactgctacatgactgcctgtgaccccctgcattatgtgacagcagtctcttggcttataagcctagtgaattttgtggtgtagacactggtcatcatgcacctgcccacctgtgggcac

SEQ ID NO: 358 - protein, 56 aa, Canis familiaris
GALHDRQAQAGFFVLFGAAYLLILLGNGLIILLTGLDARLHLPMYFFLCNLLVLDV

SEQ ID NO: 359 - DNA, 948 bp, Canis familiaris
atgagtaacttcagtatcgtcagggaatttgtgctgctgggattttcacatctccatgagttccagatcctcctctttgcattcatcctattgatatatgtgctgactgtgctggggaacctggccattatcaccctcacatgccttgacacccgcctccactcacccatgtacttcttcctctgcaacttctccctcatggagatgctggtcacctccactgtggttcctaggatgctggcagacctactatctactcataagaccatttccctggccaagtgcctgacccagtctttcttttacttctctttgggttccaccaacttcttgattctcacagtcatggcctttgatcgctacgtggctatctgccgccctctgcactacccaaccatcatgaatggtccagtgtgtgtgaagctggtggcagtctgctgggtggttggctttgtctccatcatctcccccaccctgcagaaaacacaactctggttctgcggccctaatatcatcgaccattacttttgtgactctgccccacttctcaagctttcctgctctgatacccaccacattgagcgcatggatttcttcttatcttttctctttgtgctggccaccatgatgctgatcatagtgtcctatttcctcattgtggctgcagtgctgcgaattccctccttctctgggcgccagaaggccttctccacctgtgcctcccacctcactgtggtggttctgggctatggcagcaccatcttcatctatgtgaggccaggcaagggccactccacacacctcaacaaggtggtagctctgatgactgcagtggtgacccctttcctcaatcccttcatcttcaccttccggaatgagaagttcaaggaggtcattgaagatatgaccaaaagactccgcttcagagatgcagcagctcacagatga

SEQ ID NO: 360 - protein, 315 aa, Canis familiaris
MSNFSIVREFVLLGFSHLHEFQILLFAFILLIYVLTVLGNLAIITLTCLDTRLHSPMYFFLCNFSLMEMLVTSTVVPRMLADLLSTHKTISLAKCLTQSFFYFSLGSTNFLILTVMAFDRYVAICRPLHYPTIMNGPVCVKLVAVCWVVGFVSIISPTLQKTQLWFCGPNIIDHYFCDSAPLLKLSCSDTHHIERMDFFLSFLFVLATMMLIIVSYFLIVAAVLRIPSFSGRQKAFSTCASHLTVVVLGYGSTIFIYVRPGKGHSTHLNKVVALMTAVVTPFLNPFIFTFRNEKFKEVIEDMTKRLRFRDAAAHR

SEQ ID NO: 361 - DNA, 966 bp, Canis familiaris
atgcagggacccagctcctggatcatggcaaatctgagccacccttctgaatttgtcctcttgggcttctcctcttttggcaagcttcaggttctgctgtatggacccttactcatgctttatcttcttgccttcgtgggaaacacagtcatcatagtcatggtcatagcaaacacccacctacatacgcccatgtacttctttctgggtaacttttcactgctggagatcttggtaaccatgacagcagtgcctaagatgctctcagacctgctgacttcccacaaagtcatttccttcaatggctgcatggtccagttctacttctacttttccctgggttccacctccttcctcatcctgtcagacatggcccttgaccgctttatggccatctgccacccactgcgctatggcactttgatgagctgggctgtgtgtgtccggctggcaggagttgcctgggcagctcctttcctggccatggtgcccactgtcctctcccgggcttatctcaattattgccataacaacatcattaaccacttcttctgtgacaatgcacctctgctacagctgtcctgctcagacaccaggctgctggaattctgggactttgtgatggccttggcctttgtcctcagttccttcctagtgaccctcatctcctatggctatattgtgaccactgtgctgaggatcccatctgctagtggccgccataaggctttctctacatgtgggtcacatctcacccttgtcttcattggctacagcagcaccatcttcctttatgtcaggcttggcaaaacacattctgtggaagtcaacaagaccgtagccttggtgacatcggtcctcactccctttctcaatccctttatccttaccttccgcaatgagacagtcaaggcagtgctacaggggcagatgcagaggcttaaaggcctccacaagggactatga

SEQ ID NO: 362 - protein, 321 aa, Canis familiaris
MQGPSSWIMANLSHPSEFVLLGFSSFGKLQVLLYGPLLMLYLLAFVGNTVIIVMVIANTHLHTPMYFFLGNFSLLEILVTMTAVPKMLSDLLTSHKVISFNGCMVQFYFYFSLGSTSFLILSDMALDRFMAICHPLRYGTLMSWAVCVRLAGVAWAAPFLAMVPTVLSRAYLNYCHNNIINHFFCDNAPLLQLSCSDTRLLEFWDFVMALAFVLSSFLVTLISYGYIVTTVLRIPSASGRHKAFSTCGSHLTLVFIGYSSTIFLYVRLGKTHSVEVNKTVALVTSVLTPFLNPFILTFRNETVKAVLQGQMQRLKGLHKGL

SEQ ID NO: 363 - DNA, 942 bp, Canis familiaris
atgaacaacttgtctagtgccactgagttctaccttctaggcttccccgggtcccaagaactacaccacattctttttgctatattctttttctcctactcagtgacattagtgggaaacacagtcatcattgtgattgtgtgtgttgataaacgtctgcagtcccccatgtatttcttccttggtcacctctctgcttcggagatcttaattacaactattatcgttcctatgatgctttgggggttgctactccctgggatgcagacgatatctttggctgcatgtgccacccagctcttcctgtaccttgctgtggcgactacagagtttgcattactgggagcgatggctgtggaccgttacgtggctgtctgtaaccctttgaggtacaatgtcattatgaacagccgcacctgcatctgggtggtcattgtgtcctggacatttgggtttctttctgaaatatggcctgtctatgccacatttcagtttaccttctgcaagtccaatctgttagaccattttttctgtgaccgagggcaactgttcaaactatcctgtgatgacacccttttcacagagtttgttcttttcttaatggctattgtcattatcattggttctctggccccaacagttatctcctacacctacatcatctgcaccatcctcaggatgcccacagcctcaggccagaggaaagccttctctacatgtgcttctcatttcactgttgttgttattatgtatggcagctgcttgtttatccatgtgaaacctaagctaacgcaggcagcggagtataataaaatagtttccctgttgatttctgtgttaacccctttcctgaatcctttcatcttcaccctcaggaacgacaaagtcaaagaggccctttgggatcttatgaaatgctgtaatcaactcttcaaaggttga

SEQ ID NO: 364 - protein, 313 aa, Canis familiaris
MNNLSSATEFYLLGFPGSQELHHILFAIFFFSYSVTLVGNTVIIVIVCVDKRLQSPMYFFLGHLSASEILITTIIVPMMLWGLLLPGMQTISLAACATQLFLYLAVATTEFALLGAMAVDRYVAVCNPLRYNVIMNSRTCIWVVIVSWTFGFLSEIWPVYATFQFTFCKSNLLDHFFCDRGQLFKLSCDDTLFTEFVLFLMAIVIIIGSLAPTVISYTYIICTILRMPTASGQRKAFSTCASHFTVVVIMYGSCLFIHVKPKLTQAAEYNKIVSLLISVLTPFLNPFIFTLRNDKVKEALWDLMKCCNQLFKG

SEQ ID NO: 365 - DNA, 933 bp, Canis familiaris
atgggagacaatatgacatatatcacagagttcaccctactgggatttcctcttggcccaaggattcagatggttctctttgggctcttcaccctgttctatgccttcaccctgctggggaatgggctcatcctggggctcatctcactggaccccagactgcacacccccatgtacttcttcctctcccacctggccatcgtcgacatagcctatgcctgcaacacggtgccccagatgctggtgaacctcctgaggccagacaagcccatctcctttgctggctgcctgacgcagacctttctctttctgacctttgctgtcacagaatgtcttctcctggtggtgatgtcctatgaccggtatgtggccatttgccaccccctccgctattctgtgatcatgagctggagagtctgcatcaccctggtgctgacttcttggaccattggagtccttctgtctttggttcatctcatgttacttctccccttacccttctgtagattccagaaaatcaatcactttttctgtgaaatcatggctgttctcaaacttgtctgtgcagatacccacatcaatgagattatggtattggctggagcaatttctgtgctagtgggacccttctcctcaattgtaatctcctatatgtgcattttctgtgccatccttagaatccagtctggagaaggtcaaagaaaagccttctccacctgctcatctcatctctgtgtggttggactcttttacggcacagccatcataatgtatgttgggcccagatatgggaaccccaaggagcagaagaaatacctgctcctgtttcacagccttttcaaccccatgctcaacccccttatctatagtcttaggaacttagaagtgaaaaatgccttgaagagagtgctgggaatacagagagctttatga

SEQ ID NO: 366 - protein, 310 aa, Canis familiaris
MGDNMTYITEFTLLGFPLGPRIQMVLFGLFTLFYAFTLLGNGLILGLISLDPRLHTPMYFFLSHLAIVDIAYACNTVPQMLVNLLRPDKPISFAGCLTQTFLFLTFAVTECLLLVVMSYDRYVAICHPLRYSVIMSWRVCITLVLTSWTIGVLLSLVHLMLLLPLPFCRFQKINHFFCEIMAVLKLVCADTHINEIMVLAGAISVLVGPFSSIVISYMCIFCAILRIQSGEGQRKAFSTCSSHLCVVGLFYGTAIIMYVGPRYGNPKEQKKYLLLFHSLFNPMLNPLIYSLRNLEVKNALKRVLGIQRAL

SEQ ID NO: 367 - DNA, 834 bp, Canis familiaris
ttcctcttctggatcttctccctcttttatgtcttcagtctgctggggaatggcatgatctttggactcctctgtctagattctagactgcacacccctatgtactttttttttttcctttcacacctgtccatcattgacatgtcctatgcttccaacaatgtcccccaagatgctcacaaacttagtgaatcagaagagaaccataccttttgttccatgcataatacatttttgtatttagcttttgctcacaaagagtgcctgatcttggtggtgatgtcctatgataggtttgtagagatctgccacccactctagcacactgtcatcgtaagctggagagtgtgcacagtcttggtcattgcttcctggacacgtggatttattctgtctctggtacatgcaattctccttttaaggctgcctttctgtggacctcggaagtagaccacatcttctgtgaaatcctgtctgttctcaaactggcctgtgctgatacctgaatcaatgaagctatcatctgctgcctgtatatttatcttagttgggcccctttgtttgggtgctagtctcctatactagcatcctctggaccatcctgaaaatccatcaggagaaagctgaagaaaagccttctccacctactcttctcacctctgtgtgattaggcttgtcactgtgatggtggtttatatggttccagactctagtcagagaaaggaacaggagaaaatgctcttcctgtttcatagtctcttcaatccaatgctgaatcccttcatctacagcctcaagaatgttcaggtgaagaatgccttgtatagagcattg

SEQ ID NO: 368 - protein, 106 aa, Canis familiaris
FLFWIFSLFYVFSLLGNGMIFGLLCLDSRLHTPMYFFFFLSHLSIIDMSYASNNVPQDAHKLSESEENHTFCSMHNTFLYLAFAHKECLILVVMSYDRFVEICHPL

SEQ ID NO: 369 - DNA, 933 bp, Canis familiaris
atggagggcaaccaatcatggatcacggaatttatcctagtgggattccagctcagtgaagacattgaagtgctcctcttttgtatcttctccctgttctatatctttaatttgctggcaaatggcatgatcttgggactcatttggctagacctcagactgcactcccccatgtatttcttactttctcatctggctatcattgacatatgctatgcttccagcaatctgcccaatatgctggaaaacctagtgaagcacaagaaaacgatctcctttgtctcatgtactatgcagatagttttgtttgtgacttttgctggtgcagagtgcctgattttggtagtgatggcctacgaccggtttgtggcgatctgccatcctctccagtacaccgtcatcatgaactggagagtgtgcgtggtcctggtcattgctacctgggcatgtgggttttccttggccctagtgcatctaattctcttcctaaagttgacattctgtgggccccaggaagtgaaccacttcttctgtgaaatcctctctgtcctcaaagtggcctgtggtgacacttggatcaatgaagccttagtctttgctggtggcatgtttgtcttagttgggcccctttctctgatgttggtctcctatatgcgcatcctctgggccatcctgaagatccaaacaaaggaagggcgcagaaaagccttttccacctgctcctcccacttctgtgtggttggattctactttggcatagccatgatggtttatttggttccagacaatagccaacgtgaggagcagcagaaaatccttaccctgttttacaccctcttcaacccattgctgaaccctctcatttacagtctgagaaatgctcagatgaaggctgccttcaacaaagcattgcaaaaaaagaggacaatataa

SEQ ID NO: 370 - protein, 310 aa, Canis familiaris
MEGNQSWITEFILVGFQLSEDIEVLLFCIFSLFYIFNLLANGMILGLIWLDLRLHSPMYFLLSHLAIIDICYASSNLPNMLENLVKHKKTISFVSCTMQIVLFVTFAGAECLILVVMAYDRFVAICHPLQYTVIMNWRVCVVLVIATWACGFSLALVHLILFLKLTFCGPQEVNHFFCEILSVLKVACGDTWINEALVFAGGMFVLVGPLSLMLVSYMRILWAILKIQTKEGRRKAFSTCSSHFCVVGFYFGIAMMVYLVPDNSQREEQQKILTLFYTLFNPLLNPLIYSLRNAQMKAAFNKALQKKRTI

SEQ ID NO: 371 - DNA, 930 bp, Canis familiaris
atgggaagcaaccagtcatgggtcacagaatttgtcttggtggggttccagctcagtgcagagatggaagtgctcctcttctggatcttttccctcttgtatatcttcagtctgctggcaaatggcgtgatcttgggactcatccatctggacctgagactgcacacccccatgtacttcttcctctcacacctggctgtcatcgacatgtcctatgcctccaacaatgtccccaagatgttggtaaacttagtgaatcagaagagaaccatctcttttgttccctgcgtaatgcagacatttctgtacctgggttttgctgctacagagtgcctggttttggtggtgatgtcctatgacaggtacgtggccatctgccaccccctccagtacactgtcatcatgagctggagactgtgcacggttctggctgtcacttcctggtcatgtggattttttctgtctctggtacatgcaattctccttctacggttgcccttctgtggacccaggaaagtaaaccaccttttctgtgaaatcctatctgtcctcaagctggcctgtgctgacactaggctcaaccaaatggtcatctttgctgcctgtatgtttgtcttagttgtgcctctctgcttaatgctagtttcctacatgtgcatcctctgggccatcctaaagatccagtcaaagcagggccgcagaaaggccttctccacctgctcttcccacctctgtgtggttggactcttctttggcatagccatgttggtttatatggtccccgactccaatcaacgagaagagctagagaaaatactgtccctatttcacagtctctttaacccaatgctgaaccctctcatctacagcttgaggaatgctcagatgaaggcttctttgtatagagtactgcagaaaaaaaccatgtga

SEQ ID NO: 372 - protein, 309 aa, Canis familiaris
MGSNQSWVTEFVLVGFQLSAEMEVLLFWIFSLLYIFSLLANGVILGLIHLDLRLHTPMYFFLSHLAVIDMSYASNNVPKMLVNLVNQKRTISFVPCVMQTFLYLGFAATECLVLVVMSYDRYVAICHPLQYTVIMSWRLCTVLAVTSWSCGFFLSLVHAILLLRLPFCGPRKVNHLFCEILSVLKLACADTRLNQMVIFAACMFVLVVPLCLMLVSYMCILWAILKIQSKQGRRKAFSTCSSHLCVVGLFFGIAMLVYMVPDSNQREELEKILSLFHSLFNPMLNPLIYSLRNAQMKASLYRVLQKKTM

SEQ ID NO: 373 - DNA, 933 bp, Canis familiaris
atgggaagcaaccagtcatgggtcacagaatttgtcttggtggggttccagctcagtgcagagatggaagtgctcctcttctggatcttctccctcttgtatatcttcagtctgctggcaaatggcgtgatcttgggactcatccgtctggacctgagactgcacacccccatgtacttcttcctctcacacctggctgtcatcgacatgtcctatgcctccaacaatgtccccaagatgttggtaaacttagtgaatcagaagagaaccatctcttttgttccctgcgtaatgcagacatttctgtacctgggttttgctgctacagagtgcctggttttggtggtgatgtcctatgacaggtacgtggccatctgccaccccctccagtacactgtcatcatgagctggagactgtgcatggtcctggctgtcacttcttgggtgtttagcttcctcttggccctcgtccatttaattctcatcctgaggctgcccttctgtgggcctcatgaaatcaaccacttcttctgtgaaatcttatctgtcctcaagctggcctgtgctgacactaggctcaaccaagtggtcatctttgggacctgtgtgtttatcttagtggggcctctctgcttggtgctggtgtcctactcatgcatcctgtttgccatcctgaggatccagtctggggaaggccgcagaaaggccttctccacctgttcctcccacctctgcgtggtggggctctactttggcagcgccattgtcatgtacatggcccccaaatccaaccacccagaggagaagcagaagatcctttccctgttttatagccttttcaaccctatgctgaacccactgatctacagtctgaggaacacagaggtgaagggtgccctgaggagagccttatacaggcataggcatatatga

SEQ ID NO: 374 - protein, 310 aa, Canis familiaris
MGSNQSWVTEFVLVGFQLSAEMEVLLFWIFSLLYIFSLLANGVILGLIRLDLRLHTPMYFFLSHLAVIDMSYASNNVPKMLVNLVNQKRTISFVPCVMQTFLYLGFAATECLVLVVMSYDRYVAICHPLQYTVIMSWRLCMVLAVTSWVFSFLLALVHLILILRLPFCGPHEINHFFCEILSVLKLACADTRLNQVVIFGTCVFILVGPLCLVLVSYSCILFAILRIQSGEGRRKAFSTCSSHLCVVGLYFGSAIVMYMAPKSNHPEEKQKILSLFYSLFNPMLNPLIYSLRNTEVKGALRRALYRHRHI

SEQ ID NO: 375 - DNA, 933 bp, Canis familiaris
atgggaggcaaccagacatggatcacagaagtcatcctgctgggattccaggtcgatccagcactggagctccttctctttggacttttctgtcttttctataccctcacccttctgggaaatggagtcatcttagggcttatctgcttagacgctagactgcacagccccatgtacttcttcctcactcacctggcaattgttgacatgtcctacgcctccaataatgtccccaagatgctggcaaatcttgtgaatctgaaaagaaccatatcctttgttccttgcatcatgcagacttttctgtatctggcttttgctcacatagagtgcctgattttggttgtgatgtcctatgacaggtttgtggcaatctgccatcctctacattacacagtcatcatgaactggagaatgtgcacagtcttagccagcacttcttgggtttttagcttcctcttggctctcgtccatttaattctcatcttgaggctgcccttctgtgggcctcatgaaatcaaccacttcttctgtgaaatcctgtctgtcctcaagctggcctgtgctgacactaggctcaaccaagtggtcatctttgctgcctgtgtgtttatcttagtgggacctctctgcttggtgctggtgtcctactcatgcatcctgtttgccatcctgagaatccagtctggggaaggccgcagaaaggccttctccacctgttcctcccacctctgcgtggtggggctcttctttggcagcgccattgtcatgtacatggcccccaaatccaaccaccctgaggagcagcagaagatcctttctctgttttatagccttttcaaccctatgctgaacccactgatctacagtctgaggaacacagaggtgaagggtgccctgaggagagtcttatacaggcagaggcatatatga

SEQ ID NO: 376 - protein, 310 aa, Canis familiaris
MGGNQTWITEVILLGFQVDPALELLLFGLFCLFYTLTLLGNGVILGLICLDARLHSPMYFFLTHLAIVDMSYASNNVPKMLANLVNLKRTISFVPCIMQTFLYLAFAHIECLILVVMSYDRFVAICHPLHYTVIMNWRMCTVLASTSWVFSFLLALVHLILILRLPFCGPHEINHFFCEILSVLKLACADTRLNQVVIFAACVFILVGPLCLVLVSYSCILFAILRIQSGEGRRKAFSTCSSHLCVVGLFFGSAIVMYMAPKSNHPEEQQKILSLFYSLFNPMLNPLIYSLRNTEVKGALRRVLYRQRHI

SEQ ID NO: 377 - DNA, 933 bp, Canis familiaris
atgggaagcaatcagacatggatcacagaagtcatcctgctgggattccaggttgatcccaaacttgaaatattcctctttgggttcttcttgctattctatagccttaccttgatggggaacgggctcatcctggggctcatctggctggactccagactgcacacgcccatgtacttcttcctctcaaacctggccattgttgacatgtcctatgcctcaagcattgtccctaagatgctggcaagtcttataatgcagaagaaaaccatctcctttgttccatgcatacttcagacatttttgtatttggcacttgctgtcacagagtgtatgagtttggtggtcatgtcctatgatcggtatgtggccatctgccatcccctacattacactgtcgtcatgagctggagagtgtgcattatcttgtctgccacttgctggatgttcagctttctcttggctctggtccacattactctgattcttaagttgcctttttgtggaccacaaaaaatcaaccactttttctgtcaaatcatgtcggtatttaaattggcctgtgctgacactagactcaaccaaattgttctctttgccggctctgtgtttgttttagtcgcacccctctgcttggtgctggtatcctatattcatatcctgttggccatcttgaggatccagtctggggagggtcgcagaaaggccttctccacctgctcctcccacctctgtgtggtggggctcttctttggcagtgctattgttatgtacctggcccctaaatctagccattctcaagaacaaagaaagattttatcattgttttatagccttttcaatcctatgctaaacccactgatcaacagcctgaggaacactgaggtgaagagtgccctgaggagatttctagggaagaagtcatcagcatga

SEQ ID NO: 378 - protein, 310 aa, Canis familiaris
MGSNQTWITEVILLGFQVDPKLEIFLFGFFLLFYSLTLMGNGLILGLIWLDSRLHTPMYFFLSNLAIVDMSYASSIVPKMLASLIMQKKTISFVPCILQTFLYLALAVTECMSLVVMSYDRYVAICHPLHYTVVMSWRVCIILSATCWMFSFLLALVHITLILKLPFCGPQKINHFFCQIMSVFKLACADTRLNQIVLFAGSVFVLVAPLCLVLVSYIHILLAILRIQSGEGRRKAFSTCSSHLCVVGLFFGSAIVMYLAPKSSHSQEQRKILSLFYSLFNPMLNPLINSLRNTEVKSALRRFLGKKSSA

SEQ ID NO: 379 - DNA, 945 bp, Canis familiaris
atgttggggaatcagtctagtgccactgaattttatctccttggcttccctggctccaaggatctacaccatcttctctttgctaccttcttcttcttctactcagtgacattaatgggaaacatggtcatcatcttgattgtgtgtgctgataaacgtctgcagtcccccatgtatttcttccttagtcacctctctgccttggagatcttggttacatctgttattgtgcctgtgatgctttgggggttgctgctccctgggatgcagacgatatctttggctgcatgtgtcacccagctcttcctgtacctttctctggggaccaccgagtttgcattactgggagcaatggctgtggaccgttacgtggctgtctgtaaccctttgaggtacaatgtcattatgaacagccgcacctgtatctgggtggtcattgtgtcatgggtgtttggtttcctatttcaaatctggccagtgtatgccacatttcagcttacgttctgcaaatccaatgtggtgaacaatttcttctgtgaccgagggcaattgctcaaactatcctgcaacaatactcttttcatagagtttattctattcctaatggctgtctttgttctttttggttctctgatccctacaatcatctcctacacctacatcatctccaccatcctcaagattccctcagcctctgggcgaaggaaagccttttctacgtgtgcgtcccacttcacttgtgttgtgatcggctatggcagttgcttgttcctctatgtgaaacccaagcaaacacaggcggcagattacaatagagtggtttccttgatggtttcagtggttactcctttcctcaaccctttcatcttcacccttcgaaatgacaaagtcatagaagccctatgggatggaatgaaaagatgctgtcaactattcaataactaa

SEQ ID NO: 380 - protein, 314 aa, Canis familiaris
MLGNQSSATEFYLLGFPGSKDLHHLLFATFFFFYSVTLMGNMVIILIVCADKRLQSPMYFFLSHLSALEILVTSVIVPVMLWGLLLPGMQTISLAACVTQLFLYLSLGTTEFALLGAMAVDRYVAVCNPLRYNVIMNSRTCIWVVIVSWVFGFLFQIWPVYATFQLTFCKSNVVNNFFCDRGQLLKLSCNNTLFIEFILFLMAVFVLFGSLIPTIISYTYIISTILKIPSASGRRKAFSTCASHFTCVVIGYGSCLFLYVKPKQTQAADYNRVVSLMVSVVTPFLNPFIFTLRNDKVIEALWDGMKRCCQLFNN

SEQ ID NO: 381 - DNA, 945 bp, Canis familiaris
atgttgaagaattattctagtgctgttgaattttatctacttggcttccatggctccaaagaacaacacaatattctttttgccactttcttctttctctactcagtgacagtcatgagaaatatgctcatcatcgtgattgtctgtgttgataaacgtctgcagtcccccatgtattttttccttggccacctctctgtcctagagatcctgattacatcagttgccgtccccttgatgctctgggggctgctgcttcctgagatgcaggcaatatctttgccagcctgcagtgcacaattatatttgtacctttctttgggtacatcggagttggtattaattggagcaatggctgtggaccgttacgtggctgtctgtaaccccttgaggtacaacatcgttatgaacagccacacctgcatctgggtggtcattgtgtcatgggtgtttgggttcctatttcaaatttggccagtgtatgccacatttcagcttaccttctgcaaatcaaatgtattagaccattttttatgtgaccgagggcaactgctcaaattatcctgtgatgacagccttttcacagagtttatcctttttttaatggctgtgttcattattgttggttctttgatccctacaatcatctcctacacctacatcatttccaccatcctcaagattccctcagcctctgggcggaggaaagccttttctacgtgtgcgtcccacttcacctttgtcgtgatcgggtatggcacctgcttgttcctctatgtgaaacccaagcaaacacaggcagcagagtataatagggtagcatcactgatggttttagtggtgaccccttttctgaacccatttatcttcactctccgtaatgacaaatttattgaggcctttcgagatgtcatgaaacgctgctatcatctccacaagggttag

SEQ ID NO: 382 - protein, 314 aa, Canis familiaris
MLKNYSSAVEFYLLGFHGSKEQHNILFATFFFLYSVTVMRNMLIIVIVCVDKRLQSPMYFFLGHLSVLEILITSVAVPLMLWGLLLPEMQAISLPACSAQLYLYLSLGTSELVLIGAMAVDRYVAVCNPLRYNIVMNSHTCIWVVIVSWVFGFLFQIWPVYATFQLTFCKSNVLDHFLCDRGQLLKLSCDDSLFTEFILFLMAVFIIVGSLIPTIISYTYIISTILKIPSASGRRKAFSTCASHFTFVVIGYGTCLFLYVKPKQTQAAEYNRVASLMVLVVTPFLNPFIFTLRNDKFIEAFRDVMKRCYHLHKG

SEQ ID NO: 383 - DNA, 723 bp, Canis familiaris
atgttggagaatcgtagtgccactgaattctatctcttaggctttcctggctccccagaattatatcatatcttatttgctaccttcttcctcttccactcagtgacagtcatggggaacatggtcatcattgtgactgtccatgttgataaatgtctgcagtcccccatgtacttcttccttggctaccactctgtcctggagattctatctacttctatccccttgatgctctgagggttgctgcttcctgagattcaggcagtatctttgacagcatgccatgtagttatatttgtacctttctttgggcacatcagaatttatattaatgggatcaatggctgtggaccagtatgtggctatctgtaaccccttgagaaaaaacatcattatgaacagccacacctgcatctgggtggtcactgtgtcatgggtgtttgggttcctatttcaaatctggctactctttgccacatttcagcttaccttctgaaaaaaaaaaagttagaccttttttttttatgtgatcgagggcaactgctcaaattatcctgtgatgacagccttttcacagagtttatccttttttaatgactatattcattatggttggttcttgtacccctacctataattgtctcctatacctacatcatcttcacctcctcaagatcccctcagcctctgggtggaggaaaaccttttctatgtgtgtgtcat

SEQ ID NO: 384 - protein, 78 aa, Canis familiaris
MLENRSATEFYLLGFPGSPELYHILFATFFLFHSVTVMGNMVIIVTVHVDKCLQSPMYFFLGYHSVLEILSTSIPLML

SEQ ID NO: 385 - DNA, 879 bp, Canis familiaris
atgcacctgttcctcttcagcatggttgtggtagtctacacactagcgatggctggcaacactgccatggtcctcttgatctgggctgatgcccggctccacacacccatgtatttcctcctcagccagttgtctttcctggacatcttcttcacctcagtcaccgtccccaagatgatagcaggcttcctctttggctggactagcatctcatttgtgggctgtggggcacaaatgtttttcttcatgttccttggggccgctgaatgcctcctgctggccctcatggcctatgaccgctacgtggccatctgcaaccctctgcgctacccatcactcatgagccaccagacctgtctgctcatggtggctgcctcctggctgggtggatccatcaatgcctccgtccagacagcattgaccctacagttcccctattgtggctcaaggaagattgcacactttttctgtgaggtgccttcgctgctgaggctggcctgtgctgacacagcagcctatgagcaagtgctctttgtgacaggtgttgtggtccttctgctgcccattgccttcatcaccacctcctatgccctcattctggcagcagtgcttgggatgcactccgtggaggggcgtcagaaggccctagccacctgctcctcccacttaacagttgtcaacctcttctatgggcctcttgtgtatacctatatgttacctgcatcttaccactctcctggccaggatgatgtagtgtctatcttttatacagtcctcacacccatgctgaaccctgtcatctacagcctcaggaacaaggaagtgacaggagcaatgaagaaggtcatagggaagtgtagggtgggtaggactgcttaa

SEQ ID NO: 386 - protein, 292 aa, Canis familiaris
MHLFLFSMVVVVYTLAMAGNTAMVLLIWADARLHTPMYFLLSQLSFLDIFFTSVTVPKMIAGFLFGWTSISFVGCGAQMFFFMFLGAAECLLLALMAYDRYVAICNPLRYPSLMSHQTCLLMVAASWLGGSINASVQTALTLQFPYCGSRKIAHFFCEVPSLLRLACADTAAYEQVLFVTGVVVLLLPIAFITTSYALILAAVLGMHSVEGRQKALATCSSHLTVVNLFYGPLVYTYMLPASYHSPGQDDVVSIFYTVLTPMLNPVIYSLRNKEVTGAMKKVIGKCRVGRTA

SEQ ID NO: 387 - DNA, 906 bp, Canis familiaris
atggagcaaggaaatgaatcctccaccacggatttcattctccttagctttttctctgactcccagcatcctagactcctcatctccattgtccgtctgatttttggggtggcagtcacaggaaattccatcctggtcctgctgatctggagtgatgcttgcctccacacccccatgtacttcttgttcagccagctctccctcatggatctaatgttaatttccaccactgtccccaagatggccactaacttcttctctggacatgagtttatctctcatattggctgtggagtccaaatttttctgtacttgatgctaggagtggctgagtgcgttcttctcactctcatggcctttttggccatctgtaaccccctcagatatcccataatcatgactccccgagtctgtatgcaaatggccactggctcatgggctggaggtgtgcttatctccttaatgcacacaatttatgccatgcacttttttacttgctgctccaggaaaactgaccatttcttctgtgagataatggcccttctgaagctctcttgtgaggacacctccatctatgagaaagtggtgttactgtccagcattgctttccttctcatcccttttggactcattctgacatcctacatatacatctaccttactgttctccgcatgaactctcctgagggcaaaaacaaagctctagctacctgttcctcccatctttgtgtggtaagtctctactttggtccagccatgattatctacatgactccaggttcctctctcccctcagagatggatcagcatctctttgtgtttgatgtaatcattattcccatgcttaaccccctcatctacagcctgaggaacaaggaggtgttgggggctctgaggaaggctcta

SEQ ID NO: 388 - protein, 302 aa, Canis familiaris
MEQGNESSTTDFILLSFFSDSQHPRLLISIVRLIFGVAVTGNSILVLLIWSDACLHTPMYFLFSQLSLMDLMLISTTVPKMATNFFSGHEFISHIGCGVQIFLYLMLGVAECVLLTLMAFLAICNPLRYPIIMTPRVCMQMATGSWAGGVLISLMHTIYAMHFFTCCSRKTDHFFCEIMALLKLSCEDTSIYEKVVLLSSIAFLLIPFGLILTSYIYIYLTVLRMNSPEGKNKALATCSSHLCVVSLYFGPAMIIYMTPGSSLPSEMDQHLFVFDVIIIPMLNPLIYSLRNKEVLGALRKAL

SEQ ID NO: 389 - DNA, 462 bp, Canis familiaris
ttgctgctcatagccatggcctttgacagtcatagggccatatgtaagcctctccaccacctgaccatcaaaaggccatgaatgtgcattttgatcttagtggttgcctggaccattggtctcattggctcattggcctccttggcttctgtggtaaacttgcccttctgtagcctttaatgtattgacagctttaactgtgacatactgtggttcatcaaatttgccttcacagagacttacaacgtaagctcattgtcactagttcaatgggttcaattccttggttgctttcttcttgctcatcctctctcaccttcatcctggccactcttcagaaacacccctcaggtggttatccaaagctccttttactctttaaggtcacattattgtgtgattttatttctttgcccactgatttttttctatatgtggccctctccttcaaaacatctggat

SEQ ID NO: 390 - protein, 65 aa, Canis familiaris
  MOD_RES (65)..(65): Any amino acid
MGSIPWLLSSCSSSLTFILATLQKHPSGGYPKLLLLFKVTLLCDFISLPTDFFLYVALSFKTSGX

SEQ ID NO: 391 - DNA, 840 bp, Canis familiaris
gaaatggaaaattgaactgtggtcactgcatttatctttccaggatttcccaaacccccttaattacaaaagctattcttcttggtcttcttgatcatttatctgataactcttctgggaaatgctttcacattaacagagatcagagtcagtcctgtcctccacactctacagtattattagcaatttgagcttcttggacattggctgcttgtctactaccatgctggtaaacttattccagaagaagactatgtcataggagggctgcctttcccagctgttcctatgacctgtgctgaggaaatcttgttggctactatgacttatgaacactatgtagccatttgccactttcttcactgtctgctgctcatgattccaagggtctgtgtgtattggttgactggaacttggctgtatgggctaaagaattctgtgacacattcagtgctagcagtcacattcactttgtgtgagctcaaccagatcagctactttctccatgatttcctactgctcgtggagctctcctgcttacatttctttcaatgaatgtgtgctccatatggcagcacaaccattggcctgaacccttgcctgtttactgcaatgtcttaaatacttatcatccctaccaggcttaggatgtcctcgggacagaaacaatgcctctatgtggacattccactccactatggtggtggtttttttagggacagctgacttcaactatagcaacacagtgtaggctacaacccagaaatggacatccttgtttctgtgattttctgtgttgtgacaccccgcctccttgtggaactccatcatctacagtct

SEQ ID NO: 392 - protein, 62 aa, Canis familiaris
NGKLNCGHCIYLSRISQTPLITKAILLGLLDHLSDNSSGKCFHINRDQSQSCPPHSTVLLAI

SEQ ID NO: 393 - DNA, 900 bp, Canis familiaris
atgacaccatttgaaatgaacaatcaaacagatgccactgaattcatcttcttgggattttccaaccaccccaaactacagggcttgtttttcctggttttcttgatcatttacctgacaacactcctgggaaacatgctcataataacagccactaaaatcagccttgctcttcatactccaatgtattatttcctcagcaacctgagtttcttggacatctgctatacatccaccaccatcccagtcatgctgatgaacttcttccgcaaaaagaaaaccatctcatatgaaggctgcttttctcagacttttttcctcgtgacatgcactggcactggatgtgttttattggttgctatggcttatgaccattatgtagtcatttgccacccccttcaatatccggtcctcatgagtgtgaaggtctgtgttctgtgtgggctggtgaattctgtgatacacaccatgctagcagccacactcactctctgtgggcccaaccaaatcagccactttctctgtgacatcccattgcttctggagctctcttgctcagacacctctctcaatgagtctgtgctccatgtggtcaaggccatcattgacctgagcccctgcctgtttaccggagtgtcctatgtactcatcatctctgccattcttaggattccctctgctcagggcaggaacaaggccttctctacctgtgtatcccaccttactgttgttgtgatcttttatggaacagccaatttcaactatgacagaaccaacatggggtataacctggacattgttatcctggtttttgtacttttctgtgttgtgaccttcatgttgaaccccatcatatacagtctgggaaacaaggaggccaagggtcccctgaggaagcta

SEQ ID NO: 394 - protein, 300 aa, Canis familiaris
MTPFEMNNQTDATEFIFLGFSNHPKLQGLFFLVFLIIYLTTLLGNMLIITATKISLALHTPMYYFLSNLSFLDICYTSTTIPVMLMNFFRKKKTISYEGCFSQTFFLVTCTGTGCVLLVAMAYDHYVVICHPLQYPVLMSVKVCVLCGLVNSVIHTMLAATLTLCGPNQISHFLCDIPLLLELSCSDTSLNESVLHVVKAIIDLSPCLFTGVSYVLIISAILRIPSAQGRNKAFSTCVSHLTVVVIFYGTANFNYDRTNMGYNLDIVILVFVLFCVVTFMLNPIIYSLGNKEAKGPLRKL

SEQ ID NO: 395 - DNA, 960 bp, Canis familiaris
atgacaccatttgaaatgaacaatcaaacagatgtcactgaattcatcttcttggggttttccaaccaccccaaactacagggcttgtttttcctggttttcttgatcatttacctgacaacactcctgggaaacatgctcataataacagccactaaaatcagccttgctcttcatactccaatgtattatttcctcagcaacctgagtttcttggacgtctgctacacatccaccaccatcccagtcatgctggtgaacttcttccacagaaagaaaaccatctcatatgaaggctgcctttcccagattttcttcctcgtgacatgcactggcactgaatgtgtcttattggctgctatggcttatgaccgctatgtagcaatttgccacccccttcaatatccggtcctcatgagtgtgaaggtctgtgtttttttggtgactgggtcctggctatgtgggctggtgaattctgtgatacacacagtgctggcagccacactcactctctgtgggcccaaccaaatcagccactttctctgtgacatcccattgctcctggagctctcttgctcagacacctctctcaatgagtctgtgctccatgtggccagtgccaccattggcctgagcccctgtctgtttactggagtgtcctatatactcataatttctgccattcttaggattccctctgctcagggcaggaacaaggccttctctacctgtgcatcccaccttactgttgttgtgatcttttatggaatggccaatttcaactatgataaacccagagagggttactccttagacatagatattctggtctctgtgctcttctgtgttgtgacccccatgttgaaccccatcatatacagtctgagaaacaaggaggtcaagggtgccctgaggaagttgactggagggtatgtgatccctggcaatattagtgtctag

SEQ ID NO: 396 - protein, 319 aa, Canis familiaris
MTPFEMNNQTDVTEFIFLGFSNHPKLQGLFFLVFLIIYLTTLLGNMLIITATKISLALHTPMYYFLSNLSFLDVCYTSTTIPVMLVNFFHRKKTISYEGCLSQIFFLVTCTGTECVLLAAMAYDRYVAICHPLQYPVLMSVKVCVFLVTGSWLCGLVNSVIHTVLAATLTLCGPNQISHFLCDIPLLLELSCSDTSLNESVLHVASATIGLSPCLFTGVSYILIISAILRIPSAQGRNKAFSTCASHLTVVVIFYGMANFNYDKPREGYSLDIDILVSVLFCVVTPMLNPIIYSLRNKEVKGALRKLTGGYVIPGNISV

SEQ ID NO: 397 - DNA, 240 bp, Canis familiaris
gaaggccacagaaaggccttctccacctggtcctcccacctctgtgtggtggggctcttctttggcagtgccactgtcatgtacatggccccctaatccaaccacccagaggagcagcggaagattctttccctattttatagccttttcaatcctatgctgaacccactgacctacagtctgaggaacacagaggtcaagggtgccctgaggagagccttatacaggcagaggcatata

SEQ ID NO: 398 - protein, 53 aa, Canis familiaris
KATERPSPPGPPTSVWWGSSLAVPLSCTWPPNPTTQRSSGRFFPYFIAFSILC

SEQ ID NO: 399 - DNA, 936 bp, Canis familiaris
atggaaagtgcaaaccattcagtggtgtctgaattcattttgcttggactttacaaatctcagaaccttcagattttgttctttgtaggattctctgtggtctatgccgggattgtgttatgaaacctccttatcttggtcactgtgacctttgactcacaccttcacacaccaatgtactttctgcttatcaatctgtcctgtatagatatgatcctagcttcttttgctacccctaagatgatcatggacttcctccgaaaacagaagaccatctcttggtggggatgttattctcagatgtttttcatgcacctcctaggtggaactgagatgatgttgcttgtagccatggcaatagacaggtatgttgccatatgcaaacccctccattacatgaccataatgagcccacgagtgcttgttgggctgctgttatcttcctatgcagttggctttgtgcactcgtctagtcaaatggctttcatgttgcatttgccattctgtggtcccagtgtggtggacagctttttctgtgaccttccccttgtgatcaaacttgcctgcgaggacacctacctgctacaactgctggttattgctgacagtggcctcctgtctctgatctgcttcctcctcttgcttgtctcctatgtggttatcatatactcagtcaggcaccgtgctgctggtggttcagccaaggccttctccactctgtcagcacacatcacagttatcactctcttctttgccccatgtgtctttatctatgtatggccctttagcagatattctgtagataaaattctttccgtgttttatacaattttcacacctctcttaaatcctattatttatacattaaggaatcaagaagtaaaagcagccataaagaggataagaactcgacatataaattcaaaacacactttg

SEQ ID NO: 400 - protein, 254 aa, Canis familiaris
MYFLLINLSCIDMILASFATPKMIMDFLRKQKTISWWGCYSQMFFMHLLGGTEMMLLVAMAIDRYVAICKPLHYMTIMSPRVLVGLLLSSYAVGFVHSSSQMAFMLHLPFCGPSVVDSFFCDLPLVIKLACEDTYLLQLLVIADSGLLSLICFLLLLVSYVVIIYSVRHRAAGGSAKAFSTLSAHITVITLFFAPCVFIYVWPFSRYSVDKILSVFYTIFTPLLNPIIYTLRNQEVKAAIKRIRTRHINSKHTL

SEQ ID NO: 401 - DNA, 939 bp, Canis familiaris
atggagggtgctaatcaaactgggatggttcgcttccacttccgccccttctccaaactccctgaggtgcagatgttgatttttgtggccttcttgatcatgtacctggtcagcatcagcggcaatgtctccatttctctcatcatctggctcaaccgttctctgcacacccccatgtacttcttcctggccaacttggcagctctggagatctgctactcttccaccatcgcccctctgaccctggccagcgtcctgtccacagagagagccctcatctccctgcctggctgtggtacccagatgttcttcttcatcttcctgggcagtgctgactgtattctactagctgtcatggcctatgacaggtttgtggccatctgtcaccctttgcgttacaccctcatgatgagttggcggttgtgtgtgcaactggccatggggtctctggtgctggggttcatcttggccatgcagttgactgtgctcatcttccaactccccttctgcagcagtaaagaaatcagtctgttctactgtgatgtcctccctgtcatgagactggcctgtgcagacacctgggtccatgaggccaccctctttgtggtcagcatcaccgtcctcactatccccttcctgctgatcactctctcctacgtcttcatcgtggccgccatcctgaagattcgctcagcagaggggaggcacaaggccttctccacttgctcctctcacctgactgtggtcctgctgcagtatggatgtgggagcctcatctacctgtgccccagctccagttactctccagagaggggccaggtggtgtctgtggtttacacattcatcacgcctgtgctgaaccccttgatctacagcatgagaaacagggagcttaaggatgctttgaggagaaccatgatcaggttcctgttgtcctaa

SEQ ID NO: 402 - protein, 312 aa, Canis familiaris
MEGANQTGMVRFHFRPFSKLPEVQMLIFVAFLIMYLVSISGNVSISLIIWLNRSLHTPMYFFLANLAALEICYSSTIAPLTLASVLSTERALISLPGCGTQMFFFIFLGSADCILLAVMAYDRFVAICHPLRYTLMMSWRLCVQLAMGSLVLGFILAMQLTVLIFQLPFCSSKEISLFYCDVLPVMRLACADTWVHEATLFVVSITVLTIPFLLITLSYVFIVAAILKIRSAEGRHKAFSTCSSHLTVVLLQYGCGSLIYLCPSSSYSPERGQVVSVVYTFITPVLNPLIYSMRNRELKDALRRTMIRFLLS

SEQ ID NO: 403 - DNA, 936 bp, Canis familiaris
atggccctgagaaatcattccaaggtgtctaaatttattttttgtggacttacccagtctcaagagctgagcttgctcttatttttctttctatctgtagtttatgtgacaacagtgttagcaaatgttgccatcatggtgactgtgacctgtgagtcccgacttcatacccccatgtacttcctgctccgcaacctctcggtcttggacatctgcttctcctccatcactgctcccaaggtccttgtggaccttctgtcaagaacaaagaccatctccttcaatggttgcatcactcagatgttcttcttccaccttctcggtggggcagacattttttctctctctgtgatggcctttgaccgctacatggccatctccaagcccttgcactacgtgaccatcatgagtagggggcgatgcactgccctcattgtggcctcctgggtggggggctttgttcactccatcgtgcagatttccctgttgctgcccctccccttctgtgggcctaatgttgttgatggcttctactgcgatgtcccccaggtcctcaaacttgcctgcactgacacctttgttcttgaagtcttaatgatttccaacaatggtctggtcactaccctgtggtttgtccttcttcttgtgtcctacacagtcatcttgatgatgctgaggtctcacactggggaaggcaggaggaaagccatctctacctgcacagcccacatcactgtggtgacccttcactttgtgccctgcatctatgtctatgcccggcccttcactgcccttcccatggacagagccgtctccatcaccttcacagtcatcatcccggttctgaaccccatgatctacaccctgaggaaccaggagatgaagtcagccatgaggagactgaagagaagacttatgttttctgaaaggacatag

SEQ ID NO: 404 - protein, 311 aa, Canis familiaris
MALRNHSKVSKFIFCGLTQSQELSLLLFFFLSVVYVTTVLANVAIMVTVTCESRLHTPMYFLLRNLSVLDICFSSITAPKVLVDLLSRTKTISFNGCITQMFFFHLLGGADIFSLSVMAFDRYMAISKPLHYVTIMSRGRCTALIVASWVGGFVHSIVQISLLLPLPFCGPNVVDGFYCDVPQVLKLACTDTFVLEVLMISNNGLVTTLWFVLLLVSYTVILMMLRSHTGEGRRKAISTCTAHITVVTLHFVPCIYVYARPFTALPMDRAVSITFTVIIPVLNPMIYTLRNQEMKSAMRRLKRRLMFSERT

SEQ ID NO: 405 - DNA, 936 bp, Canis familiaris; identical to SEQ ID NO: 16

SEQ ID NO: 406 - protein, 311 aa, Canis familiaris; identical to SEQ ID NO: 46

SEQ ID NO: 407 - DNA, 960 bp, Canis familiaris; identical to SEQ ID NO: 19

SEQ ID NO: 408 - protein, 319 aa, Canis familiaris; identical to SEQ ID NO: 49

SEQ ID NO: 409 - DNA, 960 bp, Canis familiaris
atggttgcaggaaagaacaacacaattgtgacgaaattcatcctcctgggattttcagatcatcctcaaatgaagcttttccttttcatgttatttctggggatttatctcttgacactagcctggaacctgagtctcattgtcctcatcaggatggactgccacctgcacacgcccatgtacttcttcctcagtaacctatccttcctagatatctgctatgtgtcctccacaactcccaagatgctctctgacatcatcacagggcagaaaaccatttcctttgttggctgtgccactcagtactttgtgttctgtggaatggggctgactgaatgctttcttttggcagccatggcatatgaccgctatgctgcaatctgcaacccattgctctacacagccctcatttcccacaccctttgtttaaagatggtggttggtgcctatgcaggtggattcctcagttctttgattgaaacatactctgtctacaagcatgatttctgtgggcccaacatgattgaccacttcttctgtgaccttcctcccgttctggttctatcatgctctgatacctttaccagccaggtggtgaacttcattgtgggtgttgttgttggaatggtgtctgtccttgtgatcctcatctcttatggttatattgttgctgctgtcctaaagaccagctcagctaaaggtaggaccaaagccttcagcacctgtgcctctcacctgacttctgtgactcttttctatggttctggtctctttatgtacatgcgacctagttctagctactccctaaaccgggacaaggtggtgtccatattctatgctctggtgatccctatggtgaatcctatcatctacagttttaggaataaggagattaaaaatgccatgaagaaagctatgcagaaggatcacgtgctttctcacgggcctttgtttttctga

SEQ ID NO: 410 - protein, 319 aa, Canis familiaris
MVAGKNNTIVTKFILLGFSDHPQMKLFLFMLFLGIYLLTLAWNLSLIVLIRMDCHLHTPMYFFLSNLSFLDICYVSSTTPKMLSDIITGQKTISFVGCATQYFVFCGMGLTECFLLAAMAYDRYAAICNPLLYTALISHTLCLKMVVGAYAGGFLSSLIETYSVYKHDFCGPNMIDHFFCDLPPVLVLSCSDTFTSQVVNFIVGVVVGMVSVLVILISYGYIVAAVLKTSSAKGRTKAFSTCASHLTSVTLFYGSGLFMYMRPSSSYSLNRDKVVSIFYALVIPMVNPIIYSFRNKEIKNAMKKAMQKDHVLSHGPLFF

SEQ ID NO: 411 - DNA, 939 bp, Canis familiaris
atgactggaggaggcaatactacagagatcacttatttcatccttttgggattctctgatttccccagaatcctagcagtgctctttgctgtattcctgctgatttacattttgactctgacttggaacctgggcctcatcatcttaataaggatggactctcacctccacacgcccatgtacttcttcctcagtaatctgtccttcatagatgtctgctatgtgacctctacagctcccaagatgctctccaactttttccaagagcagcaaaccatcacctttgtgggttgtgccgttcagtactttgtcttttcaaccatgggactgagtgagtcttgtctcatgacagccatggcttatgaccgatacactgccatttgtaatccacttctttattcatcagtcatgtcacccacgctctgtattcagatggtgctgggatcctatctggctgcactctctgcttctatatcccagttgtgtgccatgtttcagcttcatttctgtgggcctaatgtcatcaaccacttcttctgtgacatgccccaactattaatcctgtcctgcactgacaccttccttgtacaactgttgcttgctatactagcaatgatctttgggataataaatgcctttattattatgatatcttatggctttattgtcatgtccatcatgaaaatcacttcagctaaaggcagatccaaagctttcaacacctgtgcttctcatctgacagcagtttctctcttctatacctcaagtatctttgtctatttgagttccagctctggtggttcctccagctttgacagatttgcatcagtattctacactgtggttattcccatgttgaatcccttgatttacagtctgaggaacaaggaaatcaaagatgccttgaagaggttacaaaagaagagatggtattgctga

SEQ ID NO: 412 - protein, 312 aa, Canis familiaris
MTGGGNTTEITYFILLGFSDFPRILAVLFAVFLLIYILTLTWNLGLIILIRMDSHLHTPMYFFLSNLSFIDVCYVTSTAPKMLSNFFQEQQTITFVGCAVQYFVFSTMGLSESCLMTAMAYDRYTAICNPLLYSSVMSPTLCIQMVLGSYLAALSASISQLCAMFQLHFCGPNVINHFFCDMPQLLILSCTDTFLVQLLLAILAMIFGIINAFIIMISYGFIVMSIMKITSAKGRSKAFNTCASHLTAVSLFYTSSIFVYLSSSSGGSSSFDRFASVFYTVVIPMLNPLIYSLRNKEIKDALKRLQKKRWYC

SEQ ID NO: 413 - DNA, 939 bp, Canis familiaris
atgactgggggaggaaatactacagagatcacttatttcatccttttgggcttctctgatttccccagaatcctagcagtgctctttgctgtattcctgctgatttacattttgactctgacttggaacctgggcctcatcatcttaataaggatggactctcacctccacacgcccatgtacttcttcctcagtaatctgtccttcatagatgtctgctatgtgacctctacagctcccaagatgctctccaactttttccaagagcagcaaaccatcacctttgtgggttgtgccgttcagtactttgtcttttcaaccatgggactgagtgagtcttgtctcatgacagccatggcttatgaccgatacactgccatttgtaatccacttctctattcatcagtcatgtcacccacactctgtattcagatggtgctgggatcctatctggctgcactctctgcttctatatcccagttgtgtgccatgtttcagcttcatttctgtgggctgaatgtcatcaatcacttcttctgtgacatgccccaactattagtcctgtcctgcactgacactttgtttgtaaacctcttgactgctatattaacaatgatctttgggataataaatgcctttattattatgatatcttatggctttattgtcatgtccatcatgaaaatcacttcagctaaaggcagatccaaagctttcaacacctgtgcttctcatctgacagcagtttctctcttctatacctcaggtatctttgtctatttgagttccagctctggtggttcctccagctttgacagatttgcatcagtattctacactgtggttattcccatgttgaaccccttgatttacagtctgaggaacaaggaaataaaagatgccttgaagaggttaccaaagaagacatggtattgttga

SEQ ID NO: 414 - protein, 312 aa, Canis familiaris
MTGGGNTTEITYFILLGFSDFPRILAVLFAVFLLIYILTLTWNLGLIILIRMDSHLHTPMYFFLSNLSFIDVCYVTSTAPKMLSNFFQEQQTITFVGCAVQYFVFSTMGLSESCLMTAMAYDRYTAICNPLLYSSVMSPTLCIQMVLGSYLAALSASISQLCAMFQLHFCGLNVINHFFCDMPQLLVLSCTDTLFVNLLTAILTMIFGIINAFIIMISYGFIVMSIMKITSAKGRSKAFNTCASHLTAVSLFYTSGIFVYLSSSSGGSSSFDRFASVFYTVVIPMLNPLIYSLRNKEIKDALKRLPKKTWYC

SEQ ID NO: 415 - DNA, 948 bp, Canis familiaris
atgacggaaggaagaaacagcactatagttaccaggtttatcttattgagattctctgaatttccaagatgtgacgtcaccgtcttttcaatattcctaggcatccacctcatgacagtgtcctggagtgtggatctcatcaccctgatcaagatggaatcctacctgcacacccccgtggatttctttatcaataagcttgccttcttaggcatttgttacatttcctccacaagttccaagatgctctctgatttcttgaagaagcagaaatccatctcctgtctggggtggaccacgcagcactcattctctatcctgggtgtgactgagagctgtttcctggcagctatgggttatgaccgatgtgcttccatttgtaatcctctgctctgtactgccatcatgtcacccaccctctgtgtgcagatggtggcaggatcttgtataactggattctcgggctcatttatccaactgtatgccctacttcagctccatttctgtgggccaaatgtcatcaatcatttcttctgtgatcttccccaaccgccgatcctatcctgctctgacacatttttctttcaactcatgacctctgtgctcacagtgatctttggactcacatccttggttatcatgatatcctatgtcttggttatcatgatatcctatggttatattgttgctaccattttggagatcacatcagctgaagcagatccaaggccttcaacaatcatgcttctcactgacagctgtgactcttttttatggctccagcacctttgtctatttgtgccctagttctgatgattttctgagccaaaataagctttaatctgttgtatatgcttggtgattcctatgttaaatctattgatctacagcttaaggagtaaggaaatcgaaaatgcctcaagcagatggaagaagagaatattttca

SEQ ID NO: 416 - protein, 268 aa, Canis familiaris
MTEGRNSTIVTRFILLRFSEFPRCDVTVFSIFLGIHLMTVSWSVDLITLIKMESYLHTPVDFFINKLAFLGICYISSTSSKMLSDFLKKQKSISCLGWTTQHSFSILGVTESCFLAAMGYDRCASICNPLLCTAIMSPTLCVQMVAGSCITGFSGSFIQLYALLQLHFCGPNVINHFFCDLPQPPILSCSDTFFFQLMTSVLTVIFGLTSLVIMISYVLVIMISYGYIVATILEITSAEADPRPSTIMLLTDSCDSFLWLQHLCLFVP

SEQ ID NO: 417 - DNA, 960 bp, Canis familiaris
atggttgcaggaaagaacaacacaattgtgatgaaattcagcctcctgggattttcacatcatcctcaaatgaagcttttccttttcgagttgcttctggggatttatctcttgacactagcctggaacctgagtttcattgtcctcatcaggatggactgccacctgcacacgcccatgtacttcttcctcagtaacctatccttcctagatatctgctatgtgtcctccacaactcccaagatgctctctgacatcatcacagggcagaaaaccatttcctttgttggctgtgccactcagtactttgtgttctgtggaatggggctgactgaatgctttcttttggcagccatggcatatgaccgctatgctgcaatctgcaacacattgctctacacagccctcatttcccacaccctttgtttaaagatggtggttggtgcctatgcaggtggattcctcagttttttgattgaaacatactctgtctacaagcatgatttctgtgggcccaacatgattgcccacttcttctgtgaccttcctcccgttctggttctatcatgctctgatatctttaccagccaggtggtgaacttcattgtgggtgttgttgttggaatggtatctgtccttgtgatcctcatctcttatggttatattgttgctgctgtcctaaagaccagctcagctaaaggtaggaccaaagccttcagcacctgtgcctctcacctgacttctgtgactcttttctatggttctggtctctttatgtacatgcgacctagttctagctactccctaaaccgggacaaggtggtgtccatattctatgctctggtgatccctatggtgaatcctatcatctacagttttaggaataagaagattaaaaatgccatgaagaaagctatgcagaaggatcacgtgctttctcacgggcctttgtttttctga

SEQ ID NO: 418 - protein, 319 aa, Canis familiaris
MVAGKNNTIVMKFSLLGFSHHPQMKLFLFELLLGIYLLTLAWNLSFIVLIRMDCHLHTPMYFFLSNLSFLDICYVSSTTPKMLSDIITGQKTISFVGCATQYFVFCGMGLTECFLLAAMAYDRYAAICNTLLYTALISHTLCLKMVVGAYAGGFLSFLIETYSVYKHDFCGPNMIAHFFCDLPPVLVLSCSDIFTSQVVNFIVGVVVGMVSVLVILISYGYIVAAVLKTSSAKGRTKAFSTCASHLTSVTLFYGSGLFMYMRPSSSYSLNRDKVVSIFYALVIPMVNPIIYSFRNKKIKNAMKKAMQKDHVLSHGPLFF

SEQ ID NO: 419 - DNA, 939 bp, Canis familiaris
atgactgggggaggaaatactacagagatcacttatttcatccttttgggattctctgatttccccagaatcctagcagtgctctttgctgtattcctgctgatttacattttgactctgacttggaacctgggcctcatcatcttaataaggatggactctcacctccacacacccatgtacttcttcctcagtaatctgtccttcatagatgtctgctatgtgacctctacagctcccaagatgctctccaactttttccaagagcagcaaaccatcacctttgtgggttgtgccgttcagtactttgtcttttcaaccatgggactgagtgagtcttgtctcatgacagccatggcttatgaccgatacactgccatttgtaatccacttctctattcatcagtcatgtcacccacgctctgtattcagatggtgctgggatcctatctggctgcactctctgctagtatatcccagttgtgtgccatgtttcagcttcatttctgtgggcctaatgtcatcaatcacttcttctgtgacatgccccaactattaatcctgtcctgcactgacactttctttgtacatctgttgattgctatactagcaacgatctttgggatgataaatgcctttattattatgatatcctatggctatattgtcatgtccatcatgaaaatcacttcagctaaaggcagatccaaagctttcaacacctgtgcttctcatctgacagcagtttctctcttctatacctcaagtgtctttgtttatttgagttccagctctggtggttcctccagctttgacagatttgcatcagtattctacactgtggttattcccatgttgaatcccttgatttacagtctgaggaacaaggaaataaaagatgccttgaagaggttaccaaagaagacatggtattgctga

SEQ ID NO: 420 - protein, 312 aa, Canis familiaris
MTGGGNTTEITYFILLGFSDFPRILAVLFAVFLLIYILTLTWNLGLIILIRMDSHLHTPMYFFLSNLSFIDVCYVTSTAPKMLSNFFQEQQTITFVGCAVQYFVFSTMGLSESCLMTAMAYDRYTAICNPLLYSSVMSPTLCIQMVLGSYLAALSASISQLCAMFQLHFCGPNVINHFFCDMPQLLILSCTDTFFVHLLIAILATIFGMINAFIIMISYGYIVMSIMKITSAKGRSKAFNTCASHLTAVSLFYTSSVFVYLSSSSGGSSSFDRFASVFYTVVIPMLNPLIYSLRNKEIKDALKRLPKKTWYC

SEQ ID NO: 421 - DNA, 939 bp, Canis familiaris
atgactggaggaggcaatactacagagatcacttatttcatccttttgggattctctgatttccccagaatcctagcagtgctctttgctgtattcctgctgatttacattttgactctgacttggaacctgggcctcatcatcttaataaggatggactcgcacctccacacgcccatgtacttcttccccagtaatctgtccttcatagatgtctgctatgtgacctctacagctcccaagatgctctccaactttttccaagagcaacaaaccataacctttgtgggttgtgccgttcagtactttgtcttttcaaccatgggactgagtgagtcttgtctcatgacaaccatggcttatgaccgatacactgccatttgtaatccacttctctattcatcagtcatgtcacccacgctctgtattcagatggtgctgggatcctatctggctgcactttctgcttctatatctgagttgtgtgccttgtttcagcttcatttctgtgggcttaacgtcatcgaccacttcttctgtgacatgccccaactgttagtcctatcctgcactgacactttgtttgtaaatctcttgactgctatattaacaatgatctttgggataataaatgcctttattattgtgatatcctatggctttattgtcatgtccatcatgaaaatcacttcagctaacggcagatccaaagctttcaacacctgtgcttctcatctgacagcagtttctctcttctatacctcaggtatctttgtctatttgagttccagctctggtggttcctccagctttgacagatttgcatcagtattctacactgtggttattcccatgttgaatcccttgatttatagtctgaggaacaaggaaatcaaagatgccttgaagaggttacaaaagaagagatggtattgctga

SEQ ID NO: 422 - protein, 312 aa, Canis familiaris
MTGGGNTTEITYFILLGFSDFPRILAVLFAVFLLIYILTLTWNLGLIILIRMDSHLHTPMYFFPSNLSFIDVCYVTSTAPKMLSNFFQEQQTITFVGCAVQYFVFSTMGLSESCLMTTMAYDRYTAICNPLLYSSVMSPTLCIQMVLGSYLAALSASISELCALFQLHFCGLNVIDHFFCDMPQLLVLSCTDTLFVNLLTAILTMIFGIINAFIIVISYGFIVMSIMKITSANGRSKAFNTCASHLTAVSLFYTSGIFVYLSSSSGGSSSFDRFASVFYTVVIPMLNPLIYSLRNKEIKDALKRLQKKRWYC

SEQ ID NO: 423 - DNA, 927 bp, Canis familiaris
atgacggaaggaagaaacagcactatagttaccaggtttatcttattgagattctctgaatttccaagatgtgacgtcatcgtcttttcaatattcctaggcatccacctcatgacagtgtcctggagtgtggatctcatcaccctgatcaagatggaatcctacctgcacacccctgtggatttctttatcaataagcttgccttcttaggcatttgttacgtttcctccacaagttccaagatgctctctgatttcttgaagaagcagaaatccatctcctgtctggggtggaccacgcagtacttcttctctagcctgggtctgactgagtgctgtctcctggcagctatgggttatgaccaatgtgctaccatttgtaatcctctgctctgtactgccatcatgtcacccaccctctgtgtgcagatggtggcaggatcttgtataactggattcttaggctcatttatccaactgtatgccctacttcagctccatttctgtgggccaaatgtcatcaatcatttcttctgtgatcttccccaaccgccgatcctaccctgctctgacacatttttctttcaactcatgacctctgtgctcacagtgatctttggactcacatctgtcttggttatcatgatatcctatggttatattgttgctaccattttggagatcacatcagctgaagcagatccaaggccttcaacaatcatgcttctcactgacagctgtgactcttttttatggctccagcacctttgtctatttgtgccctagttctgatgattttctgagccaaaataagctttaatctgttgtatatgcttggtgattcctatgttaaatctattgatctacagcttaaggagtaaggaaatcgaaaatgcctcaagcagatggaagaagagaatattttca

SEQ ID NO: 424 - protein, 261 aa, Canis familiaris
MTEGRNSTIVTRFILLRFSEFPRCDVIVFSIFLGIHLMTVSWSVDLITLIKMESYLHTPVDFFINKLAFLGICYVSSTSSKMLSDFLKKQKSISCLGWTTQYFFSSLGLTECCLLAAMGYDQCATICNPLLCTAIMSPTLCVQMVAGSCITGFLGSFIQLYALLQLHFCGPNVINHFFCDLPQPPILPCSDTFFFQLMTSVLTVIFGLTSVLVIMISYGYIVATILEITSAEADPRPSTIMLLTDSCDSFLWLQHLCLFVP

SEQ ID NO: 425 - DNA, 975 bp, Canis familiaris
atggctgggggaaggaacagtacagcagttatgaagttcattctcttgggattctctgaatttcccaaactcaccattgtcctttttacaatattcctagggatctacctcatgacagtgtcctggaacctgggtctcatcactctcatcagggtggattcccatctgcacatacctatgtactttttcctcagtaacttgtccttcctggacatctgctatgtttccactatagcgcccaaaatgctctctgatttcttcaagaaggagaaatccatctcctttctgggatgtaccacacagtacttcttcttctctagcctgggtctgactgagtgctgtctcctggcagctatgggttatgaccgatacgctgccatttgtaatcctctgctctatactgccatcatgtcacccaccctctgtgtgcagatggtggcaggatcttgtacaactggattcttgggctcatttatccaactgtgtgccttacttcagctccatttctgtgggccaaatgtcatcaatcatttcttctgtgatcttccccaactgctgatcctgtcctgctctgacacatttttctttcaaatcatgacctctgtgctcacggtgatctttggactcacatctgtcttggttatcatgatatcctatggttatattgttgccaccattctgaagatcacatcagctgaaggcaggtccaaggccttcaacacctgtgcttctcacctgacagcagtgactctcttctttggctcaggtatctttgtttatatgtatccaaactctgatgattccctgagccaaaacaagttggcatcagttttatatactattataatccccatgctaaatccattgatctatagcttgaggaacaaggaaatcaaagatgccctaaacagatggaagaagagaattttttctgttgttactaattatggaatttatttcagatgtacagcatag

SEQ ID NO: 426 - protein, 324 aa, Canis familiaris
MAGGRNSTAVMKFILLGFSEFPKLTIVLFTIFLGIYLMTVSWNLGLITLIRVDSHLHIPMYFFLSNLSFLDICYVSTIAPKMLSDFFKKEKSISFLGCTTQYFFFSSLGLTECCLLAAMGYDRYAAICNPLLYTAIMSPTLCVQMVAGSCTTGFLGSFIQLCALLQLHFCGPNVINHFFCDLPQLLILSCSDTFFFQIMTSVLTVIFGLTSVLVIMISYGYIVATILKITSAEGRSKAFNTCASHLTAVTLFFGSGIFVYMYPNSDDSLSQNKLASVLYTIIIPMLNPLIYSLRNKEIKDALNRWKKRIFSVVTNYGIYFRCTA

SEQ ID NO: 427 - DNA, 957 bp, Canis familiaris
atggctggaggaaggaacaatacaatagtcatcagattcatccttttgggattctcagattatcccaagcttaagattcttctctttgcaggattcttgggttcttatgtcttgacagtggcctggaacctggggctcatcatcttgattaagatagacccttatctacatacacccatgtacttcttcctcagcaacttatccttcttagatttttgctatgttacctccacaaccccgaaaatgctctcagacttcttccagaagcctaaatccatctcttttctgggatgcactatgcagtacttcttcttctctagcctgggtctgactgagtgctgtctcctggcagccatggcttatgatcgatatgctgctatttgtaatcctctgctctacactactaccatgtcacccccattctgtgtacagatgatggttggagcctatataactggtctctttggttcattgatccaactgtgtgctttacttcagctcaatttctgtgggccaaatgttatcaaccatttcttctgtgacctgcctcaattattagtcctatcctgctctgaaaccttcttcctaaaagtcatgaagtttgtgatagcagtgatttttggtgtgatatctgtctttgtcatcatgatatcttatggttatattgttgcaaccattctgaagataagctctgttgaaggcaggtccaaggctttcaacacctgtacttctcacttgacagcagtgatctgtttttttggatcaggactctttgtctatatgcaccccagcactggcaattctgtgggccaggacaagatagcatcagtcttctatacagtggtgatcccgatgttgaatcctctaatttacagtctgaggaacaaggaaatcaaagatgcccttaagaggtgtaagaagagagtcattttcccattgttacagctaaaggtctag

SEQ ID NO: 428 - protein, 318 aa, Canis familiaris
MAGGRNNTIVIRFILLGFSDYPKLKILLFAGFLGSYVLTVAWNLGLIILIKIDPYLHTPMYFFLSNLSFLDFCYVTSTTPKMLSDFFQKPKSISFLGCTMQYFFFSSLGLTECCLLAAMAYDRYAAICNPLLYTTTMSPPFCVQMMVGAYITGLFGSLIQLCALLQLNFCGPNVINHFFCDLPQLLVLSCSETFFLKVMKFVIAVIFGVISVFVIMISYGYIVATILKISSVEGRSKAFNTCTSHLTAVICFFGSGLFVYMHPSTGNSVGQDKIASVFYTVVIPMLNPLIYSLRNKEIKDALKRCKKRVIFPLLQLKV

SEQ ID NO: 429 - DNA, 963 bp, Canis familiaris
atggccgtgcgaaggaacatcagcatgacagccaatttcatccttgtgggattttcagagcatccagagctacaagttgtcctctttgtgttgtttctggggatctactccatgactctggcttggaacctgggcctcattgtcttgatcaggatggaatcatgtctccattcccccatgtatttcttccttggaaatttgtcttttgttgatatctcatatacatcctccattgcccccaagatgctctgtgacttcttcaagcagcagaagaccatctcctttgtgggctgtgctgctcaatttttcttcttcattgggatgggaggcactgaatgctgtcttctggcagccatggcatatgaccgatatgcggctatctccaaccctctgctctacacagccctcatgtcgcccaccatctgtgtgaggatggtcattacagcatacactggagggttcctcactggattggtccaaaccagctctgtattccagctgcatttctgtgggccacgagtcattgatcactttttctgtgacctgccacctctgctggtcttatcttgctctagtaccttcctcagccaggtagtgaactttcttgttgtgtgtgcagttggtgggacatcagctcttgttgtcctggtgtcctatggctacatcattgctgctgtcatgaagatccattcaacccaagggcggatgaaggctttcaacacctgtgcctctcatctgaccatggtgattctcttctatggctctggtctcttctcataccttcattctagtgctagctactcacaggaccaagacaaggtggtgtccatgttctatggagctgtgattcccatgctgaatcctatcatatatagtttgcgaaacaaggacatcaaagatgcattgaaaaaactcaaggacaggaagaagcagatatcctctctgtgtcttatagttccttga

SEQ ID NO: 430 - protein, 320 aa, Canis familiaris
MAVRRNISMTANFILVGFSEHPELQVVLFVLFLGIYSMTLAWNLGLIVLIRMESCLHSPMYFFLGNLSFVDISYTSSIAPKMLCDFFKQQKTISFVGCAAQFFFFIGMGGTECCLLAAMAYDRYAAISNPLLYTALMSPTICVRMVITAYTGGFLTGLVQTSSVFQLHFCGPRVIDHFFCDLPPLLVLSCSSTFLSQVVNFLVVCAVGGTSALVVLVSYGYIIAAVMKIHSTQGRMKAFNTCASHLTMVILFYGSGLFSYLHSSASYSQDQDKVVSMFYGAVIPMLNPIIYSLRNKDIKDALKKLKDRKKQISSLCLIVP

SEQ ID NO: 431 - DNA, 951 bp, Canis familiaris
atggagaatagcacagaagccacagagttcatcctcttgggattaacagatgaccccaatcttcaggtccccctcctcctggtatttttgttcatctacctcatcactctggttgggaatgggggcatgatggtgatcatccacttagacccccacttccacactcccatgtatttctttctcagtaacctctccttcgtagacctgggttactcctcagctgtagccccaaaggcagtggctgccctgcagtcagggaacaaagtcatctcctacagtggatgtgctgcccagttctttttctttgtgggttttgccactgctgagtgctacctcctggcctgcatggcctatgaccgccatgcagccatatgcaggcctcttcattacaccaccaccatgagagcaggtgtatgtgccctcctgactgttggctcctatgtctgtggcttcctcaatgcttctattcacacaggaaacacctttagactctcgttctgtgcttctcatgagattaatcattttttctgcgatcttcctccactcttggctctctcatgttccaacacacgcatcaacaacttggttgtcttctgtgtcgtgggcttcaacgtctttttcaccctcctggtcatcctcatctcttacctcttcatatacatcgccattcaaaggatacgttctgtggaaggacgaaagaaagccttctccacctgtgcctcccacctcactgccgtaaccatcttctacggaactatcatcttcatgtacttccagcccagctccagccagtccatggacacagacaaaattgattctgtgttttactcagtggtgattcccatgttgaaccccttgatctacagccttaggaacaaagacgtaaaaaatgctctccggaaagtactcaacaaacttcacccccagtctgtaagtgtaggtgggaagtag

SEQ ID NO: 432 - protein, 316 aa, Canis familiaris
MENSTEATEFILLGLTDDPNLQVPLLLVFLFIYLITLVGNGGMMVIIHLDPHFHTPMYFFLSNLSFVDLGYSSAVAPKAVAALQSGNKVISYSGCAAQFFFFVGFATAECYLLACMAYDRHAAICRPLHYTTTMRAGVCALLTVGSYVCGFLNASIHTGNTFRLSFCASHEINHFFCDLPPLLALSCSNTRINNLVVFCVVGFNVFFTLLVILISYLFIYIAIQRIRSVEGRKKAFSTCASHLTAVTIFYGTIIFMYFQPSSSQSMDTDKIDSVFYSVVIPMLNPLIYSLRNKDVKNALRKVLNKLHPQSVSVGGK

SEQ ID NO: 433 - DNA, 945 bp, Canis familiaris
atggagaacggtacagaggtgactgagttcattcttgtgggcttaaccaatgaccccaaactgcagattcctctcttcttagtcttctccctcatttacctcatcactctggctgggaacctgggcatgatggtactgattctcatggactcccgtctccacaatcctatgtactttttcctcagtaacctgtctctggtggactttggttactctacagctgtcactcccaaggtcatggctggattacttacaggagacaaggtcatgtcctacaatgcatgtgtcacccagttctttttctttgtagcctttatcactgcagaaagtttcctcttggcctcaatggcctatgaccgctacgcagctgtgtgcaaacccctgcattataccaccatcatgacaacaggtgtgtgtgctcgtctggtcataggctgttacatctgtggtttcctgaatgcttccattcacactgggaatattttcagcctttccttttgtagagccaatgttgttgatcacttcttctgcgatgctcctcctctcctggctctctcatgctcagacaactacattagtgagatggttatttttttggtggtgggcctcaatgacttcttttctgtcttagtcatcctgatatcctacctgtttatatttatcactattctgaggatgcatgcatctgaaggacgccagaaggccttttccacctgtgcctctcacctcactgctgtgtccatcttctatgggacaggcaccttcatgtacttacagccaagctccagccattccatggacacagacaaaatggcatccatgttctatacaatggtcattcccatgctaaacccagtggtctacagcatgaggaacaaagaggtcaccagtgcctttaaaaagactgtagagaaggcaaagtcttttataggattcatattttaa

SEQ ID NO: 434 - protein, 314 aa, Canis familiaris
MENGTEVTEFILVGLTNDPKLQIPLFLVFSLIYLITLAGNLGMMVLILMDSRLHNPMYFFLSNLSLVDFGYSTAVTPKVMAGLLTGDKVMSYNACVTQFFFFVAFITAESFLLASMAYDRYAAVCKPLHYTTIMTTGVCARLVIGCYICGFLNASIHTGNIFSLSFCRANVVDHFFCDAPPLLALSCSDNYISEMVIFLVVGLNDFFSVLVILISYLFIFITILRMHASEGRQKAFSTCASHLTAVSIFYGTGTFMYLQPSSSHSMDTDKMASMFYTMVIPMLNPVVYSMRNKEVTSAFKKTVEKAKSFIGFIF

SEQ ID NO: 435 - DNA, 789 bp, Canis familiaris
aacagcatggaagtgactgtgttcatccttctaggatattcagatgctccaggactgcaggcctcactccttatgacattcaccttcttctacctttttactctagttggaaatctgggggtgattgtgttgattctgttggactccagtctctagatgcccatgtactttttcttcagtaacctgtctatgatggatttttgttatatacccagggtcatgacaggacttcttagaggagaccaggtcatctcctataatgcatgtgctgctcagatgttcttttttgcagcctttgcatctatggaaagttacctcttagtctcagtggcctatgactgctactcagcagtgtgcaaacctctccattacaccaccaccatgacaacagatgtgtgtgctcatctggccatttgtgatgttctgaatgcctctgtaagtgttgaagataccttcaatctttcttcttgtatgtcaaatgtggttcatcactttttctgtaatattccagcagtcacagctctggcttgctctgatcagtgagttggttatctatatgacctgacttcctttttaaatgttttctcttgtagttatctttatttctacctgtttacatttatcaccatcttgaagatgcactcaactcagaggaatcaaaaggttttgtccgcctgtgcttgcaatctcactgtagtctccatcttctacgggacagtcatcttcatgtacttgtagcccagcttcaagaattccatggacacaatcaaaatggcatttattatattc

SEQ ID NO: 436 - protein, 59 aa, Canis familiaris
QHGSDCVHPSRIFRCSRTAGLTPYDIHLLLPFYSSWKSGGDCVDSVGLQSLDAHVLFLQ

SEQ ID NO: 437 - DNA, 939 bp, Canis familiaris
atggagaacagcactgaggtgaatgagtttatgctcttggggctaactgacaacccagaactgcaagtccctctctttataacattcactctcatttatttcactactctcattggaaatctcggaattatcatgttgattctgttggactctcgtctccatactcccatgtatatcttcctcagtaacctgtctctggtggactgtgtttactcctcggctgttactcccaaggtgatggctgggcttctcacaggggataaagtcatctcctatggtggatgtgttgctcagatgtttttctttgtggcttttgccagtgtagactgtttcctgctcgctgtcatggcttatgatcggcatgcagcagtatgtaagcccttacattatgccaccactatgaccaccagcttgtgtgctcagatggcagtaggctgctatgtctggggctttattgaatcttccatccacactggattcaccttttgcctctccttctgtcattccaatgtggtccatcactttttctgtgatattcccccaattatagctctttcctgctctgatatctacctaaatgagattgtgctctttatcttagcagctttcaatgtctgttttgctcttatagttatcttgacctcctatctgttcatcttcattgccatcctgaggatgcgctcagctgagggaaggaagaaagccttctccacctgtgcctcacacctcactgctgtaaccatcttctatggaactgtcatgttcatgtacttacaacctagttctagtcattctatggacaatgaccaaatggcatctgtgttctataccataatagtccccatgttgaaccctattgtctacagtctaaggaataaagaggtgaataatgcttttaggaaagtcaccaagaagctaaagattctgtttggcccatag

SEQ ID NO: 438 - protein, 312 aa, Canis familiaris
MENSTEVNEFMLLGLTDNPELQVPLFITFTLIYFTTLIGNLGIIMLILLDSRLHTPMYIFLSNLSLVDCVYSSAVTPKVMAGLLTGDKVISYGGCVAQMFFFVAFASVDCFLLAVMAYDRHAAVCKPLHYATTMTTSLCAQMAVGCYVWGFIESSIHTGFTFCLSFCHSNVVHHFFCDIPPIIALSCSDIYLNEIVLFILAAFNVCFALIVILTSYLFIFIAILRMRSAEGRKKAFSTCASHLTAVTIFYGTVMFMYLQPSSSHSMDNDQMASVFYTIIVPMLNPIVYSLRNKEVNNAFRKVTKKLKILFGP

SEQ ID NO: 439 - DNA, 702 bp, Canis familiaris
ttctgttactcctcaacagtcactcctaaggtcatagctcagctccttatgggagataaggtcatctctacaatgcatgtgttgtcagatgttcctttttggaatctttgccactgtggaaagttaccttttagcctcagtggtctatgactgctacacagcagtgtgtaaacaccattgcaccaccgccatggaaacaggtgtgtgtgcttgtctgatcaataggttgctatgtctgtagttttctgattgattcttttgatgtaggagacacattccatttcccttctgtaagtcctctctcctatccatcactttctgagctattcctgcagtatggctctctctctcgttctgatagacatgtcagtgagctggttcttgtctttgtagcaatctttaacatctttcttgctctcctagttatcttgatttcctacttgctcatatttatcaccatcctggagatgccctcaattgaggactgtatccacctgtgcctctcacctcacttcagtgtccatcttctatagggcagtcatcttcatgtacatacagcccacctccagccactctatgggcacagacaaaatcgcatctgtgttctatcctatgatcatcctcatgctgaacccgctggtctatagcctgaggaacaaagaggtcaagaatgctttcaagaaagttgttgaggaggtaaaa

SEQ ID NO: 440 - protein, 62 aa, Canis familiaris
FYLLNNFLESILDLFVPQAIDQRVQHEDDHRIEHRCDFVCAHRVAGGGLYVHEDDCPIEDGH

SEQ ID NO: 441 - DNA, 864 bp, Canis familiaris
cctctctttctaatgtttaccctcatgtacctcatcattgtggttgggaacctggggatgaccatgctgatcctgctggactcccgtctgtatattcccatgtacctcttcctcagtaacctgtctccggtggactttcgttactcctccacaatcactcccaaggtaatggctggattacttataggagaccaggtcttctcctgcagtgcatgtgctgcccagatgttcttttttgtactctttgtggcagtggaaagttacctcttagcttcaatggcctatgaactctatgcagctgtaatggccttgcattacaccaccaccatggcgacagtgtgtgtgtgtgctcatctggccatagactcttatgcctttgcctttctaactcctgttattgacattggagacacgttctatttctctttctgtatgttcaaggtagtccatcactttttctgtgatatcccagcagctatgactctaacttgctcagatagagatattaacaagctgattcttgttatttcaagctttaatatcttttctgcactttttatcttgatttcctacgtgttcatatttatcactgttttgaagatacaatcaggtgagggataccagaagtctttatctacctgtgcttctcaccttgtcacagtttccttattttatgggacagtcatcatcatgtacttacagccaagttctcatcattccatggacacagacaaaatcgcatctgtgttctatactatggtcacccccatgctgaaccaagtggtatacagcttgaggaacaaagagatcaagaatgctttcaagaaggtggttgaaaaggtaaaatattctctaggtatagtt

SEQ ID NO: 442 - protein, 288 aa, Canis familiaris
PLFLMFTLMYLIIVVGNLGMTMLILLDSRLYIPMYLFLSNLSPVDFRYSSTITPKVMAGLLIGDQVFSCSACAAQMFFFVLFVAVESYLLASMAYELYAAVMALHYTTTMATVCVCAHLAIDSYAFAFLTPVIDIGDTFYFSFCMFKVVHHFFCDIPAAMTLTCSDRDINKLILVISSFNIFSALFILISYVFIFITVLKIQSGEGYQKSLSTCASHLVTVSLFYGTVIIMYLQPSSHHSMDTDKIASVFYTMVTPMLNQVVYSLRNKEIKNAFKKVVEKVKYSLGIV

SEQ ID NO: 443 - DNA, 297 bp, Canis familiaris
acaaattatatggtcagcatcaccgtcctggccatccccttcctgtttatcattccctcctctgtcttcatcgtggccaccaacctgaagattcgcttggccgaggggaggccctaggccttctccacctgctcccttcacctgactgtggtcctgctgcagtagggatgttccaaccccagttactctccagagagggcccagggagtgtctgtggtttacacattcctcacccaggtgctgaaccccttgatctatagcatgagaaacaagttgtttaaggatgcttttaagaaa

SEQ ID NO: 444 - protein, 99 aa, Canis familiaris
FLKSILKQLVSHAIDQGVQHLGEECVNHRHSLGPLWRVTGVGTSLLQQDHSQVKGAGGEGLGPPLGQANLQVGGHDEDRGGNDKQEGDGQDGDADHIIC

SEQ ID NO: 445 - DNA, 1029 bp, Canis familiaris
atgacttctttcctcataccaggtctcatggaagaggaaaaccagacaggagtggtccagttccacttccaccccttctccacagacccagcggtggttcccctcctatttgtggccttcttgctgttgtacttaggaagtcttgttggaaacatgaccattgggctgacggtctggagagatcactccctccataccccgatgtacttcttcctttttgttctggccgtgctggagatcggctactctaccaacattgctcccctgactctggctggcatcctttccatggggcggatgcttatctctctccctggctgtggggcccagatgttcttgttcatccttcttggcgggtctgactgtgtcctgcttgctgtcatggcctacgacaggtacgtggcaatctgtcatccgttgcactacaacctcatcatgagttgggagctctgtgggcagatgactttgggctcattggggctgggattcctgttgtcactgcccttgaccattctgatctgccaccttccattctgtggccacaatgagatccaccactttttctgtgacatgcctgcagtcatgcgcctggcctgcacagacacccgcctgcatgaagcaactctctatgccctcagcgtggtggctgtggctgtccccttcctcctcatctgcctctcctatggctgcatcgtggccaccatcctgaggatgaattcagctgagggaaagcgccgggctttctccacctgttcctcccaccttatcgtcgttctcctgcaatatgggtgttgcagcctcatctaccttcgccccagctccagctactccccagaagagggccgggcagtgtccgttgtctacacctttttctccccagtgctaaaccccttgatctatagcataaagaatcaagaggtgactgatgcaataaggagacttatggcaagaatgtgctgggtcaggaaaccagaaatatttcttcctagaaaaaatattccccaaaccaggaataagggcatgatgtaa

SEQ ID NO: 446 - protein, 342 aa, Canis familiaris
MTSFLIPGLMEEENQTGVVQFHFHPFSTDPAVVPLLFVAFLLLYLGSLVGNMTIGLTVWRDHSLHTPMYFFLFVLAVLEIGYSTNIAPLTLAGILSMGRMLISLPGCGAQMFLFILLGGSDCVLLAVMAYDRYVAICHPLHYNLIMSWELCGQMTLGSLGLGFLLSLPLTILICHLPFCGHNEIHHFFCDMPAVMRLACTDTRLHEATLYALSVVAVAVPFLLICLSYGCIVATILRMNSAEGKRRAFSTCSSHLIVVLLQYGCCSLIYLRPSSSYSPEEGRAVSVVYTFFSPVLNPLIYSIKNQEVTDAIRRLMARMCWVRKPEIFLPRKNIPQTRNKGMM

SEQ ID NO: 447 - DNA, 939 bp, Canis familiaris
atgggtaacaggacagaagtgacacagttcatcctgctgggactaaccaatgacccagaactgcaggttcctctcttcataatgttcaccttcatctacctcatcactctggttgggaatttggggattaccgtgctgattctcttggactcccgtctccacactcccatgtactttttcctcagtaacctgtctctggcagactttggttactctacagctgtcacacccacagtcatggctgggttacttagaggagaccaggtcatctcctacagtgcatgtgctgctcagatgttcatttttgctgtctttgccactgtggaaaattatctcttggcctcaatggcctatgaccgctacgcagcagtgtgcaaacccctccattacaccaccactatgacgacaggtgtgtgtgcttgtctggccataggctcctatgtctgtggtttcctgaatgcctctatccacattggaggcacatttagtctctctttctgtatgaacaatgaagtccatcactttttctgtgatatcccagcagtcatggttctttcttgctctgatagacacgtcagtgagctggctcttgtttatgcaaccacttttaacatcatttttgctctcctggttatctttgtatcctacatattcatatttatcaccatcctgaagatgcactcttcttcagtatacctaaaggctatatccacctgtgcttcccacctcactgcagtgtccatcttctatggagcagtcatcttcatgtacacacagcccagctccagccattccatggacacagacaaaatggcatccgtgttctacaccatggtcatccccatgctgaaccctgtggtctacagcctgagaaacaaggaggtcaagaatgcattcatgaaaattgttttagagtcaaagttgtctttaggattgtga

SEQ ID NO: 448 - protein, 312 aa, Canis familiaris
MGNRTEVTQFILLGLTNDPELQVPLFIMFTFIYLITLVGNLGITVLILLDSRLHTPMYFFLSNLSLADFGYSTAVTPTVMAGLLRGDQVISYSACAAQMFIFAVFATVENYLLASMAYDRYAAVCKPLHYTTTMTTGVCACLAIGSYVCGFLNASIHIGGTFSLSFCMNNEVHHFFCDIPAVMVLSCSDRHVSELALVYATTFNIIFALLVIFVSYIFIFITILKMHSSSVYLKAISTCASHLTAVSIFYGAVIFMYTQPSSSHSMDTDKMASVFYTMVIPMLNPVVYSLRNKEVKNAFMKIVLESKLSLGL

SEQ ID NO: 449 - DNA, 834 bp, Canis familiaris
tctataactggaaacctgtatctcctactatccttcactcattttgccctaaaaaattatttctctgcatttatgtgaccatttcagctttttgttttgatgtatgctccctggtggactgtgcttatttccaggttgttactccaaggtgatggctgggtttctcacagaggataaagttgtctcctgtgatggatgtgcttctcagatgtttttctttgtggcttttgccagtgtagactgtttcctgctagctgtcatgcttgtgatgggcaggcagtgatgtgaaagttcttacattacacaccactctgactgttaatgcatgtgctcagacactggtaggctgctgtctggggctttgttgaatctgccatccacactggattcaccttctgccattccaatgtgatccatccctttttctgtgatatcctcccaaccctggatctttcccactctgacatctacctaaatgagattgtgctctttatcttagcagctttcaatgtctgttttgctcttatagttatcttgacctcctatctgttcatcttcattgccatcctgaggatgcgctcagctgagggaaggaagaaagccttctccacctgtgcctcacacctcactgctgtaaccatcttctatggaactgtcatgttcatgtacttacaacctagttctagtcattctatggacaatgaccaaatggcatctgtgttctataccataatagtccccatgttgaaccctattgtctacagtctaaggaataaagaggtgaataatgcttttaggaaagtcaccaagaagctaaagattctgtttggccca

SEQ ID NO: 450 - protein, 87 aa, Canis familiaris
MRSAEGRKKAFSTCASHLTAVTIFYGTVMFMYLQPSSSHSMDNDQMASVFYTIIVPMLNPIVYSLRNKEVNNAFRKVTKKLKILFGP

SEQ ID NO: 451 - DNA, 945 bp, Canis familiaris
atggggaacaacacagaagtgactgaattcatcctgctgggactaactaatgccccggagctccagatccccctctttatcatgttcaccctcatttacctcatcactctggctgggaacctgggcatggtggtgctgattctcttggactcccgtctccacactcccatgtactttttccttagtaacctgtctctggttgactttggttactctacagctgtcactcccaaagtcatggctggattacttataagggatcaggtcatctcctacaatgcatgtgctgctcaaatgttcttttttgtagccttagccactgtggaaaatttcctattggcctcaatggcttatgaccgctacacagcagtgtgcaaacccctccattacaccactaccatgacaacaagtgtatgcgctcatttggccataggctcctacctctgtggttttctgaatgcctccattcacattcatgacacattcagtctctctttttgcatgtccaatctagtccatcactttttctgtgatgtgccagtagtcatggctctctcttgctctgatagatatgtcagtgagctggttcttgttgttgtagcaagcttcaacatcttttttgctctcctcattatcttgatttcctatctgttcatatttatcaccatcctgaagatgcacacagctgacggatatcagaaggctctatccacctgcgcttcccacctcactgcagtgtccatcttctatgggacagtcatcttcatgtacttacagcccaactccagccattccatggacacagacaaaatcgtatctgtgttctattctatggtcatccccatgctgaatcccctagtctatagcttgagaaacaaggaggttaaaaatgcattcaagaaggtggttgagaaggcgaaattgtctgcaggctttacctcttaa

SEQ ID NO: 452 - protein, 314 aa, Canis familiaris
MGNNTEVTEFILLGLTNAPELQIPLFIMFTLIYLITLAGNLGMVVLILLDSRLHTPMYFFLSNLSLVDFGYSTAVTPKVMAGLLIRDQVISYNACAAQMFFFVALATVENFLLASMAYDRYTAVCKPLHYTTTMTTSVCAHLAIGSYLCGFLNASIHIHDTFSLSFCMSNLVHHFFCDVPVVMALSCSDRYVSELVLVVVASFNIFFALLIILISYLFIFITILKMHTADGYQKALSTCASHLTAVSIFYGTVIFMYLQPNSSHSMDTDKIVSVFYSMVIPMLNPLVYSLRNKEVKNAFKKVVEKAKLSAGFTS

SEQ ID NO: 453 - DNA, 939 bp, Canis familiaris
atggagaataatacagaagtgatggatttcatcctggtgggtctgactggtaccccagaacttcagatttcactttttactgtgttcacccttgtttacctcatcagtgttttaggaacctggggaaacctggggatgaccatcctgatccttctggactcccgtctccacactcccatgtactttttcctcagtaacctgtctctggtggactttggttactctacagctgtcactcccaaggtcatggctgggttacttagaggagaccaggtcatctcctgcagtgcatgtgctgctcaaaagttctcttttgcagcctttgcaacagtggaaagttacctcttatcttcaatggcttatgaccgctacacagcagtgtgcaaacccctccattacaccaccaccatgacgacaggtgtgtgtgctcgtttggccataggctgctacacctgtggttttctgaatgcttccattcatgttggaaacacattcagtctttctttctgtaattccaacctggtccatcactttttctgtgatattccagcagtcatggctctctcttgctctgataaatacattagtgaggtggctcttgtgtatgtgtcaagttttaatgtcttttttgctcttctggttataatcatatcttacctattcatatttataaccatattaaggatgcaatcacctcaagagctccaaaaggctttgtccacctgtgcttctcacctcactgcagtctccatattctatgggacaattatcttcatgtacttacagcccagctccagccattccatggacacagacaaaatagcatccgtgttctacaccatggccatctccatgctgaaccctgtggtctacggcctgagaaataaagaggtcaagagtgctttcaagaaattttcagagaaggcaaaatcatctcta

SEQ ID NO: 454 - protein, 313 aa, Canis familiaris
MENNTEVMDFILVGLTGTPELQISLFTVFTLVYLISVLGTWGNLGMTILILLDSRLHTPMYFFLSNLSLVDFGYSTAVTPKVMAGLLRGDQVISCSACAAQKFSFAAFATVESYLLSSMAYDRYTAVCKPLHYTTTMTTGVCARLAIGCYTCGFLNASIHVGNTFSLSFCNSNLVHHFFCDIPAVMALSCSDKYISEVALVYVSSFNVFFALLVIIISYLFIFITILRMQSPQELQKALSTCASHLTAVSIFYGTIIFMYLQPSSSHSMDTDKIASVFYTMAISMLNPVVYGLRNKEVKSAFKKFSEKAKSSL

SEQ ID NO: 455 - DNA, 945 bp, Canis familiaris
atggataataggacagaagggacacagttcatcctgctgggactaaccaatgccccagagctccagatccccctttttatcatgttcactctcatttacctcatcactctggctgggaacctgggcatgatgatgctgattctcttggactcccgtctccacactcccatgtacttttttctcagtaacctgtctctggtggactttggttactctacagctgtcactcccaaggtcatggctgggttacttaggggagaccaggtcatctcctacaatgcatgtgctgctcagatgttcttttttgtagcctttgccactgtggaaaattatctcttggcctcaatggcctatgaccgctacgcggccgtgtgcaaacccctccattacaccaccaccatgacgacaggggtgtgtgctcgtctggccataggctcctacatctgtggtttcctgaatgcttccttccatgttggggacatatttagtctgtctttatgtaattccaatccagtccatcactttttctgtgatgttccagcggtcatggctctctcttgttctgataaacacattagtgaggtgtttcttgtttttatgtcaagttttaatgccctttttgctcttctggttatattgatttcctaccttttcatatttataaccatcttgaaggtgcagtcagctcaagggcatcaaaaagctttatccacctgtgcttcccacctcactacagtgtccatcttctatgggacagtcatcttcatgtacttacagcccagctccagccattccatggacacagacaaaatcgcatctgtgttctattctatggtcatccccatgctgaatcccctggtctatagcctgaggaacaaagaggtcaagtgtgcattcaagaaggtggtggaaaaggcaattttttcaataggattggcaatctaa

SEQ ID NO: 456 - protein, 314 aa, Canis familiaris
MDNRTEGTQFILLGLTNAPELQIPLFIMFTLIYLITLAGNLGMMMLILLDSRLHTPMYFFLSNLSLVDFGYSTAVTPKVMAGLLRGDQVISYNACAAQMFFFVAFATVENYLLASMAYDRYAAVCKPLHYTTTMTTGVCARLAIGSYICGFLNASFHVGDIFSLSLCNSNPVHHFFCDVPAVMALSCSDKHISEVFLVFMSSFNALFALLVILISYLFIFITILKVQSAQGHQKALSTCASHLTTVSIFYGTVIFMYLQPSSSHSMDTDKIASVFYSMVIPMLNPLVYSLRNKEVKCAFKKVVEKAIFSIGLAI

SEQ ID NO: 457 - DNA, 498 bp, Canis familiaris
ttgggaatgatggtgctgattctcttggactcccgtctccatgctgtcatgtactttttcctcagtaacctgtctctggtggactttggttactctacagctgtcactcccaaggtcatggctggattacttaaaggagacaaggtcatctcctacaattcatgtcctgctcagatgttcttttttgtagcccttgtcactgtggaattggtctatgactgccacacagctgtgtgtaaactcctacattacaccaccataatgactgccagtgtgtgtgcacatgttgccatacattcctacttttttggtttcctaaatgcccccattcacattcaggacatggtcagtctccttttctgcatgtccaatctagtccaccactttttctgtgatgttccagcagtcacagctctcccttattctgatagacatgtcagtgagctggtttttgttgttgtcactagtttcaatattatttttgctctcctcattatg

SEQ ID NO: 458 - protein, 166 aa, Canis familiaris
LGMMVLILLDSRLHAVMYFFLSNLSLVDFGYSTAVTPKVMAGLLKGDKVISYNSCPAQMFFFVALVTVELVYDCHTAVCKLLHYTTIMTASVCAHVAIHSYFFGFLNAPIHIQDMVSLLFCMSNLVHHFFCDVPAVTALPYSDRHVSELVFVVVTSFNIIFALLIM

SEQ ID NO: 459 - DNA, 939 bp, Canis familiaris
atgggtaacaggacagaagtgacacagttcatcctgctgggactaaccaatgacccagaactgcaggttcctctcttcataatgttcaccttcatctacctcatcactctggttgggaatttggggattaccgtgctgattctcttggactcccgtctccacactcccatgtactttttcctcagtaacctgtctctggcagactttggttactctacagctgtcacacccacagtcatggctgggttacttctaggagaccaggtcatctcctacagtgcatgtgctgctcagatgttcgtttttgctgtctttgccactgtggaaaattatctcttggcctcaatggcctatgaccgctacgcagcagtgtgcaaacccctccattacaccaccactatgacgacaggtgtgtgtgctcgtctggccataggctgctatatctttggtttcctgaatgcttctatttacattggagacacatttagtctctctttctgtatgaacaatgaagtccatcactttttctgtgatatcccagcagtcatggttctttcttgctctgatagatatgtcaatgagctgattcttatttatgtagtgagcttcaacatcttttttgctctcctggttatcttaatttcctacatattcatatttatcaccatcctgaatatgcactcatctggtggatatcagaaggctattgccacctgtgcttcccacctcactgcagtgtccatcttctatgggacagtcatcttcatgtatacacagcccagctccagccattccatggacacagacaaaatggcatccgtgttctacactatggttatccccatgctgaaccctatggtctacagcatgaggaacaaggaggtcaagaatgctttcaagaagattgttttagagtcaaaattgtctttaggattgtga

SEQ ID NO: 460 - protein, 312 aa, Canis familiaris
MGNRTEVTQFILLGLTNDPELQVPLFIMFTFIYLITLVGNLGITVLILLDSRLHTPMYFFLSNLSLADFGYSTAVTPTVMAGLLLGDQVISYSACAAQMFVFAVFATVENYLLASMAYDRYAAVCKPLHYTTTMTTGVCARLAIGCYIFGFLNASIYIGDTFSLSFCMNNEVHHFFCDIPAVMVLSCSDRYVNELILIYVVSFNIFFALLVILISYIFIFITILNMHSSGGYQKAIATCASHLTAVSIFYGTVIFMYTQPSSSHSMDTDKMASVFYTMVIPMLNPMVYSMRNKEVKNAFKKIVLESKLSLGL

SEQ ID NO: 461 - DNA, 948 bp, Canis familiaris
atggagaacaatacagaggtgtctgatttcatcctgttgggactaaccaatgccccagagctgcagattcctctttttgtaatattcatcctcatttacctcatcactctgcttgggaacctggggatgatcacactgatcttgctggactctcgtctccatactcctatgtactttttcctcagtaatctgtctctggtagacttttgttactcctcaacagtcactcccaaggtcatggctgggctccttataggagacaaggtcatttcctacaatgcatgtgctgcccagatgttcttttttgcagtctttgctactgtggaaaattacctcttagcatcaatggcctatgactgctatatagcagtgtgtaaacccctccattatgccaccaccatgacgacaggtgtgtgtgctcatctcaccatagtctcctatgcctgtggcatcttaaatgcatctgtaaatgttgtagataccttcagtctctctttctgtatgtccagtgttgttcatcattttttctgtgatattccagcagtcatggctctgtcgtgctctgataaacacttcagtgagctgattctcatttttatctcaagctttaatgtgttttttgcactttttgttatctttatttcctatctgttcatatttattaccattttgaagataaagtcaggtgagggataccagaaggctttgtctacctgtgcttctcaccttgttacagtttccttattttatgggacagtcatcatcatgtacttacagccaagttctcatcattccatggacacagacaaaatcgcatctgtgttctatactatggtcatccccatgctgaaccctgtggtctacagcttgaggaacaaagaggtcaagaatgcattcaagaaggttgctgagaaggcaaaatattctctaggtgtggtctataaatga

SEQ ID NO: 462 - protein, 315 aa, Canis familiaris
MENNTEVSDFILLGLTNAPELQIPLFVIFILIYLITLLGNLGMITLILLDSRLHTPMYFFLSNLSLVDFCYSSTVTPKVMAGLLIGDKVISYNACAAQMFFFAVFATVENYLLASMAYDCYIAVCKPLHYATTMTTGVCAHLTIVSYACGILNASVNVVDTFSLSFCMSSVVHHFFCDIPAVMALSCSDKHFSELILIFISSFNVFFALFVIFISYLFIFITILKIKSGEGYQKALSTCASHLVTVSLFYGTVIIMYLQPSSHHSMDTDKIASVFYTMVIPMLNPVVYSLRNKEVKNAFKKVAEKAKYSLGVVYK

SEQ ID NO: 463 - DNA, 945 bp, Canis familiaris
atgaagaacaacacaaaagtgactgagttcatcctactgggactaaccaatgccccagagctacagatccccctctttatcatgttcaccctcatttacctcatcactctggctgggaacctgggcatgatgatgttgattctcttggactcccatctccacactcccatgtacttttttctcagtaacctctctctggtggactttggttactctacagctgtcactcccaaggtcatggctgggttacttagaggagaccaggtcatctcctacaatgcatgtgctgctcagatgttcttttttgtagcctttgccactgtggaaaattatctcttgacctcaatggcctatgaccgctatgtggctgtgtgcaaacccctccattacgccaccaccatgacaacaggggtgtgtgcttggctatccataggctgctacttctgtggatttctaaacacctcaatccatacttggaacatttttaggctctccttctgtaattccaatgtgatccatcactttttctgtgatgtaccggcagtcatgactctctcttgctctaatagacatgtcagtgagctggttcttgtctttgtagcagtcttcaacatattttttgctctcctcattatcttgatttcctacttattcatttttatcactatcctgaagatgccctcagtggagggatacctgaaggccatatccacctgcgtctcccacctcactgcagtgtccatcttctatgggtcattcatcttcatgtacatacagcccacctccagctactctatggacacagacaaaatcgcatctgtgttctattctatgatcatccccatgctgaatcccctggtctatagcctgaggaacaaagacgtcaagaatgctttcaataaagttgttgagaaggttaaactgcctttaagcttcacctcttag

SEQ ID NO: 464 - protein, 314 aa, Canis familiaris
MKNNTKVTEFILLGLTNAPELQIPLFIMFTLIYLITLAGNLGMMMLILLDSHLHTPMYFFLSNLSLVDFGYSTAVTPKVMAGLLRGDQVISYNACAAQMFFFVAFATVENYLLTSMAYDRYVAVCKPLHYATTMTTGVCAWLSIGCYFCGFLNTSIHTWNIFRLSFCNSNVIHHFFCDVPAVMTLSCSNRHVSELVLVFVAVFNIFFALLIILISYLFIFITILKMPSVEGYLKAISTCVSHLTAVSIFYGSFIFMYIQPTSSYSMDTDKIASVFYSMIIPMLNPLVYSLRNKDVKNAFNKVVEKVKLPLSFTS

SEQ ID NO: 465 - DNA, 945 bp, Canis familiaris
atggagaacaacacaaaagtgactgagttcatcctagtgggactaaccaataccccagagctgcagatccccctctttatcatgttcaccctcatttacctcttcactctggctgggaacctgggcatggtggtgctgattctcttggactcctgtctccacactcccatgtacttttttctcagcaacctgtctctggtggactttggttactctacagctgtcactcccaaggtcatggctgggttacttagaggagaccaggtcatctcctacaatgcatgtgctgctcagatgttcttttttgcagcctttgcaacagtggaaagttacctcttagcttcaatggcctatgaccggtatgtggccgtgtgcaaacccctccattacaccaccaccatgacgacaggtgtgtgtgctcgtctggccataggctcctatatgtctggttttctgaatgcttctgtagatgttggagatacattccatctctccttctgtaattccaatgtgatccatcactttttctgtgatattcctgcagtcatggctctctcttgctctaatagacatgtcagtgagctggttcttgtctttgtagcaagcttccacatctttcttgctctcctcattatcttgatttcctacttgttcatttttatcaccatcctgaaaataccctcagtggagggatacctgaaggccgtatccacctgcgcctcccacctcactgcagtatccatcttctatgggacagtcatcttcatgtactcccagcccacctccaaccactctatggacacagacaaaatcatatctgtgttctatactgtaatcatccccatgctaaatcccatggtgtatagcctgaggaacaaagaggtaaagaatgctttcaagaaggttgttgagaaggtaaaactgtctctaagcttcacctcttag

SEQ ID NO: 466 - protein, 314 aa, Canis familiaris
MENNTKVTEFILVGLTNTPELQIPLFIMFTLIYLFTLAGNLGMVVLILLDSCLHTPMYFFLSNLSLVDFGYSTAVTPKVMAGLLRGDQVISYNACAAQMFFFAAFATVESYLLASMAYDRYVAVCKPLHYTTTMTTGVCARLAIGSYMSGFLNASVDVGDTFHLSFCNSNVIHHFFCDIPAVMALSCSNRHVSELVLVFVASFHIFLALLIILISYLFIFITILKIPSVEGYLKAVSTCASHLTAVSIFYGTVIFMYSQPTSNHSMDTDKIISVFYTVIIPMLNPMVYSLRNKEVKNAFKKVVEKVKLSLSFTS

SEQ ID NO: 467 - DNA, 930 bp, Canis familiaris
atggaagaaatgaataaaactgcaaagatacagttcttctttcacccattctcagctgaccccaagatccaggtggggatttttgtggccttcctggtgatgtacctgaccagcctcggtggaaacaccacaattgcagtccttgtccagatcaacccctccctccacatccccatgtacttcttcctggctaacctggcagtcctggaaatcttctatacctctgccattgccccactggctttggcaaacctcctttcaatgggcaaaactcctgtttctatccccggatgtggggcccagatgttcttcttcatcttcttgggtggagctgactgtgtcctgctggccgtcatggcttacgaccggtttgtggcaatctgttaccctctgagatacacccgcatcatgagctggcccttgtgtgtggagctgatggtcgggtccctggtgctggggttcctgctgtcgctgccgctgactattttaatcttccatctcccattctgtggccacaacgagatccaccacttctactgtgacatgcctgcagtcatgcgcctggcctgcgcagacacacacactcaccagactgccctgtacatcatcagcttcatcgtcctgagcgtccccctgtccttaatctccacctcctacatcttcatcatggcagccattttacggatccggtcagcagaagggcgccaccgagccttctctacctgttcctcccacatcttagtggtcctcctgcagtatggctgcaccagctttatctacttgtccccccggtccagctactctcctgagatgggccgagtggtgtctgtggtctacactttcatcactcccattttaaaccccttgatctacagtatgaggaacagggaactgaaagatgccctaaggagggcactgaggaagttctag

SEQ ID NO: 468 - protein, 309 aa, Canis familiaris
MEEMNKTAKIQFFFHPFSADPKIQVGIFVAFLVMYLTSLGGNTTIAVLVQINPSLHIPMYFFLANLAVLEIFYTSAIAPLALANLLSMGKTPVSIPGCGAQMFFFIFLGGADCVLLAVMAYDRFVAICYPLRYTRIMSWPLCVELMVGSLVLGFLLSLPLTILIFHLPFCGHNEIHHFYCDMPAVMRLACADTHTHQTALYIISFIVLSVPLSLISTSYIFIMAAILRIRSAEGRHRAFSTCSSHILVVLLQYGCTSFIYLSPRSSYSPEMGRVVSVVYTFITPILNPLIYSMRNRELKDALRRALRKF

SEQ ID NO: 469 - DNA, 954 bp, Canis familiaris
atgactttgatggagaacgtttcagaggtgactgaattcattcttgtggggttaacagatgccctggagatgcaggtccctttatttacagtcttcactatcatttacttcatcattctggttgggaatgctgggatgatcgtgttgattctgctggattctcgtctccacactcccatgtacttcttcctcagcaacctctcctttgtagactgtgtttatgcctcagctgtcactcccaaggtaatggtgggatttctcacaaaagataagatcatctcctacaatgcatgtgctgcccagatgttcttcttttcagcctttgccactattgaaagttttcttttggcctcaatggcttttgaccgccacacagcagtgtgtaaacccctgcattacgccaccatcatgacaagtgctatgtatacctcactggccactggttcctacatctctggactcttgcagtcttccatccatgttgccctcacctttcacctctccttctgtcgttccaacataattaatcactttttctgtgacattcccgcactgttggctctctcttgctctgatatctacatgaatgagattgtgctcttcatattggcagcattcaatgtccttttcaccctcttggttatcttgaattcttatctgttcatttttattgctatcctgggaatgcactcagctgagggacagaagaaggctttctccacctgtgcatcccacctgaccactgtctccatcttctatgggacaatcatcttcatgtacttgcagccaacttctagtcattccatggacacagacaaaatggcatccatattctacaccatggtcatccccatgctgaaccctttgatctatagtctaaggaacaaagaggtcaagagtgcatttcagaaagtggttggaaaagcaaagtcttcagtgggtttagcctactaa

SEQ ID NO: 470 - protein, 317 aa, Canis familiaris
MTLMENVSEVTEFILVGLTDALEMQVPLFTVFTIIYFIILVGNAGMIVLILLDSRLHTPMYFFLSNLSFVDCVYASAVTPKVMVGFLTKDKIISYNACAAQMFFFSAFATIESFLLASMAFDRHTAVCKPLHYATIMTSAMYTSLATGSYISGLLQSSIHVALTFHLSFCRSNIINHFFCDIPALLALSCSDIYMNEIVLFILAAFNVLFTLLVILNSYLFIFIAILGMHSAEGQKKAFSTCASHLTTVSIFYGTIIFMYLQPTSSHSMDTDKMASIFYTMVIPMLNPLIYSLRNKEVKSAFQKVVGKAKSSVGLAY

SEQ ID NO: 471 - DNA, 960 bp, Canis familiaris
atgttcgctaggagccctgtcctcaaccaatccggccccactgagttcttcttccgcgtgttgaccaccgtcccagaattccaggccctgctcttcctcctcttcctcctcctctacttgatgatcctctgtggcaacacagccatcatctgggtggtgtgcacgcacagctccctccgcacccccatgtacttcttcctctgcaacctggcctttgtagagatcagctacaccacggtggtggtgcctctgatgctttccaacatttggggagccccgaagcccatccccctggctggctgtggggcccagatgttcttttttctcactcttggtggtgctgactgctttctcttggcaatcatggcctacgatcgctatgtggccatctgccacccgctgcactacaccctcatcatgacccagaagctgtgcgcccagatggtggcgtgcgcggtgggcctggccctggtcctctccctgcagctcacgtccttaatcttcaccctgcccttctgcgggcaccgccaggagatcaaccacttcctgtgcgatgtgcccccggtcctgcggctggcctgcgccgacatccgcgtgcaccaggccgtcctctacgtggtgggcatcctcgtgctgaccgtccccttcctgctcatctgtgtgtcctatgtgttcatcgcctcggccatcctgcgcatccgctccgccgagggccgccgccgggccttctccacctgctcctcgcacctcaccgtggtcctgctgcagtacggcttctgtgccgtggtctacctgcggccccagtccacctcctcggtggacgaggaccgccagtttgccctggtctacacctttgtcacccccctcctcaacccgctgatttacaccctcagaaacaaagatgtcaaaggtgctttgaaaaaggccatcagtagcaaagcagcatctgaagctctctga

SEQ ID NO: 472 - protein, 319 aa, Canis familiaris
MFARSPVLNQSGPTEFFFRVLTTVPEFQALLFLLFLLLYLMILCGNTAIIWVVCTHSSLRTPMYFFLCNLAFVEISYTTVVVPLMLSNIWGAPKPIPLAGCGAQMFFFLTLGGADCFLLAIMAYDRYVAICHPLHYTLIMTQKLCAQMVACAVGLALVLSLQLTSLIFTLPFCGHRQEINHFLCDVPPVLRLACADIRVHQAVLYVVGILVLTVPFLLICVSYVFIASAILRIRSAEGRRRAFSTCSSHLTVVLLQYGFCAVVYLRPQSTSSVDEDRQFALVYTFVTPLLNPLIYTLRNKDVKGALKKAISSKAASEAL

SEQ ID NO: 473 - DNA, 945 bp, Canis familiaris
atgacctggggaaatcgctcactgttgatggaatttgggttcctggcctatccctcccacccagagctccgtgtcttgtccttccttggagtcagcctaatttataccttgatcatcagtgggaatgttctaattgtagtggccatccagacagaagcccgcctacacacacccatgtactatttcttgggaagcctctcgggaatagaaatatgctacactgctgtggtggtgccccacatcttggccaacatcctacggccagagaagaccatcaccctcctgggctgtgccactcagatgatcttcttcatcgggctcggcagtgccgattgcttcctcttggctgccatggcctatgaccggtatgttgctatttgccaccctttgcagtaccctctcaccatgactttaactctctgtgtccgcttggtcatggcctctgtggtgattggcttgttcctgtccacacaactggtggccttcatcttctctctgccattctgccgggctcggagtatcgagcatttcttttgtgatgtcccaccagtgatgcgtcttgtttgtgccaatagccatgtccatgagcagtcagtgctggtggcagccacactggccattgccatgcctttcttcctcattgccacttcctacaccttcattgtggctgctgtgctcaagattcactcaacagctgggcgtcaccgggccttctccacctgctcttcccacctctctgtggtcctgctgcagtatggctgttgcgccttcatgtacctgcgccccaactccagctactatcccaagcaagatcagttcatctcactggtatacacattgggaaccccactgctcaacccacttatctacaccctgaggaacagtgaaatgaaggggaccttggggagagttcttaccaggaattgcctctcccagaacaactag

SEQ ID NO: 474 - protein, 314 aa, Canis familiaris
MTWGNRSLLMEFGFLAYPSHPELRVLSFLGVSLIYTLIISGNVLIVVAIQTEARLHTPMYYFLGSLSGIEICYTAVVVPHILANILRPEKTITLLGCATQMIFFIGLGSADCFLLAAMAYDRYVAICHPLQYPLTMTLTLCVRLVMASVVIGLFLSTQLVAFIFSLPFCRARSIEHFFCDVPPVMRLVCANSHVHEQSVLVAATLAIAMPFFLIATSYTFIVAAVLKIHSTAGRHRAFSTCSSHLSVVLLQYGCCAFMYLRPNSSYYPKQDQFISLVYTLGTPLLNPLIYTLRNSEMKGTLGRVLTRNCLSQNN

SEQ ID NO: 475 - DNA, 960 bp, Canis familiaris
atgttcgctaggagccctgtcctcaaccaatccggcccccctgagttcttcttccgcgtgttgaccaccgtcccagaattccaggccctgctcttcctcctcttcctcctcctctacttgatgatcctctgtggcaacacagccatcatctgggtggtgtgcacgcacagctccctccgcacccccatgtacttcttcctctgcaacctggccttcctggaaatctgctacaccacggtggtggtgcctctgatgctttccaacatttggggagccccgaagcccatccccctggctggctgtggggcccagatgttcttttttgtcaccctcggcagcactgactgctttctcttggcaatcatggcctacgatcgctatgtggccatctgccacccgctgcactacaccctcatcatgacccagaagctgtgcgcccagatggtggcgtgcgcggtgggcctggccctggtcctctccctgcagctcacgtccttaatcttcaccctgcccttctgcgggcaccgccgggagatcaaccacttcctgtgcgatgtgcccccggtcctgcggctggcctgcgccgacatccgcgtgcaccaggcggtcctctacgtggtgggcatcctcgtgctgaccgtccccttcctgctcatctgtgtgtcctatgtgttcatcgcctcggccatcctgcgcatccgctccgccgagggccgccgccgggccttctccacctgctcctcgcacctcaccgtggtcctgctgcagtacggctgttgcagcctcgtctacctgcggccccgctccagctcctcggtggacgaggaccgccagatcgccctggtctacaccttcgtcacccccctcctcaacccgctgatttacaccctcaggaacaaggatgtcaaaggtgccctgaggaatgccgtcctccataaagcagcctctggtgccagttga

SEQ ID NO: 476 - protein, 319 aa, Canis familiaris
MFARSPVLNQSGPPEFFFRVLTTVPEFQALLFLLFLLLYLMILCGNTAIIWVVCTHSSLRTPMYFFLCNLAFLEICYTTVVVPLMLSNIWGAPKPIPLAGCGAQMFFFVTLGSTDCFLLAIMAYDRYVAICHPLHYTLIMTQKLCAQMVACAVGLALVLSLQLTSLIFTLPFCGHRREINHFLCDVPPVLRLACADIRVHQAVLYVVGILVLTVPFLLICVSYVFIASAILRIRSAEGRRRAFSTCSSHLTVVLLQYGCCSLVYLRPRSSSSVDEDRQIALVYTFVTPLLNPLIYTLRNKDVKGALRNAVLHKAASGAS

SEQ ID NO: 477 - DNA, 924 bp, Canis familiaris
atgcatcaaggaaatcgaaccaccatctctgggttcctccttctgggactctccagccaggctgagcaccaaaagcttctctttgtgcttttcctaggtatgtacctggtcactgtggtcgggaatgggctcatcattctggccattggcttggattcttaccttcacactcccatgtatcttttccttgccaatctgtcctttgctgatatttcctccatatccacctcagtcccctagatgctgatgaatattcagaccaaaactcaatctatctcctatgaaagttgcatcacacagatgtacttttctattgtgtttgttgttaatgacaatttcctctgaggagtcatggcctatgaccgctttgtggctatctgccaccctctgaactatgtgaccctcatgcaacccagaatctgcgttttgctcacagtcattccgtgggtcctcagtaacgtggtcgccctaacacacacccttctgctcattccattgctcttctgtgacagcaacattctcccacacttcttctgtgacttggctcctctgctcaaactgtcctgctcagacacaagtatcaatgaactcatgttgtttatcgtgggctcatcagttgtcaccttcccctttgccttaattctcttctcctacatctgcattgtcaaggctatcctgagaatctcatccatggagggaaaacggaaagccttcaccacctgtggctctcatttgactgttgtattactcttctatgggaccattataggggtttacttcttcccctcatccactcaccctgatgacagagataagattggtgcagtgctcttcactgtggtgacacccatgataaaccccttcatctatagcctgaggaacaaggacatgaaagttgccctaagaaagctcattaatagaaaa

SEQ ID NO: 478 - protein, 191 aa, Canis familiaris
MAYDRFVAICHPLNYVTLMQPRICVLLTVIPWVLSNVVALTHTLLLIPLLFCDSNILPHFFCDLAPLLKLSCSDTSINELMLFIVGSSVVTFPFALILFSYICIVKAILRISSMEGKRKAFTTCGSHLTVVLLFYGTIIGVYFFPSSTHPDDRDKIGAVLFTVVTPMINPFIYSLRNKDMKVALRKLINRK

SEQ ID NO: 479 - DNA, 945 bp, Canis familiaris
atggccaggaggaaccacaccatcgtgaccgagttcttcctcactgcattcagcgagcatcctgagtgggggcttcctctcttcctgctgtttttgggtttttatgtcatcaccttgttggggaacgcggggatggtccttctgatccgagtggatggccggctgcacaccccgatgtacttcctcctcggccacctgtccttcgtggacatctgctactcgtccaccatcgtgccgcagatgctggcggtgctgctgcagcggggggcagcgctgtcctacacctgctgcgccgctcagttcttcctcttcaccttctttgcttccatcgactgctacctgctggctctcatggcctatgaccgctacgtggccgtgtgccggcccctgctgtatgtcaccatcatgaccgagaaggcgcgctggggcttcgtggctggggcttatggggctggtttctccagcgcctttgttcgaacaatcacagccttctccctctccttctgcggggacaacgagattgactttattttctgtgaccttccccctctgttaaagctgacctgtggggacagctacacccaggaggtggtcattgttgtgtttgccatctttgtcatgcctatttgtgtggtggcgatcttggtgtcctacctgtttattgttgtggccatcatgaggatcccctctgcggggggccgggccaagaccttctctacctgcgcctctcacctcacggctgtgtccctcttcttcggcaccctcatcttcatgtacctgcgaggtaacgaggaccagccctccgagggagaccgagtggtgtcagtgctctacacagtggtgacccctctgctgaaccccttcatctatagtctgaggaataaggaagtgaaggaggcgtttaggaaagctctgaacaggccaaaggcttctggaaggacctag

SEQ ID NO: 480 - protein, 314 aa, Canis familiaris
MARRNHTIVTEFFLTAFSEHPEWGLPLFLLFLGFYVITLLGNAGMVLLIRVDGRLHTPMYFLLGHLSFVDICYSSTIVPQMLAVLLQRGAALSYTCCAAQFFLFTFFASIDCYLLALMAYDRYVAVCRPLLYVTIMTEKARWGFVAGAYGAGFSSAFVRTITAFSLSFCGDNEIDFIFCDLPPLLKLTCGDSYTQEVVIVVFAIFVMPICVVAILVSYLFIVVAIMRIPSAGGRAKTFSTCASHLTAVSLFFGTLIFMYLRGNEDQPSEGDRVVSVLYTVVTPLLNPFIYSLRNKEVKEAFRKALNRPKASGRT

SEQ ID NO: 481 - DNA, 936 bp, Canis familiaris
atggcagagaagaatgtcaccttggtgagcgaattcctccttattgcatttaccgactgtcctgagtggggacttcctctcttcctcctgtttctatccatttatgtcatcagcctgctggggaacgcggggatggtccttctgatccgagtggatggccggctgcacaccccgatgtacttcctcctcggccacctgtccttcgtggacatctgctactcgtccaccattgtgccgcagatgctggcggtgctgctgcagcggggggcagcgttgtcctacacctgctgcgctgctcagttcttcctcttcaccttctttggctccattgactgctacctgctggccctcatggcctatgaccgctacgtggccgtgtgccggcccctgctgtatgtcaccatcatgaccgagaaggcgcgctgggggttcgtggctggggcttatggggctggtttctccagtgcctttgttcgaacaatcacagccttctccctctccttctgcggggacaacgagattgactttattttctgtgaccttcctcctctgttaaagctgacctgtggggacagctatacccaggaggtggtcattgttgtgtttgccatctttgtcatccctgcctgcatggtggcgatcttggtgtcctacctgtttattgttgtggccatcatgaggatcccctcagctggaggccgggccaagaccttctctacctgcgcctctcacctcacgactgtgtccctcttcttcggcaccctcatcttcatgtacctcagagataactctggccactcttcacaggaggatcgggtggtgtctgtgttctacacaacagtgatccccatgttgaaccccctcatttatagcatgaggaataaggaagtgaaggaggccctgaggaaagttctcaaaagagctgagttgtactga

SEQ ID NO: 482 - protein, 311 aa, Canis familiaris
MAEKNVTLVSEFLLIAFTDCPEWGLPLFLLFLSIYVISLLGNAGMVLLIRVDGRLHTPMYFLLGHLSFVDICYSSTIVPQMLAVLLQRGAALSYTCCAAQFFLFTFFGSIDCYLLALMAYDRYVAVCRPLLYVTIMTEKARWGFVAGAYGAGFSSAFVRTITAFSLSFCGDNEIDFIFCDLPPLLKLTCGDSYTQEVVIVVFAIFVIPACMVAILVSYLFIVVAIMRIPSAGGRAKTFSTCASHLTTVSLFFGTLIFMYLRDNSGHSSQEDRVVSVFYTTVIPMLNPLIYSMRNKEVKEALRKVLKRAELY

SEQ ID NO: 483 - DNA, 942 bp, Canis familiaris
atggagaagaatggcaccatggtgacggaattcattctgctggggttccagctgccggcagagctgcagatgggtctcttccttgtgtttctggtcctttatttcattaccttggtgggcaacctgggcatgatcgtgttgattcagagagaccctcgtctccaaacccccatgtacttcttcctctgccatctttccttcttggatatttgctattcctctgtcattgtccctcagtttcttgaaaccttgggtaccgataagatggccatcacctatgagtgctgtgccactcagttcttcttctttaccctctgtgctagcactgaatgtttccttttggctgtgatggcctatgaccgctatgtggcggtgtgtaaccccctcctctatgccactgccatgacaccacagacttgcctggggctggtgactggggcatatgctggtgccatggtcaatgctgtgatccgcactgggtgtaccttctctatctctttctgtaagtccaaccacgtggacttcttcttttgtgacctcccacccctgctgaagcttgcctgtagtgacaccaagttacgggaacgggtcatttacctcttagctttcttggtcattacaaccagtatttcagtgattcttatatcctactttttcatcattcaggctattctgaagattcgtacagcaggtggcaaagccaagactttctccacctgtgcttctcacatgaccgcagtagctcttttctttgggacactcatattcatatacctgaaaggtaacatgggaaagtcccttggggaggacaagattgtgtcagtattttacactgtggtcatccctatgttgaacccaatgatctatagcttgagaaacaaggaagtgaaggaggctctgaagaaagctttcaatgggatgaaggtttcccaagcagactaa

SEQ ID NO: 484 - protein, 313 aa, Canis familiaris
MEKNGTMVTEFILLGFQLPAELQMGLFLVFLVLYFITLVGNLGMIVLIQRDPRLQTPMYFFLCHLSFLDICYSSVIVPQFLETLGTDKMAITYECCATQFFFFTLCASTECFLLAVMAYDRYVAVCNPLLYATAMTPQTCLGLVTGAYAGAMVNAVIRTGCTFSISFCKSNHVDFFFCDLPPLLKLACSDTKLRERVIYLLAFLVITTSISVILISYFFIIQAILKIRTAGGKAKTFSTCASHMTAVALFFGTLIFIYLKGNMGKSLGEDKIVSVFYTVVIPMLNPMIYSLRNKEVKEALKKAFNGMKVSQAD

SEQ ID NO: 485 - DNA, 945 bp, Canis familiaris
atggccaagaataatctcaccacagtagcagagttcattctcatgggctttacggactaccacatgtgggagattaccctcttcctgatgtttctcattttctatattgtcacccttctggggaacgtgggaatgatcattctgatccaagtggatgtccaactccacacccccatgtacttcttcctgagccatctcgccctgctggatgcctgctatgcctcagtgatcacccctcagatcctggacacactggccacaggcaaaacagtcatctcctttggccagtgtgctacgcagttctttttcttcaccatctgtgcaggcacagagtgtttcctgctggcagtgatggcctatgaccgctgtgtcgctattagcaacccactgctctacacagtggtcatgaatcccagaatctgctggggtttggtggttggagcctacgtctgtggggtgtcaggagccatcctgcgtaccacatgcaccttcaccctctccttctgtgaccacaatcagatcaacttcttcttctgtgatgtcccacccctgttgaagctagcctgcagtgacacaacaaacacggagattgtcattgtcttctttggcaactttgtgatcttggccaatgccttggtcattctgatatcctatctgctcatcatcaaggccattctgaaggtgaagtctccaggtggcaaggtcaagactttctccacatgtgcctcccacctcactgctgtgacccttttctttgggactctcatcttcatgtatctgcggagtagctccaacaagtccctggaggaagacaaggtcgtgtctgtcttctacactgtgttcattcccatgctaaaccctctgatctatagcctaagaaacaaagatgtgaaagcagccttcagaaaggtcactggtagattccaggtgtcccagagtgtgtag

SEQ ID NO: 486 - protein, 314 aa, Canis familiaris
MAKNNLTTVAEFILMGFTDYHMWEITLFLMFLIFYIVTLLGNVGMIILIQVDVQLHTPMYFFLSHLALLDACYASVITPQILDTLATGKTVISFGQCATQFFFFTICAGTECFLLAVMAYDRCVAISNPLLYTVVMNPRICWGLVVGAYVCGVSGAILRTTCTFTLSFCDHNQINFFFCDVPPLLKLACSDTTNTEIVIVFFGNFVILANALVILISYLLIIKAILKVKSPGGKVKTFSTCASHLTAVTLFFGTLIFMYLRSSSNKSLEEDKVVSVFYTVFIPMLNPLIYSLRNKDVKAAFRKVTGRFQVSQSV

SEQ ID NO: 487 - DNA, 900 bp, Canis familiaris
aataatctcactgctgtgatggagttcatccttgtgggcttcacagatcaccctgaactgatgattcccctcttcctgatgtttctcattttctatatcatcacccttctggggaatgtgggaattatcattctgatccaagtggatgtccaactccacacccccccatgtacttcttcctgagccatctcgccctgctggatgcctgctatgcctcagtgatcacccctcagatcctggacagacacactggccacaggcaagatagtcatctcctttggtcaatgtgctatgcggtcttttcttcaccatctttgcaggcacagagtgtttcctgctggcagtgatggtctatgaccactttgttgccatcagcaactcattgcatataacctggccatgactccaggcacctgcaggggatccttggctgcagcctatgtctatggggtatcaggggacatcctgcataccacatgcaccttcaccctctccttctgtgaccacaatcagttcaacttcttctgtgacttcccatccctgctgaagcttgcctggaacagcatgacataaaatgtgattgtcatcctcttttttgccaagttcatgttccttgccaatgtcatgatcatcatggcgtcctatatgctcataatcagagccatcctgagggtgaggtctgctggtgggagagccaagatcatctccacatatgcctcccacctcaccactgttgtcctcttcttcgggacacttgccttcatgtaccagagaagtaactcagaccaattcccagaggagaagattgtgtctgtcttttaccccatggtcatccccctgttgaaccccttgatctacagcctgaggaacaaagatgtaaaagctacattcaggaaagtc

SEQ ID NO: 488 - protein, 98 aa, Canis familiaris
MFLANVMIIMASYMLIIRAILRVRSAGGRAKIISTYASHLTTVVLFFGTLAFMYQRSNSDQFPEEKIVSVFYPMVIPLLNPLIYSLRNKDVKATFRKV

SEQ ID NO: 489 - DNA, 939 bp, Canis familiaris
atgggggatgaaaaccaaaccatagacatccagttccactttcatccattttcacccatcctggagatacaaatacttatttttgtggctttcctgctaatgtatattggcagtctcactggtaatgccacaatctttctcactgtctgggcagagcgttcactccacactcccatgtatttctttctggccaatctggcagttctggagatcttttactcttccactgttgcccctctcgctttggtcaacctcctgaccatggggagaatacccatctctttcgctggctgtggcacacagatgttcttttttgtctttctgggcagtgctgactgtatcctcttggggatcatggcttatgatcggtttgtagctattcggaagcctctgcgttacaccctcatcatgagatggcagctgtgtgcccagctggctctgggagccctggtccttggtttcattctagccttacaactaacagctctgattttccatctgccattttgtggccacaacagaatcactcacttctactgtgatgtactcccgatcttgcagctggcctgtggggatactcgaatgcaagaagccatgatcttcattgtcagtgtcatcatcctcaccattcccttttctctgatctccatctcatacgtcttcattgtgggtgccattctgaagatccgctctgcagaggggcggcacaaggccttctccacctgttcttctcacctgactgtagttctcctccagtatggctgctgtagccttatctatttacgccccagctctagctacaacccagaaatgggccgtgtggtgtctgttgtctacacttttgtcacccctgtcttgaaccccttgatctacagtatgaggaacaaggagctgaaagatgcattaaataaggtaatgaaaagacatctgctccactag

SEQ ID NO: 490 - protein, 312 aa, Canis familiaris
MGDENQTIDIQFHFHPFSPILEIQILIFVAFLLMYIGSLTGNATIFLTVWAERSLHTPMYFFLANLAVLEIFYSSTVAPLALVNLLTMGRIPISFAGCGTQMFFFVFLGSADCILLGIMAYDRFVAIRKPLRYTLIMRWQLCAQLALGALVLGFILALQLTALIFHLPFCGHNRITHFYCDVLPILQLACGDTRMQEAMIFIVSVIILTIPFSLISISYVFIVGAILKIRSAEGRHKAFSTCSSHLTVVLLQYGCCSLIYLRPSSSYNPEMGRVVSVVYTFVTPVLNPLIYSMRNKELKDALNKVMKRHLLH

SEQ ID NO: 491 - DNA, 954 bp, Canis familiaris
atgcagccatatgcccaaaactggacccatgtaacagagtttgtcatggtgggctttgctggggtgcatgaagcacgccttctcttctttacagtctttctcaccatgtacctgttcaccttggtggagaacttggccatcatcttggtggtggctttgaaccatcggctacacagacccatgtatttcttcctgacacacttgtcctgccttgaaatttggtacacttcagtgacggtgcctaagatgctggctggttttattggggtagatgggggcaagaatatctcctacactggctgtctatcccaactcttcatctttaccttcctgggggcaactgagtgttttctactggctgccatggcctatgaccgctatgtggccatttgtatgcctcttcgatatggggccttggtgtcgtggggcacctgcatccgtctggcagctgcttgttggctggtgggcctcctcacacctgttttgcctatctacctcatgtcccagctgacattttgtggtcccaatgtcatcgaccacttcttctgtgatgtctcaccactgctagccttgtcctgctcagatgtcaccctgaaggagaccacagacttcctagtctctctgatggtgctcctggtctcctctacagtcatttctgtgtcctatggcaacatcgtctggacgttgctgcacatccgttcggctgctgagcgcagaaaggctttctccacttgtgcagctcacctgacagtggtgagcctcttctatggcactcttttctttatgtatgtccggaccaaagtggcctcctccatcaacttcaacaaggtagtgtctgtcttctactccattgtcacaccaatgctcaaccccctcatctacagtcttcggaacaaggaggtgaagggagctctgggccgagccttttccctcaggtcttggaaaggtcagtga

SEQ ID NO: 492 - protein, 317 aa, Canis familiaris
MQPYAQNWTHVTEFVMVGFAGVHEARLLFFTVFLTMYLFTLVENLAIILVVALNHRLHRPMYFFLTHLSCLEIWYTSVTVPKMLAGFIGVDGGKNISYTGCLSQLFIFTFLGATECFLLAAMAYDRYVAICMPLRYGALVSWGTCIRLAAACWLVGLLTPVLPIYLMSQLTFCGPNVIDHFFCDVSPLLALSCSDVTLKETTDFLVSLMVLLVSSTVISVSYGNIVWTLLHIRSAAERRKAFSTCAAHLTVVSLFYGTLFFMYVRTKVASSINFNKVVSVFYSIVTPMLNPLIYSLRNKEVKGALGRAFSLRSWKGQ

SEQ ID NO: 493 - DNA, 888 bp, Canis familiaris
atgacgctggggcagaaccacaccacagtgacaagattcatcctgctgggcctcacagaccaggcccccggaagacatctcctcttcggcatcttcctgctaatctatgctgtgaccctggtgggcaacctgggcatgatggacctgatccgtaccagctccaccctccacacccccatgtacttcctcctgagcgtgctctccttcctggatatatgcaattcctctgtgttcacccccaggctgctgatcagcttcctcaccacggaccagtccatctcgtttgcgggctgtgtggtccagatggccttcatgatcctccatggcacaggggagtgcctgctcttggccttcatggcctatgaccgatttgtggccatctgccaccctctcctctaccatacgatcatgtccaagcgcttgtgcatccagctggcggtggtcacctatgcggcaggggtgttcatttcagctctgcagacggggaatgccttcatcttgccctactgtggtcccaacatcattgatcacttcttctgtgacatcccccccgtgctccaactggcctgctcagacaccaccgtagccaatatcatcctgctcttcctttctgccttggttactgtccccacggtgtcagccatcttagtctcttatacctacatcctggtcacaatctgtaggatgaggtccctggaggcccagcgcaaagctttctccacttgtgcctcccacctcattgccctctccctcttctatgggtctgtgttctttgtctatgtccaacccaacccagaaagtgcctcagcctataataagaccctgtctgtgttctacaccattgtgatccccatgctgaaccccctggtctacagcctaaggaaataa

SEQ ID NO: 494 - protein, 295 aa, Canis familiaris
MTLGQNHTTVTRFILLGLTDQAPGRHLLFGIFLLIYAVTLVGNLGMMDLIRTSSTLHTPMYFLLSVLSFLDICNSSVFTPRLLISFLTTDQSISFAGCVVQMAFMILHGTGECLLLAFMAYDRFVAICHPLLYHTIMSKRLCIQLAVVTYAAGVFISALQTGNAFILPYCGPNIIDHFFCDIPPVLQLACSDTTVANIILLFLSALVTVPTVSAILVSYTYILVTICRMRSLEAQRKAFSTCASHLIALSLFYGSVFFVYVQPNPESASAYNKTLSVFYTIVIPMLNPLVYSLRK

SEQ ID NO: 495 - DNA, 960 bp, Canis familiaris
atgacacctggagaactagcccttgcaagtggcaaccacactccagttacccagttcatcttgttgggattctccagctatccagagctccagcagcttctatttgtaacctttctgctcatttatgccatgacagtgatgggcaacctgggaatgatggcactcatcttcacagactcccgtctccatagtcccatgtatttcttcctcagtgtcctctcttttcttgatatttgttactcttctgtggtcacacccaagctcttggtcaacttcctggcctctgacaagaccatttcttttgagggctgtgtggtccagctaaccttttttgtggtgcatgtgacagctgagagcttcctgctggcctccatggcctacgatcgctttgtggccatctgccaacctctccattatggttcgatcatgaccaaggagacctgtctccagctggtagctgcttcctatgcatttggtggcgccaactctgctatccagactgggaacgtctttgctctgcctttctgtgggcccaaccaggtaacacactacttctgtgacatccctccccttctccgcctggcttgtgccaacacagccacagcaggagtggtcctctatatcttctctgctctggttacccttctgcctgctgcagtcatcctcacctcctacagcttggtcttggtggccattgggaggatgcgctcggccgctggacgggagaaggccctctccacctgtgcctcccacttcctggccattgccattttctacggcactgtggttttcacctatgtccagcctcatggatccactaatgataccaatggccaaatagtgtccgtgttctacaccatcataatccccatgctcaaccccttcatctatagcctccgcaacaaagaggtgaaggacgcactacagagaaagctccaggtcagtatctttccctgctga

SEQ ID NO: 496 - protein, 319 aa, Canis familiaris
MTPGELALASGNHTPVTQFILLGFSSYPELQQLLFVTFLLIYAMTVMGNLGMMALIFTDSRLHSPMYFFLSVLSFLDICYSSVVTPKLLVNFLASDKTISFEGCVVQLTFFVVHVTAESFLLASMAYDRFVAICQPLHYGSIMTKETCLQLVAASYAFGGANSAIQTGNVFALPFCGPNQVTHYFCDIPPLLRLACANTATAGVVLYIFSALVTLLPAAVILTSYSLVLVAIGRMRSAAGREKALSTCASHFLAIAIFYGTVVFTYVQPHGSTNDTNGQIVSVFYTIIIPMLNPFIYSLRNKEVKDALQRKLQVSIFPC

SEQ ID NO: 497 - DNA, 936 bp, Canis familiaris
atggaggagggaaattataccagagtgaaagaatttatttttcaaggacttacccagtctcgagagctgagcttggtcttatttctttttttatttttggtgtacacatcaactgtgatgggaaacctcctcatcatggtcactgtgacctgtgagtcccgccttcatacccccatgtacttcctgctccgcaacctctcagtcttggacatctgcttctcctccatcactgctcccaaggtccttgtggaccttctgtcaaggacaaagaccatctccttcaatggttgcatcactcagatgttcttcttccaccttctcggtggggcagacattttttctctctctgtgatggcctttgaccgctacatggccatctccaagcccttgcactacgtgaccatcatgagtagggggcgatgcactgccctcattgtggcctcctgggtggggggctttgttcactccatcgtgcagatttccctgttgctgcccctccccttctgtgggcctaatgttgttgatggcttctactgcgatgtcccccaggtcctcaaacttgcctgcactgacaccttggttcttgaggtcttaatgatttccaataatggcttaatctcgacactatggtttgtcttcctcctcgtgtcctacacagtcattctgacgatgctgaggtctcatgctggggagggcaggaggaaagccatctccacttgcacttcccacatcactgtggtgacccttcactttgtgccctgtatctatgtctatgcccggcccttcactgccctccccatggacagagctgtctccatcaccttcacagtcatcatccctgttctgaaccccatgatctacaccctgaggaaccaggagatgaagtcagccatgaggagacttaagagaagacttggaccttctaaaaaagaatag

SEQ ID NO: 498 - protein, 311 aa, Canis familiaris
MEEGNYTRVKEFIFQGLTQSRELSLVLFLFLFLVYTSTVMGNLLIMVTVTCESRLHTPMYFLLRNLSVLDICFSSITAPKVLVDLLSRTKTISFNGCITQMFFFHLLGGADIFSLSVMAFDRYMAISKPLHYVTIMSRGRCTALIVASWVGGFVHSIVQISLLLPLPFCGPNVVDGFYCDVPQVLKLACTDTLVLEVLMISNNGLISTLWFVFLLVSYTVILTMLRSHAGEGRRKAISTCTSHITVVTLHFVPCIYVYARPFTALPMDRAVSITFTVIIPVLNPMIYTLRNQEMKSAMRRLKRRLGPSKKE

SEQ ID NO: 499 - DNA, 936 bp, Canis familiaris
atggatcagggaaattatacgaaagtgaaagaatttcttttcctgggtattactcagtctcgagagctgagcttggtcttgtttgtcttcttgtttacggtgtatatgacaactctgctgggaaacctcctcatcatggtcactgtgacctttgagtctcaccttcatacccccatgtacttcctgctccgcaacctctctgtcttggacatctgcttctcctccatcactgctcccaaggtcctagttgatcttctatcaaaaagaaaaaccatctccttcaatggctgtgtcactcaaatgtttttcttccaccttctgggaggagcagatgttttttctctctctgtgatggcctttgatcgctacgtggccatctcaagaccccttcactatatgacaatcatgagtaaggaacgatgtactagcctggtgctggcctcctgggtggggggctttgtccactccatcgtgcagatttccctgttgcttccactccccttctgtggacccaatgttcttgacactttctactgcgatgtcccccaggtcctcaagctcgcctgtacagacaccatctctctggagatcctgatgatttctaataatggattagtcagttggcttattttcttctttctcctcatatcttacacggtcattctgatgatgctgaggtctcatgctggggagggaaggaggaaagccatctccacctgcacctcccacatcactgtggtaaccttacactttgtgccctgtatctatgtctatgcccggccctttactgccctccccacagataaagccatctctgtcaccttcacggtcatctcccctttgctcaatcctatgatctacaccctgaggaaccaggaaatgaagtcagccatgaggagattaaagaaacgactagggcattcagaaaggatttaa

SEQ ID NO: 500 - protein, 311 aa, Canis familiaris
MDQGNYTKVKEFLFLGITQSRELSLVLFVFLFTVYMTTLLGNLLIMVTVTFESHLHTPMYFLLRNLSVLDICFSSITAPKVLVDLLSKRKTISFNGCVTQMFFFHLLGGADVFSLSVMAFDRYVAISRPLHYMTIMSKERCTSLVLASWVGGFVHSIVQISLLLPLPFCGPNVLDTFYCDVPQVLKLACTDTISLEILMISNNGLVSWLIFFFLLISYTVILMMLRSHAGEGRRKAISTCTSHITVVTLHFVPCIYVYARPFTALPTDKAISVTFTVISPLLNPMIYTLRNQEMKSAMRRLKKRLGHSERI

SEQ ID NO: 501 - DNA, 936 bp, Canis familiaris
atggagttgggaaatagcacaaggataaaagaatttatatttctggggcttactcagtcccatgacctgagcttgatcttatttctttctttgtgtttggtgtacgtgataactcttctgggaaacctcctcatcatggtcactgtgacctgtgagtcccgccttcacacccccatgtacttcctgctccgcaacctagccgtccttgacatctgcttctcctccatcactgctcccaaggttctcatagaccttctgtcaaagataaagaccatctcctatacaagctgcatgacacagatgttcttcttccaccttctcggtggggcagacattttttctctctctgtgatggcctttgaccgctacatggccatctccaagcccttgcactatgtgaccatcatgagtagagggcgatgcactgccctcattgtggcctcctgggtggggggctttgtccactccattgtgcagatttccctgttgctgcccctccccttctgtggccccaatgttcttgacactttctactgcgatgtcccccaggtcctcaaacttgcctgcactgacacctttgcacttgagctcctgatgatttccaacaatggcttagtcactactttgtggtttattttcctcctggtgtcctacacagtcatcttgacaatcctgaggtctcaggcaggggagggcaggaggaaagccatctccacctgcacctcccacatcactgtggtgaccctgcattttgtgccctgtatctatgtctatgcccggcccttcactgccctccccacagataaagccatctctgtcaccttcacagtcatctccccactgctgaaccccatgatctacaccctgaggaaccaggagatgaaatcagccatgaggagattaagcagaagactcacaccctttgtgatggaatag

SEQ ID NO: 502 - protein, 311 aa, Canis familiaris
MELGNSTRIKEFIFLGLTQSHDLSLILFLSLCLVYVITLLGNLLIMVTVTCESRLHTPMYFLLRNLAVLDICFSSITAPKVLIDLLSKIKTISYTSCMTQMFFFHLLGGADIFSLSVMAFDRYMAISKPLHYVTIMSRGRCTALIVASWVGGFVHSIVQISLLLPLPFCGPNVLDTFYCDVPQVLKLACTDTFALELLMISNNGLVTTLWFIFLLVSYTVILTILRSQAGEGRRKAISTCTSHITVVTLHFVPCIYVYARPFTALPTDKAISVTFTVISPLLNPMIYTLRNQEMKSAMRRLSRRLTPFVME

SEQ ID NO: 503 - DNA, 936 bp, Canis familiaris
atggagctgaaaaattgcaccagggtgaaagaatttgctttccttggcctaacccagaatcaaggactgagcttggtcttatttcttttcctgcttctggtatatgtgacaactctgctgggaaacctcctcatcatggtcactgtcacctgtgagtcccgtcttcacacccccatgtacttcctgctccgtaatttatctgttgccgacatctgcttttcctccatcacagctcccaaggttctgatggaccttctgtcacaaagaaagacaatctcctttaatgggtgcttcacccagatgttttttttccaccttgttggaggggtggatgtattttctttgtcagtgatggcattggatcgatatgtggccatctccaagcccctgcactatgtgaccattatgagtagaggccgttgcattggattaatagtggcctcctgggtgggaggctttacccactccattgtacagatttccctgttgcttccgctccccttctgtgggcccaatgttcttgacactttctactgcgatgttccacaggtcctcaagctcgcctgtacagacatttttatgcttgagttgctgatgatttccaataatggactgctcaccacactgtggtttttcttcctcctggtatcatatatggtcatattagtagtagtaaagtctcaggcaggggagggcaggaggaaagccatctccacctgcacttcccacatcactgtagtgacgctgcactttgtgccctgcatctatgtctatgcccggcccttcactgctctccccacagataaagccatctctgtcaccttcacagtcatctctcctctgctgaaccccttgatctatactctgaggaaccaggagatgaagtcagccatgaggagattgaagagaagactcatgccttctgacagggaatag

SEQ ID NO: 504 - protein, 311 aa, Canis familiaris
MELKNCTRVKEFAFLGLTQNQGLSLVLFLFLLLVYVTTLLGNLLIMVTVTCESRLHTPMYFLLRNLSVADICFSSITAPKVLMDLLSQRKTISFNGCFTQMFFFHLVGGVDVFSLSVMALDRYVAISKPLHYVTIMSRGRCIGLIVASWVGGFTHSIVQISLLLPLPFCGPNVLDTFYCDVPQVLKLACTDIFMLELLMISNNGLLTTLWFFFLLVSYMVILVVVKSQAGEGRRKAISTCTSHITVVTLHFVPCIYVYARPFTALPTDKAISVTFTVISPLLNPLIYTLRNQEMKSAMRRLKRRLMPSDRE

SEQ ID NO: 505 - DNA, 930 bp, Canis familiaris
atggaacaaaacaatggcactaaagtaactgaattcatcctcctgggatttgctggtcaacacaagtcttggcatatcctcttcatagtgtttctagtgatctatgtggccaccctaatggggaatattgggatgatcctactcatcaagattgattctcgccttcacaccccaatgtactttttcctacaacacctggcatttgtggatctctgctacacctctgctatcactcccaagatgctgcaaaaccttgtagaaacagagcaatccatctcattcataggatgtatggtgcaattactagtctatggagcttttgcaacaaccgactgctacatcctggctgcaatggcagtggacaggtatgtggccatctgcaacccactccgctatccgacagtcatgtcccaggcagtctgcattcaactcctgattggctcatacttcgtaggcttcttgaatgcctctgtaaacacaagttttgctttttcattgaacttttgcaaatccaataaaattaaccactttttctgtgatgaacccccactccttgccctctcgtgctccaacattgacttcaacatcatgctactaactgtctttgtggggtttaacttgatgttcactgtgctggttgtcatcttttcctacatatatattctggctgccatcctgaagatatcttctgctgcagggaggaagaaagccttctccacatgcgcctcccacttgacagcagtcataattttctatgggactctctcttacatgtacctgcatcatgggaccaaggagtctcaagagcaagaaaaaatggcttctgtgttttatggcattatgatccccatgttaaaccccctcatctacagcctgagaaaccaagatgtgaaggaagccctaaaagggattccaaagaaggccttctag

SEQ ID NO: 506 - protein, 309 aa, Canis familiaris
MEQNNGTKVTEFILLGFAGQHKSWHILFIVFLVIYVATLMGNIGMILLIKIDSRLHTPMYFFLQHLAFVDLCYTSAITPKMLQNLVETEQSISFIGCMVQLLVYGAFATTDCYILAAMAVDRYVAICNPLRYPTVMSQAVCIQLLIGSYFVGFLNASVNTSFAFSLNFCKSNKINHFFCDEPPLLALSCSNIDFNIMLLTVFVGFNLMFTVLVVIFSYIYILAAILKISSAAGRKKAFSTCASHLTAVIIFYGTLSYMYLHHGTKESQEQEKMASVFYGIMIPMLNPLIYSLRNQDVKEALKGIPKKAF

SEQ ID NO: 507 - DNA, 939 bp, Canis familiaris
atggaagtaggaaaccgtaccattctgactgaattcatcttggtgggcttctcagcagacccacggtggcagctgattctatttggaatatttctgatgctctatttgatgactttgtcagggaacatgaccctggttatcctaatccgaattgattcccgcctgcacacccctatgtacttcttcattggcaatttgtcctttttggatttttggtacacttctgtgtatactcccaaaatcttggctaattgtgtctcagaagataaacgtatttccttggctggatgtggagcccagttgttcttttcctgtgttgtagcctacacagaatgctatctcctagccgccatggcatatgaccggtatgcagcaatctgtaacccattgctttattcaagtatgatgtccaattctctctgtactgggcttgttgctggctcctacttaggaggacttttgaatgccatagcccatactgctaacactttccgcttgagtttctgtggtaaaaatatcattgaccacttcttctgtgatgcaccaccattggtaaaaatgtcttgtacagatacccatgtctatgaaaaagtcctcctgggtgtggtgggcttcacagtcctctccagcattcttgccatcctggtttcctattgcaacatccttctggctatcctgaggatccgctcggcttcaggaaggcgcaaagccttctccacctgtgcttcacacctcatttcggtcatgctcttctatggatccttgctcttcatgtattcaaggccaagttccacctactccctggagagagacaaagtggctgctctgttctacactgtggtcaacccattgctcaaccctctcatctatagcctgagaaacaaagacgtcaaagaggccttctggaaagcaacacaaaccataaggctgcagagatga

SEQ ID NO: 508 - protein, 312 aa, Canis familiaris
MEVGNRTILTEFILVGFSADPRWQLILFGIFLMLYLMTLSGNMTLVILIRIDSRLHTPMYFFIGNLSFLDFWYTSVYTPKILANCVSEDKRISLAGCGAQLFFSCVVAYTECYLLAAMAYDRYAAICNPLLYSSMMSNSLCTGLVAGSYLGGLLNAIAHTANTFRLSFCGKNIIDHFFCDAPPLVKMSCTDTHVYEKVLLGVVGFTVLSSILAILVSYCNILLAILRIRSASGRRKAFSTCASHLISVMLFYGSLLFMYSRPSSTYSLERDKVAALFYTVVNPLLNPLIYSLRNKDVKEAFWKATQTIRLQR

SEQ ID NO: 509 - DNA, 930 bp, Canis familiaris
atggaaaatcagaacaatgtcacagaatttgttttcatggggctatggggaaataagcaactagaactactgttctttttcttgttcctgctctgctacctggctgtcttaatgggaaacttcattatcttactcacgatcacctgcagccatctaattgaacatccgatgtactattttctctgtcacctttccctcatggacctctgctacacctccactgtggtccccaggctaatcagggacttaggtgcagcaagaaaaaacatttcctataacaactgtatgacccagctcttcactgcccacttgctggcaggggtggagatattcatcttggtgtccatggctttagaccgctatgttgccattgtcaagcccctgcattacatggtcatcatgaaccgacggaggtgtaacctgttgatttttatggcctggggtgtggggttttggcactctgttgctctattgctcatggtactcaatttacctttctgtggtcctaatcagatagatcattacatatgtgatgtgaagcctcttttgaaactggtgtgcagagatattcgtgttgttagtatcttagtgattgcaaactcaggaatggtggtggttgtcatttttcttgtcctggtggcttcttacattctcatattatataatcttaggacccactcctctgtagggagactcaaagctctctccacctgcagctctcatgtaatggtggtcattttattctttgtgccttgtatctatacttatgttctacctgcagggagtgagaacaaggataaggaaatctctgtgttttacactgtaattgctcccatgctgaatcctctcatctataccttaagaaacatggagatgaaaatcgccatgcggaaggtgtggtctaaagtggcacattcagaattcaaataa

SEQ ID NO: 510 - protein, 309 aa, Canis familiaris
MENQNNVTEFVFMGLWGNKQLELLFFFLFLLCYLAVLMGNFIILLTITCSHLIEHPMYYFLCHLSLMDLCYTSTVVPRLIRDLGAARKNISYNNCMTQLFTAHLLAGVEIFILVSMALDRYVAIVKPLHYMVIMNRRRCNLLIFMAWGVGFWHSVALLLMVLNLPFCGPNQIDHYICDVKPLLKLVCRDIRVVSILVIANSGMVVVVIFLVLVASYILILYNLRTHSSVGRLKALSTCSSHVMVVILFFVPCIYTYVLPAGSENKDKEISVFYTVIAPMLNPLIYTLRNMEMKIAMRKVWSKVAHSEFK

SEQ ID NO: 511 - DNA, 930 bp, Canis familiaris
atggagaatagaaacaatgtgacagagtttgttctactggggctcacagagaatccaaagatgcagaaaatcgtttttgttgtgtttttgatcatctacatcgtctctgtggtaggaaatgtgctcactgtggcagctatcaccgccagcccattattggggtcccccatgtactttttcctggcctatctttccttcattgatgcctgctattcttctgtcaataaccctaaactgattgtagattcactccgtgaaaagaagaccaccacattcaatgcatgtataacccaaatctttggggaacatttttttggaggtgctgatgtcatcttgcttactgtgatggcctatgaccgctatgtggccatctgcaagccactgcactacatgatcatcatgaatcggcaggtgtgtggcttgctcatggcagtggtgtgggtgggaggctttcttcatgcagccatacagatcctctttatcatccctctacctttctgtggccctaatgtcatagatcactttatgtgtgatctgaatcctttgctcaatcttgcctgcactgatacccacactcttgggttctttgttgctgccaacagtggtttcatctgtgccttaaacttcctcctcctcatggtctcctatgtggtcattctgcactccctaaggaaccacagcttggaggcgagactcaaagccctctccacctgtgtctcccacatcacagtggtcgtcttattctttgtgccctgtatatttgtgtacatgagacctgcagctactttacctattgataaagcagttgcagttttctacactatgataacacccatgttaaatcccttaatatatgccttgagaaatgatcagatgaaaaatgccattaggaaattgtgcagtagaaaagttatttcagatgcgaaataa

SEQ ID NO: 512 - protein, 309 aa, Canis familiaris
MENRNNVTEFVLLGLTENPKMQKIVFVVFLIIYIVSVVGNVLTVAAITASPLLGSPMYFFLAYLSFIDACYSSVNNPKLIVDSLREKKTTTFNACITQIFGEHFFGGADVILLTVMAYDRYVAICKPLHYMIIMNRQVCGLLMAVVWVGGFLHAAIQILFIIPLPFCGPNVIDHFMCDLNPLLNLACTDTHTLGFFVAANSGFICALNFLLLMVSYVVILHSLRNHSLEARLKALSTCVSHITVVVLFFVPCIFVYMRPAATLPIDKAVAVFYTMITPMLNPLIYALRNDQMKNAIRKLCSRKVISDAK

SEQ ID NO: 513 - DNA, 930 bp, Canis familiaris
atgacaagccagagaaacatctccgaattcatacttctaggactttcatatgaccagagcatacagatattttgttttgtcattttcttactctgttatgttgctctgttggcaggaaatcttctgatccttatctccattcgatgcagccctctttttcaccaaccaatgtactacttccttatacacttatccttaatagacatctgctacacctctacagttacacccaagttaattggtgacttgctagtggaaaggaaaaccatctcctatgacaattgcatgttacaggtctttacaatgcacttctttggaggcatcgagatcttcattctcaccgccatggcctttgatcgctatgctgccatctgcaaacctctccactatgtgattatcatgaacaggacaagatgcaatctcctagtcttagctgcttgggctggtggggccattcatgcctttcctttattttctactgcaattggtttgcccttctgtggtcctaatgaaattgatcactatttttgtgatatttttcctttgcttaaagtggcctgtactgatacttacatcactggtgtccttgtgattgccttttcgggtatggtcgcattagttacctttattgtcttatctgtttcttatggcattatactgttcactttaagaaatctctcagctgaaggaagacgcaaagccctctctacctgttggtctcatatcactgtggtcatcttattttttgggcctgtaatctttatctaccttaggccacctactacttttcctgaggacaaaatatttgctctgttttacaccatcattgctcctatgttcaatcccttaatctatactctgagaaattcagagatgaaaaaagccatgaggaaagtttggtgtccatcagtattttcaaaggaagcatga

SEQ ID NO: 514 - protein, 309 aa, Canis familiaris
MTSQRNISEFILLGLSYDQSIQIFCFVIFLLCYVALLAGNLLILISIRCSPLFHQPMYYFLIHLSLIDICYTSTVTPKLIGDLLVERKTISYDNCMLQVFTMHFFGGIEIFILTAMAFDRYAAICKPLHYVIIMNRTRCNLLVLAAWAGGAIHAFPLFSTAIGLPFCGPNEIDHYFCDIFPLLKVACTDTYITGVLVIAFSGMVALVTFIVLSVSYGIILFTLRNLSAEGRRKALSTCWSHITVVILFFGPVIFIYLRPPTTFPEDKIFALFYTIIAPMFNPLIYTLRNSEMKKAMRKVWCPSVFSKEA

SEQ ID NO: 515 - DNA, 213 bp, Canis familiaris
ggtagggtggtggcagccttttttgttgtcttggtggcttcttacatattcatatcacataatcttaggacccactcctccgccgggtaatgcaaagctctctccacgtgcagctctcatgtaatggtggtagttttattcttcatgccctgtatctgtacttaggttctacctgcaggcagtgaggacagagatgaggaactctccgtattt

SEQ ID NO: 516 - protein, 40 aa, Canis familiaris
VGWWQPFLLSWWLLTYSYHIILGPTPPPGNAKLSPRAALM

SEQ ID NO: 517 - DNA, 912 bp, Canis familiaris
atggagagccagaggaatgtctcagaattcattcttttgggactttcgcatgaccagaacatgcaaatattttgctttgtgctcttcttattctgttatgctgctctcttggtaggaaaccttctgatccttgtctctattcgatgcagccctctttttcaccaaccgatgtactacttcctcagccacttatccactttggacatctgctatacctctagcgttacacccaaattaattgctgacctgctagtggaaagaaaagccatctcctatggtaattgtatgttacaggtctttgccatgcacttctttggaacgattgaggttttaatccttacagtcatggcctttgatcgctatgctgccatctgcaaacctctccactacctgcttatcatgaacaggacaaggtgtaatctcctagtcttagctgcttgggctggtggggctgtccactcctttcctcaattttgtatggtaatcaggttgcccttctgtgggcctaatgagattgatcactatttctgtgatatatttcctttgctaaaggttgcctgcactgatacctacatcactggtgtccttatggttgtcaattcgggaatggttaccttagtgacatttgtggttttatttttttcttatgtcattatattattcactttaagaaatcactcagcagaaggaagacgcaaagccctctctacttgtggatctcatatcacggttatagttttattttttgggccttccatctttgcctaccttagacctccaactaatttccctgaggataaagtatttgctctgttttacaccatcattgctcctatgttcaatcccttaatctatactctgagaaattcagagatgaaaaatgccatgagaaaattttggtgtcaaacatga

SEQ ID NO: 518 - protein, 303 aa, Canis familiaris
MESQRNVSEFILLGLSHDQNMQIFCFVLFLFCYAALLVGNLLILVSIRCSPLFHQPMYYFLSHLSTLDICYTSSVTPKLIADLLVERKAISYGNCMLQVFAMHFFGTIEVLILTVMAFDRYAAICKPLHYLLIMNRTRCNLLVLAAWAGGAVHSFPQFCMVIRLPFCGPNEIDHYFCDIFPLLKVACTDTYITGVLMVVNSGMVTLVTFVVLFFSYVIILFTLRNHSAEGRRKALSTCGSHITVIVLFFGPSIFAYLRPPTNFPEDKVFALFYTIIAPMFNPLIYTLRNSEMKNAMRKFWCQT

SEQ ID NO: 519 - DNA, 930 bp, Canis familiaris
atggaaaatcagaacaatgtcacagaatttgttttcatgggtctgtggggaaataaacaaatggagctactgttctttttcctgttcctgctctgctttttggccatcttaatgggaaacttcatcatcttactcacgatcatctgcagccatctaattgaacaaccaatgtactactttctctgccacctttctctcatggacctctgctacacttccactgtagtccccagactaatcagggacttaggtgcagcaagaaaaaacatttcctataacaactgtatgacccagctcttcactgcccacttgctggcaggggtggagatattcatcttggtgtccatggctttagaccgttatgtggccattgtcaagcccctgcattacatggtcatcatgagccggcggaggtgtaacctgttgattttcatggcctggagtgtggggttttggcactctgttgctctattgctcttggtactcaatttacctttctgtggtcctaatcagataaatcattacatatgtgatgtgaagcctcttttgaaactggtgtgcagagatattcgtgttgttaatatcttagtgatttcaaactcaggaatggtggcagttgttgtgtttcttgtcctggtggcttcttacattctcatattatacaatctgaggacccactcctctgtagggagacgcaaagctctctccacgtgcagctctcatgtaatggtggtcattttattctttgtgccttgtatctatatttatgttctacctgcagggagtgaaaacaaggataaggagatctctgtgttttacactgtgattgctcccttgttgaatcctctcatctataccctgagaaacatggagatgagaaatgccatgtggaaggtgtggtctaaaatggcacatacgaaattcaggtaa

SEQ ID NO: 520 - protein, 309 aa, Canis familiaris
MENQNNVTEFVFMGLWGNKQMELLFFFLFLLCFLAILMGNFIILLTIICSHLIEQPMYYFLCHLSLMDLCYTSTVVPRLIRDLGAARKNISYNNCMTQLFTAHLLAGVEIFILVSMALDRYVAIVKPLHYMVIMSRRRCNLLIFMAWSVGFWHSVALLLLVLNLPFCGPNQINHYICDVKPLLKLVCRDIRVVNILVISNSGMVAVVVFLVLVASYILILYNLRTHSSVGRRKALSTCSSHVMVVILFFVPCIYIYVLPAGSENKDKEISVFYTVIAPLLNPLIYTLRNMEMRNAMWKVWSKMAHTKFR

SEQ ID NO: 521 - DNA, 933 bp, Canis familiaris
atgcagcaaaataacagcgtaacagagttcatactattaggactaacccaagaccctatcagacagaaaatgatatttgtaatcttctccattttttatgtgggaactgtggttgggaatttgcttattattgtgaccatcaagtctagccggacacttgggagccccatgtactttttcctattttatttgtcccttgctgattcctgcttttcaacttccacagcccccagactaattgtggattcactctctgcaaaaaaaatcataacttacaatgagtgcatgactcaagtctttgcactacatttatttggctgcatggagatctttgtcctcatcctcatggccgttgatcgctatgtggccatctgtatgcctttacgttacccaaccatcatgagacggcaggtctgcaccatcctaattgttctggcatggattggatcttttatccattctatagcccagattatcctggctttgagattgcccttctgtggaccgaatttgattgatcattactgctgtgatttgcagcccttgctgaaacttgcttgcatggacacttataagatcaacctattgttggtgtctaatagtggggccatttgctcaagcagttttgtgattctgatgatctcctatattgtcatcttgcattccctgcgaaaccacagtgcggaagggaagaaaaaagctctctctacttgtacttctcacatcattgtagtaatcttattctttggtccatgtatattcatttatacacgccccccaactactttccccatggacaagatggtggccgtattttatactattgggacaccttttctcaatccacttatctacacactgaggaatgcagaagtgaaaaatgccatgaaaaagctatggcatatcaaaattacctcagaaagcaaaaaatga

SEQ ID NO: 522 - protein, 310 aa, Canis familiaris
MQQNNSVTEFILLGLTQDPIRQKMIFVIFSIFYVGTVVGNLLIIVTIKSSRTLGSPMYFFLFYLSLADSCFSTSTAPRLIVDSLSAKKIITYNECMTQVFALHLFGCMEIFVLILMAVDRYVAICMPLRYPTIMRRQVCTILIVLAWIGSFIHSIAQIILALRLPFCGPNLIDHYCCDLQPLLKLACMDTYKINLLLVSNSGAICSSSFVILMISYIVILHSLRNHSAEGKKKALSTCTSHIIVVILFFGPCIFIYTRPPTTFPMDKMVAVFYTIGTPFLNPLIYTLRNAEVKNAMKKLWHIKITSESKK

SEQ ID NO: 523 - DNA, 933 bp, Canis familiaris
atgcagcaaaataacagcgtaacagagttcatactgttaggactaacccaagatcctatgagacagaaaatggtatttgtaatcttctccattttatatgtgggaactgtggttgggaatttgcttattattgtgaccatcaagtctagccggacacttgggagccccatgtactttttcttattttatttgtcccttgctgattcctgcttttcaacttccacagcccccagactaattgtggattcactctctgcaaaaaaaatcataacttacaatgagtgcatgactcaagtctttgcactacacttatttggctccatggagatctttgtcctcatcctaatggcctttgaccggtatgtggccatctgtatgcctttacgttacccaaccatcatgagacggcaggtctgcaccatcctaattgttctggcatggattggatcttttatccattctacagcccagattatcctggctttgagattgcccttctgtggacccaatttgattgatcattactgctgtgatttgcagcccttgctgaaacttgcctgcatggacacttatgtgatcaacctactgttggtgtctaatagtggggccatttgctcaagcagttttgtgattctgatgatctcctacattgtcatcttgcattccctgcgaaaccacagtgcagaagggaagaaaaaagctctctctacttgcacttctcacatcattgtagtaatcttattctttggtccatgtatattcatttatacacgcccgccaactactttccccatggacaagatggtaactgtattttatactattgggacaccttttctcaatccacttatctacacactgaggaatgcagaagtgaaaaatgccatgaaaaatctatggcatgtcaaaattacctcagaaagcaaaagatga

SEQ ID NO: 524 - protein, 310 aa, Canis familiaris
MQQNNSVTEFILLGLTQDPMRQKMVFVIFSILYVGTVVGNLLIIVTIKSSRTLGSPMYFFLFYLSLADSCFSTSTAPRLIVDSLSAKKIITYNECMTQVFALHLFGSMEIFVLILMAFDRYVAICMPLRYPTIMRRQVCTILIVLAWIGSFIHSTAQIILALRLPFCGPNLIDHYCCDLQPLLKLACMDTYVINLLLVSNSGAICSSSFVILMISYIVILHSLRNHSAEGKKKALSTCTSHIIVVILFFGPCIFIYTRPPTTFPMDKMVTVFYTIGTPFLNPLIYTLRNAEVKNAMKNLWHVKITSESKR

SEQ ID NO: 525 - DNA, 192 bp, Canis familiaris
ttttcttggccatgtactttcatgtatatttgctctgatactaccttttcaggggataagatgatggctgtattttacaccattatcaccctcatgttaaatcctctgatccacaccctgagaaacacagaagtaaagaatgcaatgaaaagactgtggggcaggaagattttgtcagaggctaatggtaaa

SEQ ID NO: 526 - protein, 64 aa, Canis familiaris
FSWPCTFMYICSDTTFSGDKMMAVFYTIITLMLNPLIHTLRNTEVKNAMKRLWGRKILSEANGK

SEQ ID NO: 527 - DNA, 804 bp, Canis familiaris
gtggtcactatcactgccagcccattatcggggtcccccatgtacttttttctggcctatctctccctcattgatgcctgctattcttttgtcaatacccctacactcatcatagagtcactccgtgaaaagaagaccatcccattcaatgcatgcataatccaaatctttggggaacattttttttttggaggtgctgatgtcatcctgcttactgtgatggcctatgacagctatgtagctatctgcaagccactgcactacatgaccatcatgaattagcaggtatgtggcctgctcatggcagtggagtgggtgggaggctttcctcatgcagccatacagatcttctttatcatcccactacccttctgtggccctaatgtcatagatcactttatatgtgatctgaatcctttgctcaatcttgcctgcactgatacccacactctcagattctttgttgctgccaacagtggtttcatctgtgtcttaaacctcctcctcctcctcatggtctcctatgtggtcattctgcactccttaaggaaccacagctttgaggcaaggtgcaaagccctctccatctgtgtctcctacatcacagtggtcatcctatactttgtgccctgcatatttgtatacatgagacccgcagctactttatcaattgataaagctattacagtgttctatactacaataactcccatgttaaatcctttaatctataccttgagaaatgaccagatgaaaaatgccattaggaaactgtgtagtaggaatgctagtgtgggtgacaaa

SEQ ID NO: 528 - protein, 168 aa, Canis familiaris
MAVEWVGGFPHAAIQIFFIIPLPFCGPNVIDHFICDLNPLLNLACTDTHTLRFFVAANSGFICVLNLLLLLMVSYVVILHSLRNHSFEARCKALSICVSYITVVILYFVPCIFVYMRPAATLSIDKAITVFYTTITPMLNPLIYTLRNDQMKNAIRKLCSRNASVGDK

SEQ ID NO: 529 - DNA, 936 bp, Canis familiaris
atggagagaggcaatcatacagtgactgagttcatcctggtgggcttcacgacagacccagtgatgcagctggtcctgtttatggtattccttggcgtgtactctctgactgtggtagcaaacgccaccctcatagttttgatctgtaatgactcccggctgcacacacccatgtattttttcattgggaatctatcttttctggatgtctggtattcctctgtctacacaccaaagatcctcatgacctgcatctctgaagacaaaagcatctcctttgctggctgtgtatgtcagttcttcttctctgctgggttggcatatagtgagtgttacctgttggccgccatggcttacgaccgctatgcagccatttccaaccccctgctgtatgctcagacaatgtcaagtagactgtgcatctgtttggttgtatactcttatactggtggttttgtcaatgcaataatacttaccagtaacacattcacattggatttttgtggtgacaatgtcatcgacgattttttctgtgatgtcccaccactggtgaaattggcatgtgatgtgaaggagagctatcaggctgtgctgtacttccttctggcctccaatgtcatcactcccacggcgctcatccttgcttcctatgtgttcatcattgctgccatcttgaggatccgctccacccagggccgtcgcaaggccttctccacatgctcctcccacctggtctcagtcactttgtactatggctccattctctacatctactctcgcccaagttccagctattcccttgagagggacaaaatggtatcaacattttatactgtgctattccccatgttgaaccccatgatctatagtctaaggaataaggatgtgaaagaagctctgaaaaagctcatctggttaacacaatcagatgtctaa

SEQ ID NO: 530 - protein, 311 aa, Canis familiaris
MERGNHTVTEFILVGFTTDPVMQLVLFMVFLGVYSLTVVANATLIVLICNDSRLHTPMYFFIGNLSFLDVWYSSVYTPKILMTCISEDKSISFAGCVCQFFFSAGLAYSECYLLAAMAYDRYAAISNPLLYAQTMSSRLCICLVVYSYTGGFVNAIILTSNTFTLDFCGDNVIDDFFCDVPPLVKLACDVKESYQAVLYFLLASNVITPTALILASYVFIIAAILRIRSTQGRRKAFSTCSSHLVSVTLYYGSILYIYSRPSSSYSLERDKMVSTFYTVLFPMLNPMIYSLRNKDVKEALKKLIWLTQSDV

SEQ ID NO: 531 - DNA, 933 bp, Canis familiaris
atgaagcaaaatatcagtattactgagttcatactgttaggattgacccaagatcctatgaaaaagaaagtggtatttgtaatcttcttcattttatatgtgggaacgctggcaggaaatttgctaattattgtgaccatcaagtctagccggacacttgggagccccatgtactatttcttattttatttgtcccttgctgattcctgcttttcaacttccacagcccccagactaattgtggattcactctctacaaaaaatatcataacttacaatgagtgcatgactcaagtctttgcactgcatttctttggctgcatggagatctttgtcgtcatcttcatggccgttgaccgctatgtggcaatctgtaagcccttacgttacctaaacatcatgaactggcaggtctgcaccatcctaattgttctggcatggattggatcttttatccattctatagcccagattatcctggctttgagattgcccttctgtggacccaatttgattgatcattactgctgtgatttgcagcccttgctgaaacttgcttgcatggacacttatgtgatcaacctactgttggtgtctaatagcggggccatttgctcaagcagttttgtgattctgatgatctcctacattgtcatcttgcattccctgcgaaaccacagtgcggaagggaggaaaaaagctctctctacttgcacttctcacatcatcgtagtagtcttatgctttggtccatgcatattcatatatacacggcctccaaccaccttcttcatggacaagatggtaactgtattttatactattgggacaccttttctcaacccactgatttatgcactaaggaatgcagaagtgaaaaatgccatgaaaaagctatggcatatcaaaattacctcagaaagcagaagatga

SEQ ID NO: 532 - protein, 310 aa, Canis familiaris
MKQNISITEFILLGLTQDPMKKKVVFVIFFILYVGTLAGNLLIIVTIKSSRTLGSPMYYFLFYLSLADSCFSTSTAPRLIVDSLSTKNIITYNECMTQVFALHFFGCMEIFVVIFMAVDRYVAICKPLRYLNIMNWQVCTILIVLAWIGSFIHSIAQIILALRLPFCGPNLIDHYCCDLQPLLKLACMDTYVINLLLVSNSGAICSSSFVILMISYIVILHSLRNHSAEGRKKALSTCTSHIIVVVLCFGPCIFIYTRPPTTFFMDKMVTVFYTIGTPFLNPLIYALRNAEVKNAMKKLWHIKITSESRR

SEQ ID NO: 533 - DNA, 933 bp, Canis familiaris
atgcagcaaaataacagtactactgagttcatactgttaggattgacccaagatcctatgaaaaagaaaatggtatttgtaatatttttcattttttatttgggaactgtggttgggaatttgcttattgttgtgaccatcaagaccagccggacacttgggagccccatgtactatttcttattttatttgtcccttgctgattcctgcttttcaacttccacagcccccagactaattgtggattcactctctgcaaaaaatatcataacttacaatgaatgcatgactcaagtctttgcactacatttctttggttgcatggaggttttagtccttatccttatggcctttgaccggtatgtggccatctgtaagcccttacattacccaaccatcatgagccggcgggtctgcaccatcctaattgttctggcatggattggatcttttatccattctatagcccagattatcctggctttgaggttgcccttctgtggaccgagtttgattgatcattactgctgtgatttgcagcccttgctgaaacttgcttgcatggacacttatgtgatcaacctactgttggtgtctaatagtggggccatttgctcaagcagttttgtgattctgatgatctcctacattgtcatcttgcattccctgcgaaaccacagtgcggaagggaggaaaaaagctctctctacttgtacttctcacatcattgtagtaatcatattctttggtccctgtatattcatttatacacgtcccccaaccactttccccatggacaagatggtggccgtattttatactattgggacaccttttctcaacccactcatctacacattgaggaatgcagaagtgaaaaatgccatgaaaaagctatggcatatcaagattacctcagaaagcagaagatga

SEQ ID NO: 534 - protein, 310 aa, Canis familiaris
MQQNNSTTEFILLGLTQDPMKKKMVFVIFFIFYLGTVVGNLLIVVTIKTSRTLGSPMYYFLFYLSLADSCFSTSTAPRLIVDSLSAKNIITYNECMTQVFALHFFGCMEVLVLILMAFDRYVAICKPLHYPTIMSRRVCTILIVLAWIGSFIHSIAQIILALRLPFCGPSLIDHYCCDLQPLLKLACMDTYVINLLLVSNSGAICSSSFVILMISYIVILHSLRNHSAEGRKKALSTCTSHIIVVIIFFGPCIFIYTRPPTTFPMDKMVAVFYTIGTPFLNPLIYTLRNAEVKNAMKKLWHIKITSESRR

SEQ ID NO: 535 - DNA, 930 bp, Canis familiaris
atggggaatagaaacaatgtgacagagtttgttctactggggctcacagagaatccaaagatgcagaaaatcgtttttgttgtgtttttgatcatctacatcatctctgtggtaggaaatgtgctcaccgtggcagctatcaccaccagcccattattggggtcccccatgtactttttcctggcctatctttccttcattgatgcctgctattcttctgtcaataaccctaaactgattgtagattcactccgtgaaaagaagaccaccacattcaatgcatgtataacccaaatctttggggaacatttttttggaggtgctgatgtcatcctgcttactgtgatggcctatgaccgctatgtggccatctgcaagccactgcactacatgaccatcatgaatcggcaggtgtgtggcttgctcatggcagtggtgtgggtgggaggctttcttcatgcagccatacagatcctctttatcatccctctacccttctgtggccctaacgtcatagatcactttatgtgtgatctgaatcctatgctcaatcttgcctgcactgatacccacactcttgggttctttgttgctgccaacagtggtttcatctgtgccttaaacttcctcctcctcatggtctcctatgtggtcattctgcgctccctaaggaaccacagcttggaggcgaagcgcaaagccctctccacctgtgtctcccacatcacagtggtcgtcctattctttgtgccctgcatatttgtgtacatgagacccgcagctactttacctattgataaagcagttgcagttttctacactatgataacacccatgttaaatcccttaatctatgccttgagaaatgatcagatgcaaaaagccattaggaaattgtgcagtagaaaagttatttcagatgagaaataa

SEQ ID NO: 536 - protein, 309 aa, Canis familiaris
MGNRNNVTEFVLLGLTENPKMQKIVFVVFLIIYIISVVGNVLTVAAITTSPLLGSPMYFFLAYLSFIDACYSSVNNPKLIVDSLREKKTTTFNACITQIFGEHFFGGADVILLTVMAYDRYVAICKPLHYMTIMNRQVCGLLMAVVWVGGFLHAAIQILFIIPLPFCGPNVIDHFMCDLNPMLNLACTDTHTLGFFVAANSGFICALNFLLLMVSYVVILRSLRNHSLEAKRKALSTCVSHITVVVLFFVPCIFVYMRPAATLPIDKAVAVFYTMITPMLNPLIYALRNDQMQKAIRKLCSRKVISDEK

SEQ ID NO: 537 - DNA, 921 bp, Canis familiaris
atgacaagccagagaaacatctccgaattcatacttctaggactttcaaatgaccagagcatacagatattttgttttgtcattttcttactctgttatgttgctctgttggcaggaaatcttctgatccttatctccattcgatgcagccctctttttcaccaaccaatgtactatttccttatacacttatccttaatagacatctgctacacctctacagttacacccaagttaattggtgacttgctagtggaaaggaaaaccatctcctatgacaattgcatgttacaggtctttacaatgcacttctttggaggcattgagatcttcattctcaccgccatggcctttgatcgctatgctgccatctgcaaacctctccactacgtgattatcatgaacaggacaagatgcaatctcctagtcttagctgcttgggctggtggggccattcatgcctttcctttactttctactgcaattggtttgcccttctatggtcctaatgaaattgatcactacttttgtgatatttttcctttgcttaaagtggcctgtactgatacttacatcactagtgtccttgtgattgccctttcaggaatggtcacattagttacctttattgtcttatctgtttcttatggtattgttcactttaagaaatctctcagctgaaggaagacgcaaagccctctctacctgttggtctcatatcactgtggtcatctatattttgggcctgtagtctttatgtaccttaggccacttattacttttcctgaggacaaaatatttgctatgttttacaccatcattgctcctttgttcaattccttaatctattctctgagaaattcagagatgaaaaaagccatgaggaaagtttggtgtccatcagtattttcaaaggaagca

SEQ ID NO: 538 - protein, 226 aa, Canis familiaris
MTSQRNISEFILLGLSNDQSIQIFCFVIFLLCYVALLAGNLLILISIRCSPLFHQPMYYFLIHLSLIDICYTSTVTPKLIGDLLVERKTISYDNCMLQVFTMHFFGGIEIFILTAMAFDRYAAICKPLHYVIIMNRTRCNLLVLAAWAGGAIHAFPLLSTAIGLPFYGPNEIDHYFCDIFPLLKVACTDTYITSVLVIALSGMVTLVTFIVLSVSYGIVHFKKSLS

SEQ ID NO: 539 - DNA, 210 bp, Canis familiaris
gtggtggtggcagccttttctgttgtcttggtggcttcttacatattcatatcacataatcttaggacccactcctccgccgggtaatgcaaagctctctccacctgcagctctcatgtaatggtggtagttttattcttcatgccctgtatctgtacttaggttctacctgcagggagtgagaacagagatgaggaactctccatattt

SEQ ID NO: 540 - protein, 39 aa, Canis familiaris
WWWQPFLLSWWLLTYSYHIILGPTPPPGNAKLSPPAALM

SEQ ID NO: 541 - DNA, 912 bp, Canis familiaris
atggagagccagaggaatgtctcagaattcattcttttgggactttcgcatgaccagaacatgcaaatattttgctttgtgctcttcttattctgttatgctgctctcttggtaggaaaccttctgatccttgtctctattcgatgcagccctctttttcaccaaccgatgtactacttcctcagccacttatccactttggacatctgctatacctctagcgttacacccaaattaattgctgacctgctagtggaaagaaaagccatctcctatggtaattgtatgttacaggtctttgccatgcacttctttggaacgattgaggttttaatccttacagtcatggcctttgatcgctatgctgccatctgcaaacctctccactacctgcttatcatgaacaggacaaggtgtaatctcctagtcttagctgcttgggctggtggggctgtccactcctttcctcaattttgtatggtaatcaggttgcccttctgtgggcctaatgagattgatcactatttctgtgatatatttcctttgctaaaggttgcctgcactgatacctacatcactggtgtccttatggttgccaattcgggaatggttaccttggtgacatttgtggttttatttttttcttatgtcattatattattcactttaagaaatcactcagcggaaggaagacgcaaagccctctctacctgtggatctcacatcacagttatagttttattttttgggccttccatctttgcctaccttagacctccaaccaatttccctgaggataaaatatttgctctgttttacaccatcattgctcctatgttcaatcccttaatctatactctgagaaattcagagatgaaaaatgccatgagaaaattttggtgtcaaacatga

SEQ ID NO: 542 - protein, 303 aa, Canis familiaris
MESQRNVSEFILLGLSHDQNMQIFCFVLFLFCYAALLVGNLLILVSIRCSPLFHQPMYYFLSHLSTLDICYTSSVTPKLIADLLVERKAISYGNCMLQVFAMHFFGTIEVLILTVMAFDRYAAICKPLHYLLIMNRTRCNLLVLAAWAGGAVHSFPQFCMVIRLPFCGPNEIDHYFCDIFPLLKVACTDTYITGVLMVANSGMVTLVTFVVLFFSYVIILFTLRNHSAEGRRKALSTCGSHITVIVLFFGPSIFAYLRPPTNFPEDKIFALFYTIIAPMFNPLIYTLRNSEMKNAMRKFWCQT

SEQ ID NO: 543 - DNA, 930 bp, Canis familiaris
atggaaaatcagaacaatgtcacagaatttgttttcatgggtttgtggggaaataaacaaatggagctactgttctttttcctgttcctgctctgttatttggccatcttaatgggaaacttcatcatcttactcacgatcatctgcagccatctaattgaacaaccaatgtactactttctctgccacctttctctcatggacctctgctacacttccactgtagtccccagactaatcagggacttaggtgcagccagaaaaaacatttcctataacaactgtatgacccagctcttcactgcccacttgctggcaggggtggagatattcatcttggtgtccatggctttagaccgttatgtggccattgtcaagcccctgcattacatggtcatcatgagccggcggaggtgtaacctgttgattttcatggcctggagtgtggggttttggcactctgttgctctattgctcttggtactcaatttacctttctgtggtcctaatcagataaatcattacatatgtgatgtgaagcctcttttgaaactggtgtgcagagatattcgtgttgttaatatcttagtgatttcaaactcaggaatggtggtggttgctgtgtttcttgtcctggtggcttcttacattctcatattatacaatctgaggacccactcctctgtagggagacgcaaagctctctccacgtgcagctctcatgtaatggtggtcattttattctttgtgccttgtatctatatttatgttctacctgcagggagtgaaaacaaggataaggagatctctgtgttttacactgtgattgctcccttattgaatcctctcatctataccctgagaaacatggagatgagaaatgccatgtggaaggtgtggtctaaaatggcacatacgaaattcaggtaa

SEQ ID NO: 544 - protein, 309 aa, Canis familiaris
MENQNNVTEFVFMGLWGNKQMELLFFFLFLLCYLAILMGNFIILLTIICSHLIEQPMYYFLCHLSLMDLCYTSTVVPRLIRDLGAARKNISYNNCMTQLFTAHLLAGVEIFILVSMALDRYVAIVKPLHYMVIMSRRRCNLLIFMAWSVGFWHSVALLLLVLNLPFCGPNQINHYICDVKPLLKLVCRDIRVVNILVISNSGMVVVAVFLVLVASYILILYNLRTHSSVGRRKALSTCSSHVMVVILFFVPCIYIYVLPAGSENKDKEISVFYTVIAPLLNPLIYTLRNMEMRNAMWKVWSKMAHTKFR

SEQ ID NO: 545 - DNA, 858 bp, Canis familiaris
atgcagcaaaataacagtactactgagttcatactgttaggattgacccaagatcctatgaaaaagaaaacggtatttgtaatatttttcattttttatttgggaactgtggttgggaatttgcttattattgtgaccatcaagtccagccggacacttgggagccccatgtactatttcttattttatttgtcccttgctgattcctgcttttcaacttccacagcccccaaactaattgtggattcactctctgcaaaaaatatcataacttacaatgaatgcatgactcaagtctttgcactgcatttctttggttgcatggaggtttttgtcctcctcctcatggcctttgaccggtatgtggccatctgtaagcccttacattacacaaccatcatgagccggcgggtttgcaccatcctaattgttctggcatggattggatcttttatccattctacagcccagattatcctggctttgagattgcccttctgtggaccccacctactgttggtttctaatagtggggccatttgctcaagcagttttgtgattctgatgatctcctacattgtcatcttgcattccctgcgaaaccacagtgcagaagggaggaaaaaagctctctctacttgcacttctcacatcatcgtagtagtcttatgctttggtccctgtatattcacatatacacgccccccaaccacttaccccatggacaagatgatggccgtgttttatactattgggacaccgcttgttaacccactcatctacacactgaggaatgcagaagtgaaaaatgccatgcaaaagctatggcatatcaaaattacctcagaaagcagaaga

SEQ ID NO: 546 - protein, 286 aa, Canis familiaris
MQQNNSTTEFILLGLTQDPMKKKTVFVIFFIFYLGTVVGNLLIIVTIKSSRTLGSPMYYFLFYLSLADSCFSTSTAPKLIVDSLSAKNIITYNECMTQVFALHFFGCMEVFVLLLMAFDRYVAICKPLHYTTIMSRRVCTILIVLAWIGSFIHSTAQIILALRLPFCGPHLLLVSNSGAICSSSFVILMISYIVILHSLRNHSAEGRKKALSTCTSHIIVVVLCFGPCIFTYTRPPTTYPMDKMMAVFYTIGTPLVNPLIYTLRNAEVKNAMQKLWHIKITSESRR

SEQ ID NO: 547 - DNA, 930 bp, Canis familiaris
atggagattaggaacaacgtgacagaatttgtgctactggggctcacagagaatccaaagatgcagaaaatcatatttgttgtgtttctggtcatctacatcgtctctgtggtaggaaatgtgctcaccgtggtcactatcactgccagcccattatcggggtcccccatgtactttttcctggcctatctctccctcattgatgcctgctattcttctgtcaatacccccaccctcatcatagagtcactccgtgaaaagaagaccatcccattcaatgcatgcataatccaaatctttggggaacatttctttggaggtgctgatgtcatcctgcttactgtgatggcctatgaccgctatgtggccatctgcaagccactgcactacatgaccatcatgaatcggcggctatgtggcctgctcatggcagtggtgtgggtgggaggctttcttcatgcagccatacagatcctctttatcatcccactacccttctgtggccctaacgtcatagatcactttatatgtgatctgaatcctttgctcaatcttgcctgcactgatacccacactcttgggttctttgttgctgccaacagtggtttcatctgtgtcttaaacttcctcctcctcatggtttcctatgtggtcattctgcgctccctaaagaaccacagcttggaggcgaggcgcaaagccctctccacctgtgtctctcacatcacagtggtcgtcctattctttgtgccctgcatatttgtgtacatgagacccgcagctactttatccattgataaagcagttgcagtgttctatactacaataactcccatgttaaatcctttaatctataccttgagaaatgaccagatgaaaaatgccattaggaaactgtgtagtaggaatgctagtgtgggtgacaaataa

SEQ ID NO: 548 - protein, 309 aa, Canis familiaris
MEIRNNVTEFVLLGLTENPKMQKIIFVVFLVIYIVSVVGNVLTVVTITASPLSGSPMYFFLAYLSLIDACYSSVNTPTLIIESLREKKTIPFNACIIQIFGEHFFGGADVILLTVMAYDRYVAICKPLHYMTIMNRRLCGLLMAVVWVGGFLHAAIQILFIIPLPFCGPNVIDHFICDLNPLLNLACTDTHTLGFFVAANSGFICVLNFLLLMVSYVVILRSLKNHSLEARRKALSTCVSHITVVVLFFVPCIFVYMRPAATLSIDKAVAVFYTTITPMLNPLIYTLRNDQMKNAIRKLCSRNASVGDK

SEQ ID NO: 549 - DNA, 933 bp, Canis familiaris
atgcagcaaaataacagtactactgagttcatactgttaggattgactcaagatcctatgaaaaagaaaatggtatttgtaatatttttcattttttatttgggaactgtggttgggaatttgcttattattgtaaccatcaagtccagccggacacttgggagccccatgtactatttcttattttatttgtcccttgctgattcctgcttctcaacttccacagccccaagactaattgtggattcactctctgcaaaaaatatcataacttacaatgaatgcatgactcaagtctttgcactgcatttctttggctgcatggaggttttagtcctcatccttatggcctttgaccggtatgtggccatctgtaagcccttacattacccaaccatcatgagccggcgggtctgcaccatcctaattgttctggcatggattggatcttttatccattctacagcccagattatcctggctttgagattgcccttctgtggacccaatttgattgatcattactgctgtgatttgcagcccttgctgaaacttgcttgcatggacacttttgtgatcaacctactgttggtgtctaatagcgggggcatttcctcaagcagttttgtgattctgatgatctcctacattgtcatcttgcattcactgcgaaaccacagtgcggaagggaggaaaaaagctctctctacttgcactactcacatcattgtagtaatcatattctttggtccctgtatattcatttatacacgccccccaaccacttaccccatggacaagatggtaactgtattttatactattgggacaccttttctcaacccacttatctacacactgaggaatgcagaagtgaaaaatgccatgagaaagctatggcatatcaatattacctcagaaagcagaagatga

SEQ ID NO: 550 - protein, 310 aa, Canis familiaris
MQQNNSTTEFILLGLTQDPMKKKMVFVIFFIFYLGTVVGNLLIIVTIKSSRTLGSPMYYFLFYLSLADSCFSTSTAPRLIVDSLSAKNIITYNECMTQVFALHFFGCMEVLVLILMAFDRYVAICKPLHYPTIMSRRVCTILIVLAWIGSFIHSTAQIILALRLPFCGPNLIDHYCCDLQPLLKLACMDTFVINLLLVSNSGGISSSSFVILMISYIVILHSLRNHSAEGRKKALSTCTTHIIVVIIFFGPCIFIYTRPPTTYPMDKMVTVFYTIGTPFLNPLIYTLRNAEVKNAMRKLWHINITSESRR

SEQ ID NO: 551 - DNA, 918 bp, Canis familiaris
atggagagaggcaatcatacagtgactgagttcatcctggtgggcttcacgacagacccagtgatgcagctggtcctgtttgtggtattccttggcgtgtactctctgactgtggtagcaaatgccaccctcatagttttgatctgtaatgactcccggctgcacacacccatgtattttttcattgggaatctatcttttctggatctctggtattcctctgtctacactccgaaaatcctcatgacctgcatctctgaagacaaaagcatctcctttgctggctgtgtatgtcagttcttcttctctgcagggctggcatatactgagtgttacctgttggctgccatggcttatgaccgctatatggccatctcaaagccactgcgctatgctcaggccatgtctataaagctgtgtgcatttttggtagcatcctcatatcttggtgcttttattaactcttctatcatcaccaaaagaacttttgccttagacttctgtagtggcaatgttattgatgactttttttgtgatttgctgcccctggtgaagttggcttgtggcagaaaagatggctaccaggctatactgtacttccttctggcctccaatgtcatcacccctacagtgctcatcctagcctcctacctgttcatcattggcgccatcttgaggatccgctccacccagggccgcctcaaagccttctctacatgttcctcacacctggtctctgtcaccttgtactatggctccattctctacatctactctcgtccccgatctagctattctttggacacagacaaaatagtttccacattttatactgtggtgttccccatgctgaatcctatgatctatagcctgaggaataaggatgtgaaagaggctctgaataaactcattaaataa

SEQ ID NO: 552 - protein, 305 aa, Canis familiaris
MERGNHTVTEFILVGFTTDPVMQLVLFVVFLGVYSLTVVANATLIVLICNDSRLHTPMYFFIGNLSFLDLWYSSVYTPKILMTCISEDKSISFAGCVCQFFFSAGLAYTECYLLAAMAYDRYMAISKPLRYAQAMSIKLCAFLVASSYLGAFINSSIITKRTFALDFCSGNVIDDFFCDLLPLVKLACGRKDGYQAILYFLLASNVITPTVLILASYLFIIGAILRIRSTQGRLKAFSTCSSHLVSVTLYYGSILYIYSRPRSSYSLDTDKIVSTFYTVVFPMLNPMIYSLRNKDVKEALNKLIK

SEQ ID NO: 553 - DNA, 933 bp, Canis familiaris
atgcagcaaaataacagaactactgagttcatactgttaggattgactcaagatcctatgaaaaagaaaatggtatttgtaatatttttcattttttatttgggaactgtggttgggaatttgcttattattgtaaccatcaagtccagccggacacttgggagccccatgtactatttcttattttatttgtcccttgctgattcctgcttctcaacttccacagccccaagactaattgtggattcactctctgcaaaaaatatcataacttacaatgaatgcatgactcaagtctttgcactgcatttctttggctgcatggaggttttagtcctcatccttatggcctttgaccggtatgtggccatctgtaagcccttacattacccaaccatcatgagccggcgggtctgcaccatcctaattgttctggcatggattggatcttttatccattctacagcccagattatcctggctttgagattgcccttctgtggacccaatttgattgatcattactgctgtgatttgcagcccttgctgaaacttgcttgcatggacacttttgtgatcaacctactgttggtgtctaatagcgggggcatttcctcaagcagttttgtgattctgatgatctcctacattgtcatcttgcattcactgcgaaaccacagtgcggaagggaggaaaaaagctctctctacttgcactactcacatcattgtagtaatcatattctttggtccctgtatattcatttatacacgccccccaaccacttaccccatggacaagatggtaactgtattttatactattgggacaccttttctcaacccacttatctacacactgaggaatgcagaagtgaaaaatgccatgagaaagctatggcatatcaatattacctcagaaagcagaagatga

SEQ ID NO: 554 - protein, 310 aa, Canis familiaris
MQQNNRTTEFILLGLTQDPMKKKMVFVIFFIFYLGTVVGNLLIIVTIKSSRTLGSPMYYFLFYLSLADSCFSTSTAPRLIVDSLSAKNIITYNECMTQVFALHFFGCMEVLVLILMAFDRYVAICKPLHYPTIMSRRVCTILIVLAWIGSFIHSTAQIILALRLPFCGPNLIDHYCCDLQPLLKLACMDTFVINLLLVSNSGGISSSSFVILMISYIVILHSLRNHSAEGRKKALSTCTTHIIVVIIFFGPCIFIYTRPPTTYPMDKMVTVFYTIGTPFLNPLIYTLRNAEVKNAMRKLWHINITSESRR

SEQ ID NO: 555 - DNA, 933 bp, Canis familiaris
atgcagcaaaataacagtactactgagttcatactgttaggattgacccaagatcctatgaaaaagaaaacggtatttgtaatatttttcattttttatttgggaactgtggttgggaatttgcttattattgtgaccatcaagtccagccggacacttgggagccccatgtactatttcttattttatttgtcccttgctgattcctgcttttcaacttccacagccccaagactaattgtggattcactctctgcaaaaaatatcataacttacaatgaatgcatgactcaagtctttgcactgcatttctttggttgcatggaggtttttgtcctcctcctcatggcctttgaccggtatgtggccatctgtaagcccttacattacccaaccatcatgagccggcgggtttgcaccatcctaattgttctggcatgggttggatcttttatccattctatagcccagattatcctggctttgagattgcccttctgtggacccaatttgattgatcattactgctgtgatttgcagcccttgctgaaacttgcttgcatggacacttataagatcaacctactgttggtttctaatagtggggccatttgctcaagcagttttgtgattctgatgatctcctacattgtcatcttgcattccctgcgaaaccacagtgcagaagggaggaaaaaagctctctctacttgcacttctcacatcatcgtagtagtcttatgctttggtccctgtatattcacatatacacgccccccaaccacttaccccatggacaagatgatggccgtgttttatactattgggacaccgcttgtcaacccactcatctacacactgaggaatgcagaagtgaaaaatgccatgcaaaagctatggcatatcaaaattacctcagaaagcagaagatga

SEQ ID NO: 556 - protein, 310 aa, Canis familiaris
MQQNNSTTEFILLGLTQDPMKKKTVFVIFFIFYLGTVVGNLLIIVTIKSSRTLGSPMYYFLFYLSLADSCFSTSTAPRLIVDSLSAKNIITYNECMTQVFALHFFGCMEVFVLLLMAFDRYVAICKPLHYPTIMSRRVCTILIVLAWVGSFIHSIAQIILALRLPFCGPNLIDHYCCDLQPLLKLACMDTYKINLLLVSNSGAICSSSFVILMISYIVILHSLRNHSAEGRKKALSTCTSHIIVVVLCFGPCIFTYTRPPTTYPMDKMMAVFYTIGTPLVNPLIYTLRNAEVKNAMQKLWHIKITSESRR

SEQ ID NO: 557 - DNA, 933 bp, Canis familiaris
atgcaacaaaataacagcgttactgagttcatactgttaggattgactcaagatcctatgaaaaagaaaatggtatttataatattcttcattttatatatgggaactgtggtagggaatttgcttattattgtgaccatcaggtttagtcggacacttgggacccccatgtactatttcttattttatttgtctcttgcggattcctgcttttcaacttccacagcccccagactaattgtggattcactctctgcaaaaaaaatcataacttacaatgagtgtatgactcaggtctttgcactacatttctttggttgcatggaggtctttgtcctcatcctcatggccattgatcgctatgtggccatctgtaagcccttacgttacccaaccatcatgagccggcaggtctgcactatcatgattgttctcgcatggataggatcttttttccattctatagccgaggttgtcccagccttgagattgcccttctgtggacccaatttgattgatcattactgctgtgatttgcaacccttgctgaaacttgcttgcatggacacttatctgattaacctagaatgggtgtctaatagcggggccatttgcacaggcagttttgtgattctgatgatctcctatattgtcatcttgcattcactgagaaactatagtgcagaagggaagaaaaaagctctctctacttgcacttctcacatcatcgtagtaatcatattctttggtccgtgtatattcacatacacacgccccccaaccacttaccccatggacaagatggtggctgtattttatactattgggacaccttttctcaacccactcatctatacactgagaaatgcagaagtgaaaaatgccatgagaaagctatggcgtgtcaaaattacctcagagagcagaagatga

SEQ ID NO: 558 - protein, 310 aa, Canis familiaris
MQQNNSVTEFILLGLTQDPMKKKMVFIIFFILYMGTVVGNLLIIVTIRFSRTLGTPMYYFLFYLSLADSCFSTSTAPRLIVDSLSAKKIITYNECMTQVFALHFFGCMEVFVLILMAIDRYVAICKPLRYPTIMSRQVCTIMIVLAWIGSFFHSIAEVVPALRLPFCGPNLIDHYCCDLQPLLKLACMDTYLINLEWVSNSGAICTGSFVILMISYIVILHSLRNYSAEGKKKALSTCTSHIIVVIIFFGPCIFTYTRPPTTYPMDKMVAVFYTIGTPFLNPLIYTLRNAEVKNAMRKLWRVKITSESRR

SEQ ID NO: 559 - DNA, 936 bp, Canis familiaris
atggaaaaaaggaataatgtaactgagttcattttctggggtctttctcagaacctagaggttgaagaagtttgtttcgtggtgttttctttcttctatacggtcattcttcttggcaacctcctcatcatgctgactgtttacatgggcaaccttttcaagtttcccatgtatttcttcctcaactacttgtcttttgtggatatttgttactcttcagtcacagctcccaagatgattgttgatctattagccaagagcaaaactatttcctatgtcgggtgcatgttgcaactctttggagtacatttctttggttgcacagagatcttcatccttactgtaatggcctatgatcgttacgtggctatctgtaaacccctacactataccaccatcatggaccggaacagatgcaataaaatgttgttgggaacctggataggagggttcttacactccattatccaggtggctctggtagttcagttacccttttgtggacccagtgagatcgatcactacttttgtgatgtccaccctgtgttgaaacttgcctgcacagatacatatattgttggtgttgtggtgacagccaacagtggtaccattgctctagggagctttgttatcttgataatttcctatactgtcatcctggtgtccctgagaaaacactcagcagaaggtaggcgcaaagcactctccacctgtggctcccacattgctgtggtcataatcttttttggcccatgtactttcatgtacatgcgccctgatactaccttttcagaggataagatggtagctgtattttacaccattatcacccccatgttaaatcctctgatctatacactcagaaatgcagaaataaaaaatacaataaaaagactgtggggcaggaaggttttctcagaggctaacgataaatag

SEQ ID NO: 560 - protein, 311 aa, Canis familiaris
MEKRNNVTEFIFWGLSQNLEVEEVCFVVFSFFYTVILLGNLLIMLTVYMGNLFKFPMYFFLNYLSFVDICYSSVTAPKMIVDLLAKSKTISYVGCMLQLFGVHFFGCTEIFILTVMAYDRYVAICKPLHYTTIMDRNRCNKMLLGTWIGGFLHSIIQVALVVQLPFCGPSEIDHYFCDVHPVLKLACTDTYIVGVVVTANSGTIALGSFVILIISYTVILVSLRKHSAEGRRKALSTCGSHIAVVIIFFGPCTFMYMRPDTTFSEDKMVAVFYTIITPMLNPLIYTLRNAEIKNTIKRLWGRKVFSEANDK

SEQ ID NO: 561 - DNA, 900 bp, Canis familiaris
ttgggacatgaaaatatcacagaatttaatctcttgggactttttagtgatgaggatgcaaaggccgcctgctttgtgctgttcgtactttgctacattgcaattctctcaggaaacttgctctatcttctcacaatcaggggcagccgtctccgtgaacagctcatgtactttttcctgagctacctatcttttatggatgtctgcttcacttcagacctactggcccagcagaagaccatctcctacaatggctgcatggcccagatgttttatgcccatttttttggtgccactgagatcttcatcttggtggccatggcctatgaccgatatgcagccatctgcagaccccttcactatatggtcatcatgagcagacaggtgtgctatgtccttgtaatggcctcaattctcggagcatttacccattcaatcatgcaagtattgattgttattgaacttcccttctgtggccccaatcagatagaccactatttctgtgatgttttccccttgctgaagctggcctgcatggatactagcttgttggttattgtgatcattactaccacaggagtgctgtccattttgacctttgttgccttggtaatttcttacatcatcatcctgtctaccctgaggacctactcatcccagggctgccgcaaagccctctctacctgtggctcacacatcactgttgtgttcatgttcttcttgcctctcatcttcacatatgtccccatggcggattccgtcagtaatgacaaagtgtttgccctattttataccatgattgctcccatgttcaaccctctcatctacacattgagaaacacagacatgaagaatgccatgaggaaaatgtggtgccgggatgcacggtttgaagggaaa

SEQ ID NO: 562 - protein, 300 aa, Canis familiaris
LGHENITEFNLLGLFSDEDAKAACFVLFVLCYIAILSGNLLYLLTIRGSRLREQLMYFFLSYLSFMDVCFTSDLLAQQKTISYNGCMAQMFYAHFFGATEIFILVAMAYDRYAAICRPLHYMVIMSRQVCYVLVMASILGAFTHSIMQVLIVIELPFCGPNQIDHYFCDVFPLLKLACMDTSLLVIVIITTTGVLSILTFVALVISYIIILSTLRTYSSQGCRKALSTCGSHITVVFMFFLPLIFTYVPMADSVSNDKVFALFYTMIAPMFNPLIYTLRNTDMKNAMRKMWCRDARFEGK

SEQ ID NO: 563 - DNA, 933 bp, Canis familiaris
atgcacctgaataataatgtgactgagttcattctgcttggattgacccaggatcctgttaggaaaaaaatagtgtttgtcacttttttgtttttctatttggggacattgctgggtaactttctgattattactactatcaagaccagccagacactagggagtccaatgtacttcttccttttccacctatccttgtctgacacctgcttctgtacttccatagcccctagaatgattgttgatgcacttttgaaaagggccacaatctctttcagggagtgcatgatacaagtcttttcattccacttctttggctgcctggagatcttcatccttatcctcatggctgctgaccgctatgtggccatctgtaagcccctgcactacacaaccatcatgagtcgacaggtctgtgctgtgctggtggctattgcctgggtggggtcctgtgtgcattctttagctcagatttttctggccctgagtttacctttctgtggtcccaatgtgatcgatcactatcattgtgacttgcagcccttgttgaaacttgcctgtgcagatacccatgtgatcaatctactgttggtatccaatagtggggccatttgtacactgagttttgtcatgctgatgtgctcctatgttgtcatcttgtattctctgagaaatcacagtgctgaagggaggaggaaagccctctccacctgcatgtcccacatcattgtagtcgtcttgttctttggtccttgcatatttctatacacacgccctgcaaccacctttcccatggataagatgatagctgtattttatacacttggaacacctttgatcaatcctctgatttacacacttaggaatgcagaagtgaaaaatgccatgaagaagttatggaggaagaagttgatttcagatgacaaaagatga

SEQ ID NO: 564 - protein, 310 aa, Canis familiaris
MHLNNNVTEFILLGLTQDPVRKKIVFVTFLFFYLGTLLGNFLIITTIKTSQTLGSPMYFFLFHLSLSDTCFCTSIAPRMIVDALLKRATISFRECMIQVFSFHFFGCLEIFILILMAADRYVAICKPLHYTTIMSRQVCAVLVAIAWVGSCVHSLAQIFLALSLPFCGPNVIDHYHCDLQPLLKLACADTHVINLLLVSNSGAICTLSFVMLMCSYVVILYSLRNHSAEGRRKALSTCMSHIIVVVLFFGPCIFLYTRPATTFPMDKMIAVFYTLGTPLINPLIYTLRNAEVKNAMKKLWRKKLISDDKR

SEQ ID NO: 565 - DNA, 915 bp, Canis familiaris
atggtgatgaatagcactgtgaatgaattcattctgtttggcttgacacaggatccaagaaaacagaaagcaatatttggggtcttcttgatgctttatcttgccacactgttgggaaactttctcattgtagtgactattaaaagaagcaggacccttgggagtcccatgtacttcttcctattttacctgtcctttgctgatgcttgcctctctacaaccatttcccccagattgattgtggatgccatttctcagaggaagaccatttcctacaaggagtgcatggctcaggtctttacaggccacttctttggatgcacggaaatcttcgtgctgatcgtcatggcttttgatcgctatgtagccatttgtaagcccttgcgatacacaaccatcatgaacaggcatgtctgcagtgtgctggtgattctgggttgggtgggatcctgtatccactcttcagcacaaattgtcctggctttgagattgcctttctgtggtcccaatgtgattgatcactatttctgtgacttgcagcccttgttgaaacttgcttgcatggacacttatgtaataaatttgctagttgtttctaacagtggagccatatgcacagtgagtttcataatcctgcttatctcctatgttatcatcttgtactctctgagaaactacagtgcagaaggaaggcgaaaagccctttcaacctgcacctcccattttattgtggttgtcctattttttggcccatgtatattcatatatacacgtccggcaaccacatttccagtagacaaggtggtggctgtgttttataccactggggcacccttgctcaaccctctgatctatacactgaggaatgcagaagtgaaaaatgccatgaaaaagttatggtgtaacaaagtgtga

SEQ ID NO: 566 - protein, 304 aa, Canis familiaris
MVMNSTVNEFILFGLTQDPRKQKAIFGVFLMLYLATLLGNFLIVVTIKRSRTLGSPMYFFLFYLSFADACLSTTISPRLIVDAISQRKTISYKECMAQVFTGHFFGCTEIFVLIVMAFDRYVAICKPLRYTTIMNRHVCSVLVILGWVGSCIHSSAQIVLALRLPFCGPNVIDHYFCDLQPLLKLACMDTYVINLLVVSNSGAICTVSFIILLISYVIILYSLRNYSAEGRRKALSTCTSHFIVVVLFFGPCIFIYTRPATTFPVDKVVAVFYTTGAPLLNPLIYTLRNAEVKNAMKKLWCNKV

SEQ ID NO: 567 - DNA, 927 bp, Canis familiaris
atgggacatgaaaatatcacagaattcattctcttgggactttttagtgataaagatgagaagaccgcctgttttgtgctgttcgtactttgctacattgcaattctctcaggaaacttgctcattcttctcacaatcaggggcagccgcctccgtgaacagcccatgtactttttcctgagctacctatctttcatggatgtctgcttcacttccacagtggcccccaaactgatcatagacctactggcccagcagaagaccatctcctacaatggctgcatggcccagatgttttatgcccatttttttggtgccactgagatcttcatcttggtggccatggcctatgaccgatatgcagccatctgcagaccccttcactatatggtcatcatgagcagacaggtgtgctatgtccttgtaatggcctcaattctcggagcatttacccattcaatcatgcaagtattgattgttattgaacttcccttctgtggccccaatcagatagaccactatttctgtgatgttttccccttgctgaagctggcctgcatggatactagcttgttggttattgtgatcattactaccacaggagtgctgtccattttgacctttgttgccttggtaatttcttacatcatcatcctgtctaccctgaggacctactcatcccagggctgccgcaaagccctctctacctgtggctcacacatcactgttgtgttcatgttcttcttgcctctcatcttcacatatgtccccatggcggattccgtcagtaatgacaaagtgtttgccctattttataccatgattgctcccatgttcaaccctctcatctacacattgagaaacacagacatgaagaacgccatgaggaaaatgtggtgccgggatgcacggtttgaagggaaatga

SEQ ID NO: 568 - protein, 308 aa, Canis familiaris
MGHENITEFILLGLFSDKDEKTACFVLFVLCYIAILSGNLLILLTIRGSRLREQPMYFFLSYLSFMDVCFTSTVAPKLIIDLLAQQKTISYNGCMAQMFYAHFFGATEIFILVAMAYDRYAAICRPLHYMVIMSRQVCYVLVMASILGAFTHSIMQVLIVIELPFCGPNQIDHYFCDVFPLLKLACMDTSLLVIVIITTTGVLSILTFVALVISYIIILSTLRTYSSQGCRKALSTCGSHITVVFMFFLPLIFTYVPMADSVSNDKVFALFYTMIAPMFNPLIYTLRNTDMKNAMRKMWCRDARFEGK

SEQ ID NO: 569 - DNA, 933 bp, Canis familiaris
atgcacctgaataataatgtgactgagttcattctgcttggattgacccaggatcctgttagaaaaaaaatagtgtttgtcacttttttgtttttctatttggggacattgctgggtaactttctgattattactactatcaagaccagccagacactagggagtccaatgtacttcttccttttccacctatccttgtctgacacctgcttctgtacttccatagcccctagaatgattgttgatgcacttttgaaaagggccacaatctctttcagggagtgcatgatacaagtcttttcattccacttctttggctgcctggagatcttcatccttatcctcatggctgctgaccgctatgtggccatctgtaagcccctgcactacacaaccatcatgagtcgacaggtctgtgctgtgctggtggctattgcctgggtggggtcctgtgtgcattctttagctcagatttttctggccctgagtttacctttctgtggtcccaatgtgatcgatcactatctttgtgacttgcagcccttgttgaaacttgcctgtgcagatacctatgtgatcaatctactgttgatatccaatagtggggccatttgtacactgagttttgtcatgctgatgtgctcctatgttgtcatcttgtattctctgagaaatcacagtgctgaagggaggaggaaagccctctccacctgcatctcccacatcattgtagtcgtcttgttctttggtccttgcatatttatatacacacgccctgcaaccacctttcccatggataagatgatagctgtattttatacacttggaacacctttgatcaatcctctgatttacacacttaggaatgcagaagtgaaaaatgccatgaagaagttatggaggaagaagttgatttcagatgacaaaagatga

SEQ ID NO: 570 - protein, 310 aa, Canis familiaris
MHLNNNVTEFILLGLTQDPVRKKIVFVTFLFFYLGTLLGNFLIITTIKTSQTLGSPMYFFLFHLSLSDTCFCTSIAPRMIVDALLKRATISFRECMIQVFSFHFFGCLEIFILILMAADRYVAICKPLHYTTIMSRQVCAVLVAIAWVGSCVHSLAQIFLALSLPFCGPNVIDHYLCDLQPLLKLACADTYVINLLLISNSGAICTLSFVMLMCSYVVILYSLRNHSAEGRRKALSTCISHIIVVVLFFGPCIFIYTRPATTFPMDKMIAVFYTLGTPLINPLIYTLRNAEVKNAMKKLWRKKLISDDKR

SEQ ID NO: 571 - DNA, 927 bp, Canis familiaris
atggagaatccaaaaaatgtgactgaattcattcttttgggcattacagagaacccagagctgcggaaaatgctctctgctgtgtttctaatcatgtatgtgtccacggttttgggaaacctagtaattgtggtaactgtgatcacaagtcagagtctgagatcacctatgtattttttccttattttcttatcccttttggatgttacctactcttctgtcattgcccccaagatgattgtggactccctctccaagagcactgtcatctccttagaaggttgcatggcgcagctctttgcagagcatttctttggtggtgtggggatcatccttctcatcgtgatggcctatgaccgctacgtggccatctgtaagcccctgcactacttgaccatcatgagccctcggatgtgctgcctgctgctgggaggggcctgggtggggggatttatccatgcagcaatacagcttctcttcatgtatcaaatacccttctgtggccccaatgtcattgatcattttatatgcgatttgtttcccttgttgaaactggcctgcatggacacccacaccctgggtctcctagtcatcctcaacagtggggtgatgtgtatgaccatcttccttattctcattgcctcctacgtggtcatcctctgctctctgaagtcttgcagctctgaagggcggcgcaaagccttctccacctgtggctcccacctcaccgtggttgtcttgttctttgtgccatgcattttcctgtacgtgcggcctgtggccacctaccccattgacaaggcaatggctgtgtctgattccatcatcacacccatgttaaatcccttgatctacaccctgaggaattcagaggtgaaaaatgccatgaggaaactggggaaacaaaggagttttgttggcaagtga

SEQ ID NO: 572 - protein, 308 aa, Canis familiaris
MENPKNVTEFILLGITENPELRKMLSAVFLIMYVSTVLGNLVIVVTVITSQSLRSPMYFFLIFLSLLDVTYSSVIAPKMIVDSLSKSTVISLEGCMAQLFAEHFFGGVGIILLIVMAYDRYVAICKPLHYLTIMSPRMCCLLLGGAWVGGFIHAAIQLLFMYQIPFCGPNVIDHFICDLFPLLKLACMDTHTLGLLVILNSGVMCMTIFLILIASYVVILCSLKSCSSEGRRKAFSTCGSHLTVVVLFFVPCIFLYVRPVATYPIDKAMAVSDSIITPMLNPLIYTLRNSEVKNAMRKLGKQRSFVGK

SEQ ID NO: 573 - DNA, 933 bp, Canis familiaris
atggatatgataaaaacaaacttcactgtgactgagtttgtgttcttggggctgtcatctcagccaaagatgcagctcattctttttattatgttcttgttcttctatttattaacagttgtggggaatattataattatcactattatccagatagaacctcgtctccaaacccccatgtacttcttccttactaatttatcctttctggacatctgctacacatccaccaatgtcccacaaatgctgtccaacatgatgggaaaaaagaccatccccttctctagctgtgctactcagatgtacttctccctctcctttggaatgattgaatgtgttctccttggggtcatggcttatgacagatatgtagccatttgtcatcctctccattatactgtcattatgaaccaaagcatctgtgtccaattggcagccatttcttggtccagtagcttcctgagttccatggttatcaatgtcctcaccttgagtttgccctactgtgggcccaatgtcctgaatcactttttttgtgaggttccttctgtcttgaggttagcttgcactgacacctcatttacagagctggttgtctttatcttcagtatcatcattgtcttcatcccttttctcctcattgttgtttcctatgcccgaatccttctatcagttctcaggatacggtcagcctccgggaggcacaaagcactatccacttgtgcctcccatctgacagtggtggccttattctatggaactgccatctttatgtacatgagaccccagtcgaagtcctccagggctgggggcaagatcattgcagtgttctacactgtgatcacacccatgctcaaccccttgatctatagcctaaggaaccaggatgtgaaaggcgctttaaggagagctattgcaaaacggaggacatga

SEQ ID NO: 574 - protein, 310 aa, Canis familiaris
MDMIKTNFTVTEFVFLGLSSQPKMQLILFIMFLFFYLLTVVGNIIIITIIQIEPRLQTPMYFFLTNLSFLDICYTSTNVPQMLSNMMGKKTIPFSSCATQMYFSLSFGMIECVLLGVMAYDRYVAICHPLHYTVIMNQSICVQLAAISWSSSFLSSMVINVLTLSLPYCGPNVLNHFFCEVPSVLRLACTDTSFTELVVFIFSIIIVFIPFLLIVVSYARILLSVLRIRSASGRHKALSTCASHLTVVALFYGTAIFMYMRPQSKSSRAGGKIIAVFYTVITPMLNPLIYSLRNQDVKGALRRAIAKRRT

SEQ ID NO: 575 - DNA, 915 bp, Canis familiaris
atggtgatgaatagcactgtgaatgaattcattctgtttggcttgacacaggatccaagaaaacagaaagcagtatttggggtcttcttgatgttttaccttgccacactgttgggaaactttctcattgtagtgactattaaaagaagcaggacccttgggagtcccatgtacttcttcctattttacctgtcttttactgatgcttgcctctctaccaccattgcccccagattgattgtggatgccatttctcagaggaagaccatttcctacaatgagtgcatgactcaagtcttttcagcccacttctttggatgcatggaaatcttcgtgctgatcctgatggcttttgatcgctatgtagccatttgtaagcccttgcgatacacaaccatcatgaacaggcatgtctgcagtgtgctggtgattctgggttgggtgggatcctgtatccactcttcagcacaaattttcctggcttcgagattgcctttctgtggtcccaatgtgattgatcactatttctgtgacttgcagcccttgttgaaacttgcttgcatggacacttatgtaataaatttgctagttgtttctaacagtggagccatatgcacggtgagtttcataattctgcttatctcctatgttatcatcttgtactctctgagaaactacagtgcagaaggaaggcgaaaagccctttcgacctgcacctcccattttattgtggttgtcctattttttggcccatgtatattcatatatacacgtccggcaaccacatttccagtagacaaggtggtggctgtgttttatacctttgggacacccttgctgaaccctctgatctatacactgaggaatgcggaagtgaaaaatgccatgaaaaagttatggtgtagcaaagtgtga

SEQ ID NO: 576 - protein, 304 aa, Canis familiaris
MVMNSTVNEFILFGLTQDPRKQKAVFGVFLMFYLATLLGNFLIVVTIKRSRTLGSPMYFFLFYLSFTDACLSTTIAPRLIVDAISQRKTISYNECMTQVFSAHFFGCMEIFVLILMAFDRYVAICKPLRYTTIMNRHVCSVLVILGWVGSCIHSSAQIFLASRLPFCGPNVIDHYFCDLQPLLKLACMDTYVINLLVVSNSGAICTVSFIILLISYVIILYSLRNYSAEGRRKALSTCTSHFIVVVLFFGPCIFIYTRPATTFPVDKVVAVFYTFGTPLLNPLIYTLRNAEVKNAMKKLWCSKV

SEQ ID NO: 577 - DNA, 915 bp, Canis familiaris
atgtcaatgaatagcagcgtgaatgaattcattctgcttggcttgacacaggatccaagaaaacagaaagcaatatttggggtcttcttaatgctttaccttgccacactgttgggaaactttctcattgtagtgactattaaaagaagcaggactcttgggagtcccatgtacttcttcctattttacctgtcctttgctgatgcctgcttctctacaaccattgcccccagattgattgtggatgccatttcccagcagaagaccatttcctacaatgagtgcatgactcaggtcttttcagcccacttctttgcttgcatggaaatcttcgtgctgatcctcatggcttttgatcgctatgtagccatttgtaagcccttgcgatacacaaccatcatgaacaggcatgtctgcagtgtgctggtgattctgggttgggtgggatcctgtatccactcttcagcacaaattttcctggcttcgagattgcctttctgtggtcccaatgtgattgatcactatttctgtgatttacagcccttgttgaaacttgcttgcatggatacttatgtaataaatttgctagttgttactaatagtggagccatatgcttggtgagtttcataatcttgcttatctcctatgttgtcatcttgtactctctgagaaaccacagtgcagaaggaaggcgaaaagccctttcaacctgcacctcccattttattgtggttgtcctattttttggcccatgtatattcatgcatacacgcccggcaaccacatttccagtagacaaggtggtggcagtgttttataccattgggacacccttgctgaaccctctgatctatacactgaggaatgcggaagtgaaaaatgccatgaaaaagttatggtgtagcaaagggtga

SEQ ID NO: 578 - protein, 304 aa, Canis familiaris
MSMNSSVNEFILLGLTQDPRKQKAIFGVFLMLYLATLLGNFLIVVTIKRSRTLGSPMYFFLFYLSFADACFSTTIAPRLIVDAISQQKTISYNECMTQVFSAHFFACMEIFVLILMAFDRYVAICKPLRYTTIMNRHVCSVLVILGWVGSCIHSSAQIFLASRLPFCGPNVIDHYFCDLQPLLKLACMDTYVINLLVVTNSGAICLVSFIILLISYVVILYSLRNHSAEGRRKALSTCTSHFIVVVLFFGPCIFMHTRPATTFPVDKVVAVFYTIGTPLLNPLIYTLRNAEVKNAMKKLWCSKG

SEQ ID NO: 579 - DNA, 915 bp, Canis familiaris
atgtcaatgaacagcagtgtgaatgaattcattttgcttggcttgacacaggatccaagaaaacagaaagcaatatttggggtcttcttgatgttttaccttgccacactgttgggaaactttctcattgtagtgactattaaaagaagcaggacccttgggagtcccatgtacttcttcctattttacctgtcctttgctgatgcctgcttttctacaaccattgcccccaggttgattgtggatgccatttcccagcagaagactatttcctacaatgagtgcatgactcaggtctttgcagtccacttctttgcttgcatgggaatcttcgtgctgatcctcatggcttttgatcgctatgtagctatttgtaagcccttgcgatacacaaccatcatgaacaggcatgtctgcagtgtgctggtgactctgggttgggtgggatcctgtatccactcttcagcacaaattgtcctggctttgaaattgcctttctgtggtcccaatatgattgatcactatttctgtgacttgcagcccttgttgaaacttgcttgcatggacacttatgtaataaatttgctagttgttactaacagtggagccatatgcatggtgagtttcataatcttgcttatctcctatgttatcatcttgtactctctgagaaactacagtgcagaaggaaggcgaaaagccctttcaacctgcacttcccattttattgtggttgtcttatgttttggcccatgtatattcatttatacacgtccagcaaccacatttccagtagacaaggtggtggcagtgttttataccattgggacacccttgctgaaccctctgatctacacactgaggaatgcagaagtgaaaattgcaatgaaaatgttatggtgtagcaaagtatga

SEQ ID NO: 580 - protein, 304 aa, Canis familiaris
MSMNSSVNEFILLGLTQDPRKQKAIFGVFLMFYLATLLGNFLIVVTIKRSRTLGSPMYFFLFYLSFADACFSTTIAPRLIVDAISQQKTISYNECMTQVFAVHFFACMGIFVLILMAFDRYVAICKPLRYTTIMNRHVCSVLVTLGWVGSCIHSSAQIVLALKLPFCGPNMIDHYFCDLQPLLKLACMDTYVINLLVVTNSGAICMVSFIILLISYVIILYSLRNYSAEGRRKALSTCTSHFIVVVLCFGPCIFIYTRPATTFPVDKVVAVFYTIGTPLLNPLIYTLRNAEVKIAMKMLWCSKV

SEQ ID NO: 581 - DNA, 915 bp, Canis familiaris
atggcgatgaacagcagtgtgaatgaattcattctgtttggcttgacacaggatccaagaaaacagaaagcaatatttggggtcttcttgatgttttaccttgccacactgttgggaaactttctcattgtagtgactattaaaagaagcaggacccttgggagtcccatgtacttcttcctattttacctgtcctttgctgatgcctgcttctctacaaccacagctcccaggttgattgtggatgccatttcccagcagaagactatttcctacaatgagtgcatgactcaggtcttttcagcccatttctttggatgcatggaaatcttcgtgctgatcctgatggcttttgatcgctatgtagccatttgtaagcccttgcgttacacaaccatcctgaacaggcatgtctgcagtgtactggtgattctgggttgggtgggatcctgtatccactcttcggcacaaattgtcctggctttgagattgcctttctgtggtcccaatgtgattgatcactatttctgtgacttgcagcccttgctgaaacttgcttgcatggacacttatgtaataaatttgctagttgtttctaacagtggagccatatgcacggtgagtttcataatcctgcttatctcctatgttatcatcttgtactctctgagaaactacagtgcagaaggaaagcgaaaagccctttcgacctgcacctcccattttattgtggttgtcctattttttggtccatgtatattcatgtatacacgcccagcaaccacatttccagtagacaaggtggtggcagtgttttataccattggggcacccttgctgaaccctctgatctatacactgaggaatgcggaagtgaaaaatgccatgaaaaagttatggtgtagcaaattgtga

SEQ ID NO: 582 - protein, 304 aa, Canis familiaris
MAMNSSVNEFILFGLTQDPRKQKAIFGVFLMFYLATLLGNFLIVVTIKRSRTLGSPMYFFLFYLSFADACFSTTTAPRLIVDAISQQKTISYNECMTQVFSAHFFGCMEIFVLILMAFDRYVAICKPLRYTTILNRHVCSVLVILGWVGSCIHSSAQIVLALRLPFCGPNVIDHYFCDLQPLLKLACMDTYVINLLVVSNSGAICTVSFIILLISYVIILYSLRNYSAEGKRKALSTCTSHFIVVVLFFGPCIFMYTRPATTFPVDKVVAVFYTIGAPLLNPLIYTLRNAEVKNAMKKLWCSKL

SEQ ID NO: 583 - DNA, 915 bp, Canis familiaris
atggcgatgaacagcagtgtgaatgaattcattctgtttggcttgacacaggatccaagaaaacagaaagcaatatttggggtcttcttgatgttttaccttgccacactgttgggaaactttctcattgtagtgactattaaaagaagcaggacccttgggagtcccatgtacttcttcctattttacctgtcctttgctgatgcctgcttctctacaaccacagctcccaggttgattgtagatgccatttctcagcagaagaccatttcctacaacgagtgcatgactcaggtgttttcagcccatttctttggatgcatggaaatcttcgtgctgatactgatggctttggatcgctatgtagccatttgtaagcccttgcgatacacaaccatcatgaacaggcatgtctgcagtgtgctggtgattctgggttgggtgggatcctgtatccactcttcggcacaaattgtcctggctttgagattgcctttctgtggtcccaacgtgattgatcactatttctgtgacttgcagcccttgttgaaacttgcttgcatggacacttatgtaataaatttgctagttgttactaacagtggagccatatgcatggtgagtttcataattctgcttatctcctatgttatcatcttgtactctctgagaaactacagtgcagaaggaaggcgaaaagccctttcgacctgcacctcccattttattgtggttgtcctattttttggcccatgtatattcatatatacacgcccagcaaccacatttccagtagacaaggtggtggctgtgttttataccattgggacacccttgctcaaccctctgatctacacactgagaaatgcggaagtgaaaattgccatgaaaatgttatggtgtagcaaagtatga

SEQ ID NO: 584 - protein, 304 aa, Canis familiaris
MAMNSSVNEFILFGLTQDPRKQKAIFGVFLMFYLATLLGNFLIVVTIKRSRTLGSPMYFFLFYLSFADACFSTTTAPRLIVDAISQQKTISYNECMTQVFSAHFFGCMEIFVLILMALDRYVAICKPLRYTTIMNRHVCSVLVILGWVGSCIHSSAQIVLALRLPFCGPNVIDHYFCDLQPLLKLACMDTYVINLLVVTNSGAICMVSFIILLISYVIILYSLRNYSAEGRRKALSTCTSHFIVVVLFFGPCIFIYTRPATTFPVDKVVAVFYTIGTPLLNPLIYTLRNAEVKIAMKMLWCSKV

SEQ ID NO: 585 - DNA, 912 bp, Canis familiaris
atgtcagtgaatagcagtgtgaatgaattcattctgcttggcttgacacaggatccaagaaaacagaaagcaatatttggggtcttcttgatgttttaccttgccacactgttgggaaactttctcattgtagtgactattaaaagaagcaggacccttgggagtcccatgtacttcttcctattttacctgtcctttgctgatgcctgcttttctacaaccacagctcccaggttgattgtggatgccatttcccagcagaagactatttcctacaatgagtgcatgactcaggtctttgcatcccatttctttggttgcatgggaatctttgtgctgatcctcatggcttttgatcgctatgtagctatttgtaagcccttgcgatacacaaccatcatgaacaggcatgtctgcagtgtgctggtgattctgggttgggtgggatcctgtatccactcttcagcacaaattgtcctggctttgagattgcctttctgtggtcccaatatgattgatcactatttctgtgacttgcagcccttgttgaaacttgcttgcatggacacttatgtaataaatttgctagttgttactaacagtggagccatatgcatggtgagtttcataattctgcttatctcttatattatcatcttgtactctctgagaaaccacagtgcagaaggaaggcgaaaagccctttcgacctgcacctcccattttattgtggttgtcttatgttttgtcccatgcatattcatatatacacgtccggcaaccacatttccagtagacaaggtggtggctgtgttttataccattgggacacccttgctcaatcctctgatctacacactgaggaatgcagaagtgaaaattgccatgaaaaagttatggtgtagcaaagta

SEQ ID NO: 586 - protein, 304 aa, Canis familiaris
MSVNSSVNEFILLGLTQDPRKQKAIFGVFLMFYLATLLGNFLIVVTIKRSRTLGSPMYFFLFYLSFADACFSTTTAPRLIVDAISQQKTISYNECMTQVFASHFFGCMGIFVLILMAFDRYVAICKPLRYTTIMNRHVCSVLVILGWVGSCIHSSAQIVLALRLPFCGPNMIDHYFCDLQPLLKLACMDTYVINLLVVTNSGAICMVSFIILLISYIIILYSLRNHSAEGRRKALSTCTSHFIVVVLCFVPCIFIYTRPATTFPVDKVVAVFYTIGTPLLNPLIYTLRNAEVKIAMKKLWCSKV

SEQ ID NO: 587 - DNA, 915 bp, Canis familiaris
atggcaatgaacagcagtgtgaatgaattcattctgtttggcttgacacaggatccaagaaaacagaaagcaatatttggggtcttcttgatgttttaccttgccacactgttgggaaactttctcattgtagtgactattaaaagaagcaggacccttgggagtcccatgtacttcttcctattttacctgtcctttgctgatgcctgcttttctacaaccacagctcccaggttgattgtggatgccctttctcagcagaagaccatttcctacaatgagtgcatgactcaggtctttgcagtccacttctttggatgcatggaaatcttcgtgctgatcctgatggcttttgatcgctatgtagctatttgtaagcccttgcgttacacaaccatcatgaacaggcatgtctgcagtgtgctggtgattctgggttgggtgggatcctgtatccactcttcagcacaaattgtcctggctttgagattgcctttctgtggtcccaacgtgattgatcactatttctgtgacttgcagcccttgctgaaacttgcttgcatggacacttatgtaataaatttgctagttgtttctaacagtggagccatatgcacggtgagtttcacaatcttgcttatctcctatgttatcatcttgtactctctgagaaaccacagtgcagaaggaaggcgaaaagccctttcgacctgcacctcccattttattgtggttgtcctattttttggcccatgtatattcatatatacacgcccagcaaccacatttccagtagacaaggtggtggctgtgttttataccattgggacacccttgctgaaccctctgatctatacactgagaaatacagaagtgaaaattgccatgaaaaagttatggtgtagcaaagtatga

SEQ ID NO: 588 - protein, 304 aa, Canis familiaris
MAMNSSVNEFILFGLTQDPRKQKAIFGVFLMFYLATLLGNFLIVVTIKRSRTLGSPMYFFLFYLSFADACFSTTTAPRLIVDALSQQKTISYNECMTQVFAVHFFGCMEIFVLILMAFDRYVAICKPLRYTTIMNRHVCSVLVILGWVGSCIHSSAQIVLALRLPFCGPNVIDHYFCDLQPLLKLACMDTYVINLLVVSNSGAICTVSFTILLISYVIILYSLRNHSAEGRRKALSTCTSHFIVVVLFFGPCIFIYTRPATTFPVDKVVAVFYTIGTPLLNPLIYTLRNTEVKIAMKKLWCSKV

SEQ ID NO: 589 - DNA, 915 bp, Canis familiaris
atggagttgaatagcagtgtgaatgagttcattctgtttgggttaacacaggatgttttaaaggagaaagtcgtacttgtggtctttgtgtttctataccttgcaactctgttggcaaatttactgattgttataaccataagatacagccagacacttgggagccccatgtacttcttccttttctacttatcctttgctgatgcctgcttctcaacaaccactgctcctaggttgatagtagattctgtatctaagaagaaagttatctcctacaatgagtgcatgactcagatttttgcatttcacttctttgggtgcatggagatcttggtgcttgtcctcatgtccttggatcgctatgtggccatttgtaagcctctgaggtatacaactatcatgagccggcgtgtctgtggtacactggtgaatctagcctgggtggtgtcttgtatccattcttctgcacagattttcctggctttgaagttaccattctgtggacctaatgttattgatcattatttctgtgatatgccacctttgttgaagcttgcatgcatggacactcatgcaaccaatttactcatagtttttaatagcggggctatctgcacagtaagtttcatggtcctgcttacctcttatattttcatcttacattctttgaataaccagagtgcagaaggaagaaagaaagccctctctacctgcacatcccacattattgttgtcatcttattttttgttccgtgtatattcacatatactcgccctgtaacttcatttccagcggacaagatggtggctgtgttttacactattgtgacacccttgctcaatcctctaatttacacgctgagaaatgcagaagtgaaaaatgccatgaggaagctatggtgcaacaaactctga

SEQ ID NO: 590 - protein, 304 aa, Canis familiaris
MELNSSVNEFILFGLTQDVLKEKVVLVVFVFLYLATLLANLLIVITIRYSQTLGSPMYFFLFYLSFADACFSTTTAPRLIVDSVSKKKVISYNECMTQIFAFHFFGCMEILVLVLMSLDRYVAICKPLRYTTIMSRRVCGTLVNLAWVVSCIHSSAQIFLALKLPFCGPNVIDHYFCDMPPLLKLACMDTHATNLLIVFNSGAICTVSFMVLLTSYIFILHSLNNQSAEGRKKALSTCTSHIIVVILFFVPCIFTYTRPVTSFPADKMVAVFYTIVTPLLNPLIYTLRNAEVKNAMRKLWCNKL

SEQ ID NO: 591 - DNA, 936 bp, Canis familiaris
atgcaaaaccaaagctttgtaactgagtttgttctcctggggctttcacagaatcctaatgttcagaaaatagtatttgttgtgtttttgtttggctacattgcaactgttgggggcaacttgctaattgtggtgaccatcagcagcagcccagcactcttggggtctcccatgtacttcttcttggcttttctgtccttcctggatgcttgcttctccactgtcattgcccccaagatgattgtggactccctttatgagaggaaaacaatctcttttggaggttgtatgactcaactctttgctgagcacttctttgctggggttgaagtgattgtcctcacagccatggcctatgaccgctatgtggccatctgtaaacccttacactacacaactatcatgaactggaggctctgtagcattctgatgggcatagcctggatggggggttttctgcattccatgatacaaattctctttactttccagctgcctttctgtggccccaatgtcattgatcacttcatgtgtgatttgtacccattactggagcttgcctgcactgacactcacatctttggccttttagtggtcgccaacagtgggtctatctgcatcataatcttctctttgttgcttgtctcatatgttgtcatcttgctctctctgagaacccacagtcctgaggggcagcggaaagctctctccacctgcggatctcacattgctattgtggttttgttctttgtcccttgcatatttgtgtatgcacgacctccatctgctttctcctttgacaaaatggtggctatattttataccattctaactcctttactcaatcctttgatttacactttcaggaataaggaaatgaaaaatgccataaagaaagtgtggagcagagtaatgatggtttgtagtgacaaataa

SEQ ID NO: 592 - protein, 311 aa, Canis familiaris
MQNQSFVTEFVLLGLSQNPNVQKIVFVVFLFGYIATVGGNLLIVVTISSSPALLGSPMYFFLAFLSFLDACFSTVIAPKMIVDSLYERKTISFGGCMTQLFAEHFFAGVEVIVLTAMAYDRYVAICKPLHYTTIMNWRLCSILMGIAWMGGFLHSMIQILFTFQLPFCGPNVIDHFMCDLYPLLELACTDTHIFGLLVVANSGSICIIIFSLLLVSYVVILLSLRTHSPEGQRKALSTCGSHIAIVVLFFVPCIFVYARPPSAFSFDKMVAIFYTILTPLLNPLIYTFRNKEMKNAIKKVWSRVMMVCSDK

SEQ ID NO: 593 - DNA, 945 bp, Canis familiaris
atggagaatccaagaaatgtgactgaattcattcttttgggcattacagagaacccagagctgcggaaaatgctctctgctgtgtttctaatcatgtatgtgtccacggttttgggaaacctagtaattgtggtaactgtgatcacaagtcagagtctgagatcacctatgtattttttccttcctttcttatcccttttggatgttacctactcttctgtcattgctcccaagatgattgtggactccctctccaagagcactgccatctccttagaaggttgcatgacccagctctttgcagagcatttctttggtggtgtggggatcatccttctcatcgtgatggcctatgaccgctatgtggccatctgtaagcccctgcactacatgaccatcatgagccctcggatgtgctgcctgctgctgggaggggcctgggtgggggggtttatccatgcagcaatacagcttctcttcatgtatcaactacccttctgtggcctcaatgttattgatcactttatgtgtgatttgtttcccttgttgaaactggcctgcatggacacccacaccctgggtatcctagtcatcctcaacagtggggtgatgtgtatgaccatcttccttatcctcatcacctcctacatggtcatcctctgctctctgaagtcttgcagctctgaagggcggcgcaaagccttctccacctgtggctcccacctcaccgtggttgtcttgttctttgtgccatgcattttcctatatgtgcggcctgtggccacgtaccccattgacaaggcaatggctgtgtcttttaccattgttacacccatgttaaatcccttgatctacaccctgaggaattcagaggtgaaaaatgccgtgaggaaactggtgaaacaagggatcctgggcatcactagctcacatgctaaggactaa

SEQ ID NO: 594 - protein, 314 aa, Canis familiaris
MENPRNVTEFILLGITENPELRKMLSAVFLIMYVSTVLGNLVIVVTVITSQSLRSPMYFFLPFLSLLDVTYSSVIAPKMIVDSLSKSTAISLEGCMTQLFAEHFFGGVGIILLIVMAYDRYVAICKPLHYMTIMSPRMCCLLLGGAWVGGFIHAAIQLLFMYQLPFCGLNVIDHFMCDLFPLLKLACMDTHTLGILVILNSGVMCMTIFLILITSYMVILCSLKSCSSEGRRKAFSTCGSHLTVVVLFFVPCIFLYVRPVATYPIDKAMAVSFTIVTPMLNPLIYTLRNSEVKNAVRKLVKQGILGITSSHAKD

SEQ ID NO: 595 - DNA, 918 bp, Canis familiaris
atggaaagaagcaacaatacagtgactgagttcatcctggtgggcttcacgacagacccagtgatgcagctggtcctgtttgtggtattccttggtgtgtactctctgactgtggtagcaaatgccaccctcatagtgttgatctgtaatgactcccggctgcacacacccatgtattttttcattgggaatctatcttttctggatctctggtattcctctgtctataccccaaagattctcttgacctgcatctctgaagacaaaagcatctcctttgctggctgtgtatgtcagttcttcttctctgctggactggcatacagtgagtgttacctgttggctgccatggcttatgaccgctatatggccatctcaaagccactgcgctatgctcaggccatgtctataaagctgtgtgcatttttggtagcatcctcatatcttggtggttttattaactcttctatcatcaccaaaagaacttttgacctgaacttctgtagtggcaatatcattgatgactttttttgtgatttgtatcccctggtgaagttggcttgtggcaggaaagatggctaccagactgtgctgtatttgatcctgtgctccaatgtcatcacccccacagtgctcatcctagcctcctaccagtttattattgccaccatcttgaggatccgctccacccagggccgcctcaaagccttctctacgtgttcctcacacctggtctctgtcaccttgtactatggctccattctctacatctactctcgtccccgatctagctattctttggacacagacaaaatagtttctacattttatactgtggtgttccccatgttgaatcccatgatctatagcctgaggaataaggatgtgaaagaggctctgaataaactcattaaataa

SEQ ID NO: 596 - protein, 305 aa, Canis familiaris
MERSNNTVTEFILVGFTTDPVMQLVLFVVFLGVYSLTVVANATLIVLICNDSRLHTPMYFFIGNLSFLDLWYSSVYTPKILLTCISEDKSISFAGCVCQFFFSAGLAYSECYLLAAMAYDRYMAISKPLRYAQAMSIKLCAFLVASSYLGGFINSSIITKRTFDLNFCSGNIIDDFFCDLYPLVKLACGRKDGYQTVLYLILCSNVITPTVLILASYQFIIATILRIRSTQGRLKAFSTCSSHLVSVTLYYGSILYIYSRPRSSYSLDTDKIVSTFYTVVFPMLNPMIYSLRNKDVKEALNKLIK

SEQ ID NO: 597 - DNA, 924 bp, Canis familiaris
atggatcacttcacacctcccaacaatgtgactgaatttattctcttgggactcactcagaatccacacttgcagaaaatattctttgtggtcttcttgttcatttttctatttactgtgctggccaatctgctcattgtcctaaccatctccctcagctccacactttcagctcccatgtatttctttctcacttacttgtcctttatagatgcctcctacacctctgtgaccacccccaaaatgatcatcgacctgctgtaccagaggagaaccatctccttgggtggctgcttgactcagctcttcgtggagcactttctgggaggatccgagatcatcctcctcattgtcatggcctatgatcgctatgtggccatctgcaagccccttcactacatgaccatcatgcgacacggactctgtcagcttctagtggtagtggcctggataggggggatcctgcatgccactgttcagatccttttcatggtcaacctacccttctgtggccccaatgtcatcgaccactttatgtgtgatctctttcccctgctgaaacttgcctgcagcgacacctacaggttgggaatggtggtagcggccaacagtggcgccatgtgcttgctcattttttccatgctgctcatctcctacacagtcatcctgagttccttgagctcccatggctccgaaggtcgacacaaagccctctcgacctgttgctcccactttactgtagttgtactcttttttgtgccttgcattttcacctacatgcgtcctgtggtcacctaccctgtggataagttggtgactgtgttctttgcaatcctcactcctatgttaaatcctatcatttacacagtgaggaactcggaggtgaaaaatgccatgaggagtctgttgaagagagtaatttag

SEQ ID NO: 598 - protein, 307 aa, Canis familiaris
MDHFTPPNNVTEFILLGLTQNPHLQKIFFVVFLFIFLFTVLANLLIVLTISLSSTLSAPMYFFLTYLSFIDASYTSVTTPKMIIDLLYQRRTISLGGCLTQLFVEHFLGGSEIILLIVMAYDRYVAICKPLHYMTIMRHGLCQLLVVVAWIGGILHATVQILFMVNLPFCGPNVIDHFMCDLFPLLKLACSDTYRLGMVVAANSGAMCLLIFSMLLISYTVILSSLSSHGSEGRHKALSTCCSHFTVVVLFFVPCIFTYMRPVVTYPVDKLVTVFFAILTPMLNPIIYTVRNSEVKNAMRSLLKRVI

SEQ ID NO: 599 - DNA, 933 bp, Canis familiaris
atgaaagaagaaaggatgaatgtaactgtattcattctaatgggacttacccagaatcctcagatgcagagaattctatttttggtgttacttgtcacctacattgtcactgtctcaggcaacctgctcattgtggttactataatccgcagccagactttggactccccaatgtatttcttcctggcctttttgtctctgatagatgcatgttattcctcttccataattcctaaaatgctagctgatctgctctttgattcaaaatctgtttcctttagtggctgcatgacacagctctttgtagaacatttcttaggagcttcagagattgtcctccttgtagtcatggcctatgaccgctatgtggccatctgtagacctctgcactatgtgaccatcatgaaccatcacacatgctgcctcttcgtggggatgtgttgggtagtgggttttctccactccattggacagattctcgttactttctggctccccttctgtggtcccaacatcatggatcacttcatgtgtgacattttccccctgatacaacttgcctgcactgacactttctttgttggtttcttggttgctgccaatggtggagcaatttctgtgatcacctttgtgatgttattgatatcctatgtggtcatcctgtgctccttgaagactcacagttctgtggggaagaaaaaggccctctctacctgtagctctcacatcacagttgttgtcttgttctttgtgccctgtatttttatgtatctgcgaccagtagctacttttccaatggataaagccatagctgtattctatactcttgttacccccatgttaaaccctgtcatctacacagtaaggaatacagaggtaaaaaatgccatgagaatgttattaaccaggaatgcaatttcagataataaatga

SEQ ID NO: 600 - protein, 310 aa, Canis familiaris
MKEERMNVTVFILMGLTQNPQMQRILFLVLLVTYIVTVSGNLLIVVTIIRSQTLDSPMYFFLAFLSLIDACYSSSIIPKMLADLLFDSKSVSFSGCMTQLFVEHFLGASEIVLLVVMAYDRYVAICRPLHYVTIMNHHTCCLFVGMCWVVGFLHSIGQILVTFWLPFCGPNIMDHFMCDIFPLIQLACTDTFFVGFLVAANGGAISVITFVMLLISYVVILCSLKTHSSVGKKKALSTCSSHITVVVLFFVPCIFMYLRPVATFPMDKAIAVFYTLVTPMLNPVIYTVRNTEVKNAMRMLLTRNAISDNK

SEQ ID NO: 601 - DNA, 954 bp, Canis familiaris
atgggaaatagaaacaatgtgacagagtttgtcctcctggggctcacacaggacctggaggggcaaaaatttctgtttatcccattcttactcatctacattgtgacaatagtgggtaatttgcttatcatggtgaccattatggccagccagtctctgggttctcccatgtatttctttctggcttatttgtcatttatagatgctacttattctactgtcattgctcccaagatgattgcagacttgctctatgagaagaagactatttccttccaggcttgtatgactcaagtctttctagatcacttatttgctggtgctgaagtcattcttctggtggtgatggcctatgaccgatatgtggccatctgtaaaccacttcattatctaatcatcatgaatcggaggacatgtgttcttatgctgctaggggcctggactggaggcttcctgcactcattggttcaatttctttttatttatcagctccctttctgtggccccaatgtcattgacaacttcgtgtgtgatatgtatcccttattgaaacttgcttgcaccaatacctacctcattggaatttctatgatagctaatggaggagccatttgcactgccattttcttcattcttctagtttcctatgggatcatattatactcccttaagactcatagtttagatgggaaactcaaagccttctacacctgtgcatcccatataactgtggttattttattctttgttccctgtatcttcctgtatgcaagacctaatactacctttcccatcgataaattcatgactgtgtttttaacattcataactcccatgctgaaccccttaatctatactctgaggaatgcagaaataaaaaatgccatgtggaaactttggagtaaaaacgtgaccttagttgatagagagttgtattgctcatgcaaaatatga

SEQ ID NO: 602 - protein, 317 aa, Canis familiaris
MGNRNNVTEFVLLGLTQDLEGQKFLFIPFLLIYIVTIVGNLLIMVTIMASQSLGSPMYFFLAYLSFIDATYSTVIAPKMIADLLYEKKTISFQACMTQVFLDHLFAGAEVILLVVMAYDRYVAICKPLHYLIIMNRRTCVLMLLGAWTGGFLHSLVQFLFIYQLPFCGPNVIDNFVCDMYPLLKLACTNTYLIGISMIANGGAICTAIFFILLVSYGIILYSLKTHSLDGKLKAFYTCASHITVVILFFVPCIFLYARPNTTFPIDKFMTVFLTFITPMLNPLIYTLRNAEIKNAMWKLWSKNVTLVDRELYCSCKI

SEQ ID NO: 603 - DNA, 945 bp, Canis familiaris
atgggaaataataatgtgacagaatttgtcctccttggcctcactcaggatcctgaggggcagaaagcattatttgtcatgattttactcatctacattgtgacaatggtgggcaacctactcattgtagtgactgtttttggcagcccctctctgggctcccccatgtactttttccttgcctatctgtcacttatggatgctgtttattccactgtcatttcacccaaattgattatagacttactctgtgacaaaaagacaatttctttcccagcttgcatgggtcagctctttctagaacacttctttgggggttctgaggtcttccttctggtcatgatggcctatgatcgctatgtggccatctgtaggccactgcattacctgactgttatgaatcgacaggtttgcatcctgctgatagtggtggcctggattggaggtcttgtgcactctatggttcagcttctctttgtgtacagcctcccattttgtggccccaatgtcattgatcactttatctgtgacatgtacccattattagaacttgcctgcactgacacctacttaataggcctcactgtgattgccaacggtggagcaatctgtatggtcatctttatccttctactcatctcctatggagtcattctaaattctcttaaaagtcacagtccagaagggaggcgcaaagccctgtctacctgcagttcccacaccacagtggttgtccttttttttgttccctgcattttcatgtatgttagacctgtttctaacttgcccattgataagtctgtaactctggtttatacagttatcactcccatgttaaatcctttaatatataccttgagaaattcagagatgaaaaatgctatggaaaaattctggtgtaaaaatttaacaaaaggtagaataagaatgtgtcacctaaactga

SEQ ID NO: 604 - protein, 314 aa, Canis familiaris
MGNNNVTEFVLLGLTQDPEGQKALFVMILLIYIVTMVGNLLIVVTVFGSPSLGSPMYFFLAYLSLMDAVYSTVISPKLIIDLLCDKKTISFPACMGQLFLEHFFGGSEVFLLVMMAYDRYVAICRPLHYLTVMNRQVCILLIVVAWIGGLVHSMVQLLFVYSLPFCGPNVIDHFICDMYPLLELACTDTYLIGLTVIANGGAICMVIFILLLISYGVILNSLKSHSPEGRRKALSTCSSHTTVVVLFFVPCIFMYVRPVSNLPIDKSVTLVYTVITPMLNPLIYTLRNSEMKNAMEKFWCKNLTKGRIRMCHLN

SEQ ID NO: 605 - DNA, 918 bp, Canis familiaris
atggaacacaggaacaatgtgactgagtttgtcctcttggggctcacccagagcatccaaggtcagaaaatattatttgttgtgttcttgctcatctacatcgtgacaatggtgggcaacctactcattgtggtaactgtggtggtcagcccaagcctggatgcccctatgtacttctttcttggttacttatcatttatggatgctgtgtattctactacagttactccaaatatgatcatagacttactctatgagaagaaaaccatttccttccaagcttgcatgtcccagctctttatagggcacttatttggtggtgctgagattttactcctggtggtcatggcctatgaccgctacgtggccatctgcaaacccttgcattatttgacgatcatgaatcaacgagtgtgtgttctgttgctgttgttggcttggtttggagggtttttgcatgctgtggttaaacttttctccatttacaaccttcctttctgtggtcccaatgtcatcgaccacttcatctgtgacatgtacccattactaaaacttgcctgcactgacacttatgttattggcctcactgtggttgccaatgatgggactatctgtgtcgttatctttttggtcctactcatctcctacggagtcattctgtacaccctgaaggctcttagtcaggaagggaggcgcaaagccttatccacctgtgggtcccatattacagtggtggtcctcttctttgtcccctgcatttttatgtatgtgagacctccttctaccttacccattgataaattcttgactgtgttttacacagttatcacccctatgttaaaccccctaatctatactctgagaaatggagagatgaaaaatgccatgaaaaagttgtggaccagaagaagaaaatga

SEQ ID NO: 606 - protein, 305 aa, Canis familiaris
MEHRNNVTEFVLLGLTQSIQGQKILFVVFLLIYIVTMVGNLLIVVTVVVSPSLDAPMYFFLGYLSFMDAVYSTTVTPNMIIDLLYEKKTISFQACMSQLFIGHLFGGAEILLLVVMAYDRYVAICKPLHYLTIMNQRVCVLLLLLAWFGGFLHAVVKLFSIYNLPFCGPNVIDHFICDMYPLLKLACTDTYVIGLTVVANDGTICVVIFLVLLISYGVILYTLKALSQEGRRKALSTCGSHITVVVLFFVPCIFMYVRPPSTLPIDKFLTVFYTVITPMLNPLIYTLRNGEMKNAMKKLWTRRRK

SEQ ID NO: 607 - DNA, 930 bp, Canis familiaris
atggaaccaagaaacaatgtaacttactttgtcctcctgggcctcacacaggatcctaaggaacagaaggtcctttttattatgttcttgctcttctatattttgactgtggtgggcaacctgctcattgtggtgactgtaactgtcagtaagaccctgggctcacctatgtacttttttcttgctaacttatcttttatggatgtcatttattcctcttgcatttcccctagattgatttcagagtttttctttcaaaaaagtaccatatccttccaatcctgtatgactcagctctttatagatcacctttttggtggatcagaggtctttcttcttttggtgatggcctatgaccgctatgtggccatctgtaagcctttgcattatttggttatcatgaggcaatgggtatgtgttgtgctgcttgtggtatcctgggttggaggatttctgcattcagtaattcaagtgagcactatttatgggctcccattctgtggccccaatgtcatagatcattttttctgtgatatgtaccccttactgaaactggtctgtactgaaacgtatgttgctggcctcttagttgctgccaatggaggggtgatatgctctattgtgtttgtgctcttgctcatttcttatggtgtcatcttgcactctctaaagaaccttagtccagaggggaggcggaaagccctccagacctgtggttcccatatcactgtagtggtcttcttctttgttccatgtattttcatgtatgcaagacctgctaagaccttccccattgacaaatcattgactgtgttttatacagtcataacccccatgctaaacccactgatctacaccctgagaaattctgagatgataaatgctatgaagaagctttggaggagaaatgtcatatcaagtagtcaataa

SEQ ID NO: 608 - protein, 309 aa, Canis familiaris
MEPRNNVTYFVLLGLTQDPKEQKVLFIMFLLFYILTVVGNLLIVVTVTVSKTLGSPMYFFLANLSFMDVIYSSCISPRLISEFFFQKSTISFQSCMTQLFIDHLFGGSEVFLLLVMAYDRYVAICKPLHYLVIMRQWVCVVLLVVSWVGGFLHSVIQVSTIYGLPFCGPNVIDHFFCDMYPLLKLVCTETYVAGLLVAANGGVICSIVFVLLLISYGVILHSLKNLSPEGRRKALQTCGSHITVVVFFFVPCIFMYARPAKTFPIDKSLTVFYTVITPMLNPLIYTLRNSEMINAMKKLWRRNVISSSQ

SEQ ID NO: 609 - DNA, 1065 bp, Canis familiaris
atggaaccaagaaacaacgtaacttactttgtcctcttgggcctcacacaggatcctaaggaacagaaggtcctttgttttatgttcttgctcttctatattttgacagtggtgggcaacttgctcattgtgttgactatagctctcagtaagaccctgggctcacctatgtacttgtttcttgctaacctatcatttatggatgtcacttattcctcttgcatttcccccagattgatttcaaccttgttctttggggaaaataccatatccttccattcttgtatgacacagttatttatggagcacctttttggtggatcagaggtctttcttctgctggtgatggcctatgaccgctatgtggccatctgtaagcctttgcattatttggttatcatgaggcaatgggtgtgtgttgtgctgctggtggtatcctggattggaggttttctgcattcagtaattcaagttagcaccatttatgggctcccattttgtggtcccaatgtcattgatcatttttcctgtgacatgtaccccttactagaattggtctgcactagcacccatgtcattgggctgttagttgtagccaatggagggatgatctgcactattgtgtttgtgttcttgctcatctcttatggtgtcatcttgcactctctaaagaaccttagtccagaggggaagcggaaagccctccagacctgtggctcccacatcactgtggtggtcttcttctttgttccatgtattttcatgtatgcaagacctgctaagaccttctacattgacaaatccttgagtgtgttttatacagtcataacccccatgctgaacccactgatctacactctgagaaattctgagatgacaaatgctataaagaagctctggggatccctgggtggcgcagcggtttggcgcctgcctttggcccagggcgcgatcctggagaccagggatcgaatcccacatcgggctcccggtgcatggagcctgcttctccctctgcctgtgtctctgcctctctctctctcactgtgtgcctatcataaataa

SEQ ID NO: 610 - protein, 354 aa, Canis familiaris
MEPRNNVTYFVLLGLTQDPKEQKVLCFMFLLFYILTVVGNLLIVLTIALSKTLGSPMYLFLANLSFMDVTYSSCISPRLISTLFFGENTISFHSCMTQLFMEHLFGGSEVFLLLVMAYDRYVAICKPLHYLVIMRQWVCVVLLVVSWIGGFLHSVIQVSTIYGLPFCGPNVIDHFSCDMYPLLELVCTSTHVIGLLVVANGGMICTIVFVFLLISYGVILHSLKNLSPEGKRKALQTCGSHITVVVFFFVPCIFMYARPAKTFYIDKSLSVFYTVITPMLNPLIYTLRNSEMTNAIKKLWGSLGGAAVWRLPLAQGAILETRDRIPHRAPGAWSLLLPLPVSLPLSLSLCAYHK

SEQ ID NO: 611 - DNA, 930 bp, Canis familiaris
atggaaccaagaaacaacgtaacttactttgtcctcttgggcctcacacaggatcctaaggaacagaaggtcctttgtgttatgttcttgctcttctatattttgacagtggtgggcaacttgctcattgtgttgactatagctctcagtaagaccctgggctcacctatgtacttgtttcttgctaacctatcatttatggatgtcacttattcctcttgcatttcccccagattgatttcaaccttgttctttggggaaaataccatatccttccattcttgtatgacacagctatttacagagcacctttttggtggatcagaggtctttcttctgctggtgatggcctatgaccgctatgtggccatctgtaagcctttgcattatttggttatcatgaggcaatgggtgtgtgttgtgctgctggtggtatcctggattggaggttttctgcattcagtaattcaagttagcaccatttatgggctcccattttgtggtcccaatgttgttgatcatttcatctgtgaaatgtaccctttactggaactggtctgtactgacacatatgtcattgggctattagttgtagccaatggagggatgatctgcactattgtgtttgcgttcttactcatctcttatggtgtcatcttgcactctctaaagaaccttagtccagaggggaagcggaaagccctccagacctgtggctcccacatcaccgtggtggtcttcttctttgttccatgtattttcatgtatgtaagacctgctaagaccttccccattgacaaatccctgagtgtgttttttacagtcataaccccaatgctgaacccgttgatctacactttgcgaaattctgagatgacaaatgctatgaagaagctctggaggagaaatgttatatcttttagtagataa

SEQ ID NO: 612 - protein, 309 aa, Canis familiaris
MEPRNNVTYFVLLGLTQDPKEQKVLCVMFLLFYILTVVGNLLIVLTIALSKTLGSPMYLFLANLSFMDVTYSSCISPRLISTLFFGENTISFHSCMTQLFTEHLFGGSEVFLLLVMAYDRYVAICKPLHYLVIMRQWVCVVLLVVSWIGGFLHSVIQVSTIYGLPFCGPNVVDHFICEMYPLLELVCTDTYVIGLLVVANGGMICTIVFAFLLISYGVILHSLKNLSPEGKRKALQTCGSHITVVVFFFVPCIFMYVRPAKTFPIDKSLSVFFTVITPMLNPLIYTLRNSEMTNAMKKLWRRNVISFSR

SEQ ID NO: 613 - DNA, 939 bp, Canis familiaris
atgcagaagatggaactaagaaacaatgtaacttactttgtcctcttgggcctcacacagaatccaaaggaacagaaggtcctttttgttatattcttgctcttctatattttgactgtggtgggcaacttgctcattttggtgactatatctctcagtaagaccctgggctcacctatgtacttgtttcttgctaacttatcatttatggatgtcatttattcatcttctatatcccctagattgatttcagacttattctttgcgaaaaataccatatcgttccattcttgtatgattcagctctttacagagcacctttttggtggaacagaaatatttcttctgctggtgatggcctatgaccgctatgtggccatctgtaagcccttgcattatttggttatcatgaagcaatgggtgtgtgttgtgctgctggtggtatcctgggttggaggttttctgcactcagtaattcaacttagcactattcatgggctcccattctgtgggcccaatgtcatcgatcattttttctgtgacatgtaccctttactgaaactggtctgtactgacacatatgttattgggttgttagttgtagccaatggagggatgatctgcactattgtgttttcattcttgctcatctcttatggtatcatcttgcactctctaaagaaccttagtccagaggggaagcggaaagccctccagacgtgtggctcccacatcactgtggtggtctttttcttcgttccatgtattttcatgtatgcaagacctgctaagacattccccattgacaaatccctgagtgtgttttatacagtcataaccccaatgctgaacccgttgatctacactttgagaaattctgagatgacaaatgctatgaagaagctatggagaagaaatactatatctttcagtagataa

SEQ ID NO: 614 - protein, 312 aa, Canis familiaris
MQKMELRNNVTYFVLLGLTQNPKEQKVLFVIFLLFYILTVVGNLLILVTISLSKTLGSPMYLFLANLSFMDVIYSSSISPRLISDLFFAKNTISFHSCMIQLFTEHLFGGTEIFLLLVMAYDRYVAICKPLHYLVIMKQWVCVVLLVVSWVGGFLHSVIQLSTIHGLPFCGPNVIDHFFCDMYPLLKLVCTDTYVIGLLVVANGGMICTIVFSFLLISYGIILHSLKNLSPEGKRKALQTCGSHITVVVFFFVPCIFMYARPAKTFPIDKSLSVFYTVITPMLNPLIYTLRNSEMTNAMKKLWRRNTISFSR

SEQ ID NO: 615 - DNA, 933 bp, Canis familiaris
aaggaaatggaaccaaagaacaatgttactgactttgtcctcttgggcctcacacagaatccaaaggaacagaaggtcctttttgttatattcttgctcttctatattttgaccatggtggacaacctactcattgtggtgactgtttctttcagtaagaccctgggctcacctatgtacttttttcttgccagcttatcatttatggacgtcatttattcctcttctatttctcctgaactgctttcaaatttgttctttggggaaaatatcatatccttccaatcttgtatgatccagctgtttacagagcacttttttggtggatcagaggtctttcttctgctggtgatggcctatgaccgctatgtggccatctgtaagcccttgcattatttggttatcatgaggcaatgagtatgtgttgtgctgctggtgatatcctgggttggacgttttctgcattcagtaattaaagttagcactatttagaggctcccattctgtggccccaatgtcatcgatcattttttctgtgatatgtaccccttactgaaactggtctgtactgacacccatgtcattggcatcttagttgctgccaatggaaggatgatctgcactattgtgcttgtgctcgtgctcatctcttatggtgtcatcttgcactctctaaagaaccttagttcagaggggaggcggaaagccctccagacctgtggttcccatgtcactgtggtggtcttcttctttgttccatgtattttcatgtatttaagacctgctaagaccttcccccctgacaaatccctgagtgtgttttacacagtcataacccccatgctgaacccactgatctacactctgagaaattctgagatggcaaatgctatgaagaagctctggagcagaagtatcatatcttgcagcaaa

SEQ ID NO: 616 - protein, 138 aa, Canis familiaris
KEMEPKNNVTDFVLLGLTQNPKEQKVLFVIFLLFYILTMVDNLLIVVTVSFSKTLGSPMYFFLASLSFMDVIYSSSISPELLSNLFFGENIISFQSCMIQLFTEHFFGGSEVFLLLVMAYDRYVAICKPLHYLVIMRQ

SEQ ID NO: 617 - DNA, 933 bp, Canis familiaris
atgcatatgataaaaacaaacttcactgtgactgagtttgtgttcttggggctgtcatctcagccaaagatgcagctcattctttttattatgttcttgttcttctatttattaacagttgtggggaatattataattatcactattatccagatagaacctcgtctccaaacccccatgtacttcttccttactaatttgtcctttctggacatctgctacacatccaccaatgtcccacaaatgctgtccaacatgatgggaaaaaagaccatccccttctctagctgtgctactcagatgtacttctccctttcctttggaatgattgaatgtgttctccttggggtcatggcttatgacagatatgtagccatttgtcatcctctccattatattgtcattatgaaccaaagcatctgtgtccaattggcagccatttcttggtccagtagcttcctgagttccatggttatcaatgtcctcaccttgagtttgccctactgtgggcccaatgtcctgaatcactttttttgtgaggttccttctgtcttgaggttagcttgcactgacacctcatttacagagctggttgtttttatctttagtatcatcattgtcttcatcccttttctcctcattgttgtttcctatgcccgaatccttctatcagttctcaggatacggtcagcctctgggaggcacaaggcactgtccacttgtgtctcccatctgacagtggtggccttattctatggaactgccatcttcatatacatgagaccccagtcgaagtcctccagggctgggggcaagatcattgccgtgttctacactgtgatcacacccatgctcaaccccttgatctatagcctaaggaaccaggatgtgaaaggagctttaaggagagctattgcaaaacggaggacatga

SEQ ID NO: 618 - protein, 310 aa, Canis familiaris
MHMIKTNFTVTEFVFLGLSSQPKMQLILFIMFLFFYLLTVVGNIIIITIIQIEPRLQTPMYFFLTNLSFLDICYTSTNVPQMLSNMMGKKTIPFSSCATQMYFSLSFGMIECVLLGVMAYDRYVAICHPLHYIVIMNQSICVQLAAISWSSSFLSSMVINVLTLSLPYCGPNVLNHFFCEVPSVLRLACTDTSFTELVVFIFSIIIVFIPFLLIVVSYARILLSVLRIRSASGRHKALSTCVSHLTVVALFYGTAIFIYMRPQSKSSRAGGKIIAVFYTVITPMLNPLIYSLRNQDVKGALRRAIAKRRT

SEQ ID NO: 619 - DNA, 915 bp, Canis familiaris
atggatttgatggagaagatgaataatgtgacggaattcatcctcctgggcttgactcaaaatgtggaacttcagaaattttcatttgttgtgtttttaattgtctacttggtcactttggcaggcaacttgcttatcatgatcaccatcagcaccagcaaggccctggaaacccccatgtacttcttcctgtcttacttgtcccttatagatggctgctgttcttcctccatgacccctaaaatgcttgctgacactcttactatgagaaaaataatctcttttaggggatgtatgactcaggtctttgctgagcatttttttggtgctgctgagattatcctccttacagtaatggcctatgaccgctatgtggccatctgcaaacccttgcgctacacaaccatcatgagtcaacaggtctgtagcctccttgtgggcgtggcctgggctggaggctttgtccatgcaaccattcagatcttcttcacagtctggctgcctttctgtgggcccaatgttatagatcatttcatgtgtgacttaaaccctttgttgaaacttgtctgcatggacactcatacccttggtctctttgttgctgccaatagtgggttcatctgtttgttaaactttctccttttggtggtctcctacatggtcattttgcactccctagggacctacagcttggaggggagacgtaaagccctctctacctgtgtctctcacatcactgtggtcattttattctttgtgccctgtatatttgtctatttgcgtccagcgatcaccttttccattgataaagctgtggctgtgttttacaccatgataactcctatgttaaaccctttaatctacaccttgagaaatgcagaggtgaaaaatgctataaagaagctctggatctaa

SEQ ID NO: 620 - protein, 304 aa, Canis familiaris
MDLMEKMNNVTEFILLGLTQNVELQKFSFVVFLIVYLVTLAGNLLIMITISTSKALETPMYFFLSYLSLIDGCCSSSMTPKMLADTLTMRKIISFRGCMTQVFAEHFFGAAEIILLTVMAYDRYVAICKPLRYTTIMSQQVCSLLVGVAWAGGFVHATIQIFFTVWLPFCGPNVIDHFMCDLNPLLKLVCMDTHTLGLFVAANSGFICLLNFLLLVVSYMVILHSLGTYSLEGRRKALSTCVSHITVVILFFVPCIFVYLRPAITFSIDKAVAVFYTMITPMLNPLIYTLRNAEVKNAIKKLWI

SEQ ID NO: 621 - DNA, 930 bp, Canis familiaris
atggagattaggaacaatgtgacagagtttgttctactggggcttacagagaatccaaagatgcagaaaattgtatttgttgtgttttttgtcatctacaccatcactgtggtaggtaatatgctcattgtgatcaccatcactgccagcccattgttgggatcccccatgtaccttttcctggcctctctctcctttattgatgcctgctactcctctgtcaatactcccaaactgatcatagattcgctccatgaaaagaagactaccctatacaatggatgcatgacccaaatatttggagaacatttttttggaggtgctgaaggcatcctgcttactgtgatggcctatgaccgttatgtggctatctgcaagccactgcactacacaaccatcatgaatcggcgagtgtgtggcctgttaatgggagtggtgtgggttggaggctttcttcatgcaactatacagatcctcttcattttccaattacccttctgtgatccaaatgtcatagatcattttatgtgtgatctgaatcctttgatcaatcttgcctgcactgatacccacactttagggctcttcgttgctgccaacagtggattcatctgtctgttaatcttcctcctcttaatggtctcctatgtggtcattctatgctccctctggaatcacaacttggaggcaaagcgcaaagccctctccacctgtgtctcccacatcacagtggttgtcctattctttgtgccctgcatatttgtgtacatgagacccgcagctacgttatccattaataaggcagttgcagtgttctacactattataactcccatgttaaaccccttaatctataccttgagaaatgcccaaatgaagaatgctattaggaaattatgtagtaagaaagctatttcaggtgacaaataa

SEQ ID NO: 622 - protein, 309 aa, Canis familiaris
MEIRNNVTEFVLLGLTENPKMQKIVFVVFFVIYTITVVGNMLIVITITASPLLGSPMYLFLASLSFIDACYSSVNTPKLIIDSLHEKKTTLYNGCMTQIFGEHFFGGAEGILLTVMAYDRYVAICKPLHYTTIMNRRVCGLLMGVVWVGGFLHATIQILFIFQLPFCDPNVIDHFMCDLNPLINLACTDTHTLGLFVAANSGFICLLIFLLLMVSYVVILCSLWNHNLEAKRKALSTCVSHITVVVLFFVPCIFVYMRPAATLSINKAVAVFYTIITPMLNPLIYTLRNAQMKNAIRKLCSKKAISGDK

SEQ ID NO: 623 - DNA, 930 bp, Canis familiaris
atggaaaataaaagaaatgtgactgaatttattttaataggtcttacacagaaccccacaatgcagaatatagtatttctgggatttttgattctgtacatggtaacactctcaggcaacttgctcattgtggttaccattaccaccagccaggctctgaactcccccatgtacttctttctgactcatctttccgtgatagacacaatttattcttcctcttcagctcctaagctgattgtggactcccttcatgaaaagaaaattatctcctttagtggctgtatggctcaagtctatgcagaacacatttttggtgctacagagatcatcttgctgacagtgatggcctatgatcgctatgtggccatctgcaaacctcttcactatactactgtcatgaaccataggttgtgcattctcctgctgggcgtggcctggactggaggatttctccatgcaaccattcagatcctcttcacagtctggctgcccttctgtggccctaatgtcatagatcatttcatgtgtgacttgtaccctttgttgaaacttgtttgcatggacactcatacccttggtctctttgttgctgtcaacagtggtttcatctgccttttaaacttcctcctattggtggtgtcctatgtggtcatcctgtactccctaaagaactatagcttggaggggaggcgcaaagcactttccacctgtgtctctcacattacagtggttgtcttgttctttgtgccctgcatatttgtgtatctgcgtccagtgaccactctgcccattgataaagctgttgctgtcttttacactatggtggtccctatgttaaatcccttaatctacaccctcagaaatgttgaggtaaaaaatgctatgaggaagctctggagaaaaaaagtgacttcagataatgaataa

SEQ ID NO: 624 - protein, 309 aa, Canis familiaris
MENKRNVTEFILIGLTQNPTMQNIVFLGFLILYMVTLSGNLLIVVTITTSQALNSPMYFFLTHLSVIDTIYSSSSAPKLIVDSLHEKKIISFSGCMAQVYAEHIFGATEIILLTVMAYDRYVAICKPLHYTTVMNHRLCILLLGVAWTGGFLHATIQILFTVWLPFCGPNVIDHFMCDLYPLLKLVCMDTHTLGLFVAVNSGFICLLNFLLLVVSYVVILYSLKNYSLEGRRKALSTCVSHITVVVLFFVPCIFVYLRPVTTLPIDKAVAVFYTMVVPMLNPLIYTLRNVEVKNAMRKLWRKKVTSDNE

SEQ ID NO: 625 - DNA, 1014 bp, Canis familiaris
atgtgcctgcaacaattgcaatccctgtgctgtttgcagataaatcaattatccagatgccaaagtgggttcacagaacaaatgaacaacgtgacggaattcatcctgcttggcctgacgcagaacccagatgtgcagaaactcttgtttgctgtgtttatagtcatctactttctcactgtggcaggcaacttactcattgtcgtgacaatcagcaccagcagagccctgggctcccccatgtatttttttctgtctttcctgtccttcatagatagctgctgctcttcaactatggctcccaaaatgatatttgacttacttgctaaaaagaaaactatctccttcagtgggtgcatgactcagctctttgcagaacatttctttgggggagttgagattatcctgctcacagtgatggcctatgaccgctacgtggctatctgcaagcccctacactacatgatcacaatgaacaggcaaatgtgtgccaacttggtggccgtggcctgggctgggggatttcttcatgctctgattcaaattctttttatagtctggttgcccttctgcggccccaatgtcattgaccatttcatctgtgatctttttcctctgctaaaactctcctgcactgatactcacatctttggactttttgtcgccgccaacagtgggctgatgtgtctgctcattttttctattcttgtcacctcctatgtcctcatcctttactctctaagaactcacagtactaaaggacagcgtaaggctctctctacctgtgcctcccatgttacagtagttgtcctattctttgtaccctgtatattcgtgtaccttaggcccatggtcaccttccccatcgacaaagcagtggctgtgttttatactatgataacacccatgttaaatcctttaatctataccctcagaaactcagaagtgaaaaatgccatgaggaagctctggagccacaaagtaatcttgggtaataacaattcatgtgactag

SEQ ID NO: 626 - protein, 337 aa, Canis familiaris
MCLQQLQSLCCLQINQLSRCQSGFTEQMNNVTEFILLGLTQNPDVQKLLFAVFIVIYFLTVAGNLLIVVTISTSRALGSPMYFFLSFLSFIDSCCSSTMAPKMIFDLLAKKKTISFSGCMTQLFAEHFFGGVEIILLTVMAYDRYVAICKPLHYMITMNRQMCANLVAVAWAGGFLHALIQILFIVWLPFCGPNVIDHFICDLFPLLKLSCTDTHIFGLFVAANSGLMCLLIFSILVTSYVLILYSLRTHSTKGQRKALSTCASHVTVVVLFFVPCIFVYLRPMVTFPIDKAVAVFYTMITPMLNPLIYTLRNSEVKNAMRKLWSHKVILGNNNSCD

SEQ ID NO: 627 - DNA, 963 bp, Canis familiaris
atggaccatgtgctcataacccaagctgactccatggaaaggatgaacaatgtaacagaatttgttctgctgggcctgacccagaatccagaactgcagaaattcttatttgctgtatttttaatcacctacttgatcacactggcaggtaacctactcatctcggtcaccatcttcatcagcccagctctgggttctcccatgtacttttttctatcctatttgtccatcatagatggcttctactcttcttccatagcacctaaaatgatctttgacttaatctctgagcggaacaccatatccttcaatggctgcatgactcaactctttgctgaacatttctttgctggtgctgagatcattttattaattgccatggcttatgaccgctatgtagccatctgtaagccattgcattacatgaccattatgagccgacctgtctgtggtttcttggtaggaatggctggaattttgggctttgttcatggagggatccaggttttgttcatgatccagttaccattctgtggccccaatgttattgaccattttatgtgtgatttaatacctctcctggagctaacgtgtgcagacactcacactttggggcccctggtttctgccaacagtggatcactatgtttgctcactttttctatgctggttgcttcttacattgtcatcctgcgctccctgaggactcatagctctgaagggcgtcgcaaagccctgtctacctgtgcttctcatgtcactgttgtcatcttattctttgtaccttgttcattcctgtacctgagacccacgacctccttccctgctgacaaagctgtgactgtgttttgtaccctagtaactcctatgttgaatcctttaatctataccctcagaaattcagaagtaaaaaatgtcatgaagaaactctggggacaaataatgaaaactggtgataaatga

SEQ ID NO: 628 - protein, 320 aa, Canis familiaris
MDHVLITQADSMERMNNVTEFVLLGLTQNPELQKFLFAVFLITYLITLAGNLLISVTIFISPALGSPMYFFLSYLSIIDGFYSSSIAPKMIFDLISERNTISFNGCMTQLFAEHFFAGAEIILLIAMAYDRYVAICKPLHYMTIMSRPVCGFLVGMAGILGFVHGGIQVLFMIQLPFCGPNVIDHFMCDLIPLLELTCADTHTLGPLVSANSGSLCLLTFSMLVASYIVILRSLRTHSSEGRRKALSTCASHVTVVILFFVPCSFLYLRPTTSFPADKAVTVFCTLVTPMLNPLIYTLRNSEVKNVMKKLWGQIMKTGDK

SEQ ID NO: 629 - DNA, 909 bp, Canis familiaris
atggaaatgccacacaatatcacagaatttttcatgctgggactctcacagaatgcagagatacagcgggtcctctttgtgttttttttgatcatctatgtggccacggtgtgtggcaacatgctcactgtggtcactatcacctccagtcccatgctggcttcccccatgtattatttcctggccaacttgtcctttattgacacctgttattcgtcctctatggctcctaaactcattgctgactccttgtgtgaggggagagccatctcttttgagggctgcctggctcagctctttggagcccattttctgggaggtgttgagatcattctgctcacggtcatggcctatgaccgctatgtggccatctgcaagcccctgcactacacgaccatcatgaccaggcatctctgtgccctgctggtgggggtggcttggttcggaggcttcctgcattccctggtccagctcctcctggtccttcagctgcccttctgtgggcctaatgtgatcaatcactttgtctgtgacttgtaccccttgctggaagtcgcctgcaccaacacgtatgtcatcggcgtgctggtggtcgccaacagtggtgtgatctgcctgttgaacttcctcatgctggttgcttcctatgctgtcatcctgcgttccttgaggtaccatggtgcggaggcgagacgtaaagccctgtccacctgtggggctcacttcactgttgttgccctgttctttgtgccttgtatatttatttatatgcggccatcatctactttgtccatagacaaaatagtgtcagttttttatggtattttgacacctatgttgaatccactcatttataccctaagaaatgaagaggtaaaaaatgccatgagaaagctcttcactcagtaa

SEQ ID NO: 630 - protein, 302 aa, Canis familiaris
MEMPHNITEFFMLGLSQNAEIQRVLFVFFLIIYVATVCGNMLTVVTITSSPMLASPMYYFLANLSFIDTCYSSSMAPKLIADSLCEGRAISFEGCLAQLFGAHFLGGVEIILLTVMAYDRYVAICKPLHYTTIMTRHLCALLVGVAWFGGFLHSLVQLLLVLQLPFCGPNVINHFVCDLYPLLEVACTNTYVIGVLVVANSGVICLLNFLMLVASYAVILRSLRYHGAEARRKALSTCGAHFTVVALFFVPCIFIYMRPSSTLSIDKIVSVFYGILTPMLNPLIYTLRNEEVKNAMRKLFTQ

SEQ ID NO: 631 - DNA, 768 bp, Canis familiaris
gtgttctttttgattgtctaccttgtctctattggaggcaacctacttatcatgatcaccattatctttagtcccaccctgtgctcccctatgtactttttcctctcatgcttgtcattcactgatacttgctattccttgtgtatgacccccaaactcatcgctgactccttgtatcaggggagggccatctcttttgagggctgcctagttcaattccttgttgcccatttattgggaggaatggaaatcattctgctcacggtcatggcctatgaccgctatgtggccatctgcaagcccctgcactacacgaccatcatgaccaggcatctctgtgccctgctggtgggggtagcttggttcggaggcttcctgcattccctggtccagctcctcctggtccttcagctgcccttctgtgggcctaatgtgatcaatcactttgtctgtgacttgtaccccttgctggaagtcgcctgcaccaacacgtatgtcatcggcgtgctggtggtcgccaacagtggtgtgatctgcctgttgaacttcctcatgctggctgcctcctgtgctgtcatcctgcgttccttgagttgccatggtgcggaggcgagtcataaagccctgtccacctgtggggcccacttcactgttgttgccctgttctttgtgccttgtatatttatttatatgcggccttcgtctactttgtccatagacaaaatagtggctgtgcttattgtattctgacaaccatgttcaaccccc

SEQ ID NO: 632 - protein, 249 aa, Canis familiaris
VFFLIVYLVSIGGNLLIMITIIFSPTLCSPMYFFLSCLSFTDTCYSLCMTPKLIADSLYQGRAISFEGCLVQFLVAHLLGGMEIILLTVMAYDRYVAICKPLHYTTIMTRHLCALLVGVAWFGGFLHSLVQLLLVLQLPFCGPNVINHFVCDLYPLLEVACTNTYVIGVLVVANSGVICLLNFLMLAASCAVILRSLSCHGAEASHKALSTCGAHFTVVALFFVPCIFIYMRPSSTLSIDKIVAVLIVF

SEQ ID NO: 633 - DNA, 936 bp, Canis familiaris
atggaaccaaggagcaatgtaacttactttgtcctcttgggcctcacacagaatccaaaggaacagaaggtcctttttgttatattcttgctcttgtatattttgactgtggtgggcaacttgctcattgtggtgactgtaactgtcagtaagaccctgaagtcacctatgtacttttttcttgctagtttatcatttattcctcatctatttatcatttattcctcatctatttctcccagattgatttcagacttgttgtttggggaaaataccatatcctttcaatcttgtatgactcagctattaacagagcacttttttggtggatcagaggtctttcttctgctggtgatggcctatgaccgctatgtggccatctgtaagcccttgcattatttggttatcatgaggcaatgggtgtgtgttgtgctgcttgtggtatcctgggttggaggttttctgcattcagtaattcaacttagcactatttatgggctcccattctgtgggcccaatgtcattgaccattttttgtgtgacatgtaccctttattgaaactggtctgtactgacacatatgtcattgggctgttagttgtagccaacggaggagtgatctgcactattgtgtttgtgctcttgctcatctcttatggtgtcatcttgcactctctaaagaaccttagtccagaggggaagcggaaagccctccagacctgtggctcccacatcactgtggtggtcttcttctttgttccatgtattttcatgtatgcaagacctgctaagaccttccccattgacaaatccctgagtgtgttttatacagtcataacccccatgctgaacccactgatctatactctgagaaattctgagatgacaaatgccatgaagcagctctggggaagaaacatcatatctcttagtaaa

SEQ ID NO: 634 - protein, 312 aa, Canis familiaris
MEPRSNVTYFVLLGLTQNPKEQKVLFVIFLLLYILTVVGNLLIVVTVTVSKTLKSPMYFFLASLSFIPHLFIIYSSSISPRLISDLLFGENTISFQSCMTQLLTEHFFGGSEVFLLLVMAYDRYVAICKPLHYLVIMRQWVCVVLLVVSWVGGFLHSVIQLSTIYGLPFCGPNVIDHFLCDMYPLLKLVCTDTYVIGLLVVANGGVICTIVFVLLLISYGVILHSLKNLSPEGKRKALQTCGSHITVVVFFFVPCIFMYARPAKTFPIDKSLSVFYTVITPMLNPLIYTLRNSEMTNAMKQLWGRNIISLSK

SEQ ID NO: 635 - DNA, 687 bp, Canis familiaris
agcttgggtactgcttctattttctgcctgtgtggctcaacccttccagatatctgttgctcttcatccatgacccctgaaatgctgcttggcatttttgcagtaagaaaaaccatctttttcaaaaagtgcatgactgaagtctttgctgagcacctatgtggccatctgcaaagccctgtagtatgaaatcatctcaaggacagggatacagctttgtctttcaggtggcatgtgctagaggcttgtccttgcaatcactcaggtcctcttcacagtgtggctgcctgtgtgtggctccaatatcatagaccatttgtgtgtgatataaatccttggttgaaaaccatctgcatggacactcatacccttggtctctttgttgctgtcaaatgtgcattcatctgcctatgaacatttatgaacattttcctcttgatggtctcctagctggtcatcatatgctccttgagagcctgtagcttggaggggagacccaaagctatgtctgcctgtgttctcatgtcactgtagtggcttagtattgtgtcctgaatgtttatatatttgtatccaatcaccagcttctccactgatcaagccaagaagccatggtaactctgttgttaaacttaaacctatgtactcagaaatttggaggtaaaaaatgccatgaggaagttttgg

SEQ ID NO: 636 - protein, 62 aa, Canis familiaris
SLGTASIFCLCGSTLPDICCSSSMTPEMLLGIFAVRKTIFFKKCMTEVFAEHLCGHLQSPVV

SEQ ID NO: 637 - DNA, 930 bp, Canis familiaris
aaggaaatggaaccaaagaacaatgttactgactttgtcctcttgggcctcacacagaatccaaaggaacagaaggtcctttttgttatattcttgctcttctatattttgaccatggtgggcaacctactcattgtggtgactgtttctttcagtaagaccctgggctcacctatgtacttttttcttgccagcttatcatttatggacgtcatttattcctcttctatttctcctgaactgcttcaaaatttgttttttgggggaaatatcatatccttccaagtctgtatgatccagctgtttacagagcacttttggtggatcagagtctttcttctgctggtgatggcctatgaccgctatgtggccatctgtaagcccttgcattatttggttatcatgaggcaatgggtgtgtgttgtgctccttgtggtatcctgggttggaggttttctgcattcagtaatccaacttagcactatttatgggctcccattctgtggccccaatgtcatcgatcattttttctgtgatatgtaccccttactgaaactggtctgtactgacacccatgtcattggcatcttagttgctgccaacggagggatgatctgctctattgtgtttgtgctcttgctcatctcttatggtgtcatcttgcactctctaaagaaccttaatccggaggggaggcggaaagccctccagacctgtggttcccacatcactgtggtggtcttcttctttgttccatgtattttcatgtatgtaagacctgctaagaccttccccattgacaaatccctgagtgtgttttatacagtcataacccccatgctgaacccactgatctacactctgagaaattctgagatgacaaatgctatgaagaagctctggagcagaagtatcatatcttgcagcaaa

SEQ ID NO: 638 - protein, 308 aa, Canis familiaris
MEPKNNVTDFVLLGLTQNPKEQKVLFVIFLLFYILTMVGNLLIVVTVSFSKTLGSPMYFFLASLSFMDVIYSSSISPELLQNLFFGGNIISFQVCMIQLFTEHFWWIRVFLLLVMAYDRYVAICKPLHYLVIMRQWVCVVLLVVSWVGGFLHSVIQLSTIYGLPFCGPNVIDHFFCDMYPLLKLVCTDTHVIGILVAANGGMICSIVFVLLLISYGVILHSLKNLNPEGRRKALQTCGSHITVVVFFFVPCIFMYVRPAKTFPIDKSLSVFYTVITPMLNPLIYTLRNSEMTNAMKKLWSRSIISCSK

SEQ ID NO: 639 - DNA, 936 bp, Canis familiaris
atggataaagaaaaccactcagtggtgacggagtttatctttatgggcatcactcaggaccgtcagctgcagatcatcttctttgtgattttcctcctggtctacctagtcaatgtagtggggaacattggtatgatcatcttgatcatagcagatactcagcttcacacacccatgtactttttcctctgcaacctctcttttgttgacctgggctactcctcagccattgcccccaggatgctggctgacttcttaacagagcacaaagtcatctccttctctagctgtgccacccagtttgcgttctttgtaggttttgtagatgctgagtgctatgtcctggccgccatggcctatgaccgtttcgtggccatctgccgacccctccactatggcactctcatgtccaagcgagtctgcttggccctcatgctgggctcttacctggccggcctggtgagtttagtggcccatacttccctcaccttcagtttgagctactgtggttccaatattatcaaccacttcttctgtgaaatcccaccactcttagccctctcttgttcagatacctacatcagtgagatcttgctgtttagcctgtgtggcttcattgaattcagcaccattcttatcatcttcatctcctatgctttcatactcatcgcaatcatcagaatgcgctcagcagaaggccgccttaaggctttctccacctgtgggtctcacctcactggcgtcacccttttttatggcacagtcatgtttatgtacctgaggccaacatccagctactccctggaccaagacaagtgggcctctgtgttctacactattatcatccccatgctgaatcccttgatctacagtttacggaacaaggatgtgaaagctgctttcaaaaaactaattggaaaaaaacctcaagaataa

SEQ ID NO: 640 - protein, 311 aa, Canis familiaris
MDKENHSVVTEFIFMGITQDRQLQIIFFVIFLLVYLVNVVGNIGMIILIIADTQLHTPMYFFLCNLSFVDLGYSSAIAPRMLADFLTEHKVISFSSCATQFAFFVGFVDAECYVLAAMAYDRFVAICRPLHYGTLMSKRVCLALMLGSYLAGLVSLVAHTSLTFSLSYCGSNIINHFFCEIPPLLALSCSDTYISEILLFSLCGFIEFSTILIIFISYAFILIAIIRMRSAEGRLKAFSTCGSHLTGVTLFYGTVMFMYLRPTSSYSLDQDKWASVFYTIIIPMLNPLIYSLRNKDVKAAFKKLIGKKPQE

SEQ ID NO: 641 - DNA, 933 bp, Canis familiaris
atgtcacttgtcacctggatggatttgatggagaagatgaataatgtgacggaattcatcctcctgggcttgactcaaaatgtggaacttcagaaattttcatttgttgtgtttttaattgtctacttggtcaccttggcaggcaacttgcttatcatgatcaccatcagcaccagcaaggccctggaaacccccatgtacttcttcctgtcttacttgtcccttatagatggctgctgttcttcctccatgacccctaaaatgcttgctgacactcttactatgagaaaaataatctcttttaggggatgtatgactcaggtctttgctgagcatttttttggtgctgctgagataatcctccttacagtaatggcctatgaccgctatgtggccatctgcaaacccttgcgctacacaaccatcatgagtcaacaggtctgtagcctccttgtgggcgtggtctgggctggagcctttgtccatgcaaccattcagatcttcttcacagtctggctgcctttctgtgggcccaatgttatagatcatttcatgtgtgacttaaaccctttgttgaaacttgtctgcatggacactcatacccttggtctctttgttgctgccaatagtgggttcatctgtttgttaaactttctccttttggtggtctcctacatggtcattttgcactctctaaggacctacagcttggaggggagacgtaaagccctctctacctgtgtctctcacatcaccgtggtcattttattctttgtgccctgtatatttgtgtatttgcgtccagcgatcaccttttccattgataaagctgtggctgtgttttacaccatgataactcctatgttaaaccctttaatctacaccttgagaaatgcagaggtgaaaaatgctataaagaagctctggatctaa

SEQ ID NO: 642 - protein, 310 aa, Canis familiaris
MSLVTWMDLMEKMNNVTEFILLGLTQNVELQKFSFVVFLIVYLVTLAGNLLIMITISTSKALETPMYFFLSYLSLIDGCCSSSMTPKMLADTLTMRKIISFRGCMTQVFAEHFFGAAEIILLTVMAYDRYVAICKPLRYTTIMSQQVCSLLVGVVWAGAFVHATIQIFFTVWLPFCGPNVIDHFMCDLNPLLKLVCMDTHTLGLFVAANSGFICLLNFLLLVVSYMVILHSLRTYSLEGRRKALSTCVSHITVVILFFVPCIFVYLRPAITFSIDKAVAVFYTMITPMLNPLIYTLRNAEVKNAIKKLWI

SEQ ID NO: 643 - DNA, 930 bp, Canis familiaris
atggagattaggaacaatgtgacagagtttgttctactggggcttacagagaatccaaagatgcagaaaattgtatttgttgtgttttttgtcatctacaccatcactgtggtaggtaatatgctcattgtgatcaccatcactgccagcccattgttgggatcccccatgtactttttcctggcctatctctcctttattgatgcctgctactcctctgtcaatactcccaaactgatcatagattcgctccatgaaaagaagactaccctgtacaatggatgcatgacccaaatatttggggaacatttttttggaggtgctgaaggcatcctgcttactgtgatggcctatgaccgttatgtggctatctgcaagccactgcactacacaaccatcatgaatcggcgagtgtgtggcctgttaatgggagtggtgtgggttggaggctttcttcatgcaactatacagatcctcttcattttccaattacccttttgtggtccaaatgtcatagatcattttatgtgtgatctgaatcctttgctcaatcttgcctgcactgatacccacactttagggctcttcgttgctgccaacagtggattcatctgtctgctaaacttcctcctcttaatggtctcctatgtggtcattctacgctccctccggaatcacaacttggaggcaaagcgcaaagccctctccacctgtgtctcccacatcacagtggtcgtcctattctttgtgccctgcatatttgtgtacatgagacccgcagctacattatccattgataaagcagttgcagtgttctacactattataactcccatgttaaaccccttaatctataccttgagaaatgcccaaatgaaaaatgctattaggaaattgtgtagtaagaaagctatttcaggtgacaaataa

SEQ ID NO: 644 - protein, 309 aa, Canis familiaris
MEIRNNVTEFVLLGLTENPKMQKIVFVVFFVIYTITVVGNMLIVITITASPLLGSPMYFFLAYLSFIDACYSSVNTPKLIIDSLHEKKTTLYNGCMTQIFGEHFFGGAEGILLTVMAYDRYVAICKPLHYTTIMNRRVCGLLMGVVWVGGFLHATIQILFIFQLPFCGPNVIDHFMCDLNPLLNLACTDTHTLGLFVAANSGFICLLNFLLLMVSYVVILRSLRNHNLEAKRKALSTCVSHITVVVLFFVPCIFVYMRPAATLSIDKAVAVFYTIITPMLNPLIYTLRNAQMKNAIRKLCSKKAISGDK

SEQ ID NO: 645 - DNA, 930 bp, Canis familiaris
atggagaataaaagaaatgtgactgaatttattttaataggtcttacacagaaccccacaatgcagaatatagtatttctgggatttttgattctgtacatggtaacactctcaggcaacctgctcattgtggttaccattaccaccagccaggttctgaactcccccatgtacttctttctgactcatctttccgtgatagacacaatttattcttcctcttcagctcctaagctgattgtggactcccttcatgaaaagaaagttatctcctttaatgggtgtatggctcaagtctatgcagaacacatttttggtgctacggagatcatcctgctgatagtgatggcctatgatcgctatgtggccatctgcaaacctcttcactatactactgtcatgaaccataggctgtgcattctcctgctgggcatggcctggactggaggatttctccatgcaaccattcagatcctcttcacagtctggctgcccttctgtggacccaatgtcatagatcatttcatgtgtgatttgtaccctttgttgaaacttgtctgcatggacactcatacccttggtctctttgttgctctcaacagtggtttcatctgccttttaaacttcctcctattggtggtgtcctatgtggtcatcctgtactccctaaagaactatagcttggaggggaggcgcaaagcactttccacctgtgtctctcacattacagtggttgttttctcctttgtgccttgcatatttgtgtatctgcgcccagtgaccactttgcccattgataaagctgttgctgtcttttacactatggtggtcccaatgttaaatcccttaatctacaccctcagaaatgctgaggtaaaaaatgctatgaggaagctctggagaaaaaacgtgacttcagataatgaataa

SEQ ID NO: 646 - protein, 309 aa, Canis familiaris
MENKRNVTEFILIGLTQNPTMQNIVFLGFLILYMVTLSGNLLIVVTITTSQVLNSPMYFFLTHLSVIDTIYSSSSAPKLIVDSLHEKKVISFNGCMAQVYAEHIFGATEIILLIVMAYDRYVAICKPLHYTTVMNHRLCILLLGMAWTGGFLHATIQILFTVWLPFCGPNVIDHFMCDLYPLLKLVCMDTHTLGLFVALNSGFICLLNFLLLVVSYVVILYSLKNYSLEGRRKALSTCVSHITVVVFSFVPCIFVYLRPVTTLPIDKAVAVFYTMVVPMLNPLIYTLRNAEVKNAMRKLWRKNVTSDNE

SEQ ID NO: 647 - DNA, 963 bp, Canis familiaris
atggaccatgtgctcataacccaagctgactccatggaaaggatgaacaatgtaacagaatttgttctgctgggcctgacccagaatccagaactgcagaaattcttatttgctgtgtttttaatcacctacttgatcacactggcaggtaacctgctcatctcagtcaccatcttcatcagcccagctctgggttctcccatgtacttttttctgtcctacttgtccattatagatggtttatactcctcttccatagcacctaaaatgatctttgacttaatctctgagcagaacaccatatccttcaatggctgcatgactcaactctttgctgaacatttctttgctggagctgagatcatcttattaattgccatggcttatgaccgctatgtagccatctgtaagccattgcattacatgaccattatgagcagacctgtctgtggattcttggtaggaatggctggaattttgggctttgttcatggagggatccaggttttgttcatgatccagttaccattctgtggccccaatgtcatcgaccattttttgtgtgatttaatacctctcctggagctagcgtgtgcagacactcacactttggggcccctggtttctgccaacagtggatcactatgtttgctcactttttctatgctggttgcttcttacattgtcatcctgcgctccctgaggactcatagctctgaagggcgtcgcaaagccctgtctacctgtgcttctcatgtcactgttgtcatcttattctttgtaccttgttcattcctgtacctgagacccacgacctccttccctgctgacaaagctgtgactgtgttttgtaccctagtaactcctatgttgaatcctttaatctataccctcagaaattcagaagtaaaaaatgtcatgaagaaactctggggacaaataatgaaaactggtgataaatga

SEQ ID NO: 648 - protein, 320 aa, Canis familiaris
MDHVLITQADSMERMNNVTEFVLLGLTQNPELQKFLFAVFLITYLITLAGNLLISVTIFISPALGSPMYFFLSYLSIIDGLYSSSIAPKMIFDLISEQNTISFNGCMTQLFAEHFFAGAEIILLIAMAYDRYVAICKPLHYMTIMSRPVCGFLVGMAGILGFVHGGIQVLFMIQLPFCGPNVIDHFLCDLIPLLELACADTHTLGPLVSANSGSLCLLTFSMLVASYIVILRSLRTHSSEGRRKALSTCASHVTVVILFFVPCSFLYLRPTTSFPADKAVTVFCTLVTPMLNPLIYTLRNSEVKNVMKKLWGQIMKTGDK

SEQ ID NO: 649 - DNA, 837 bp, Canis familiaris
ctttgtgttttttttttggtcatctatgtggccacggtgtgtggcaacatgctcactgtggtcactatcacctccagtcccatgctggcttcccccatgtattatttcctggccaacttgtcctttattgacacctgttattcttcctctatggctcctaaactcattgctgacttcttgtgtgaggggagagccatctcttttgagggctgcttggctcagctctttggagcccattttctgggaggtgttgagatcattctgctcatggtcatggcctatgaccgctatgtggccatctgcaagcccctgcactacacgaccatcatgaccaggcatctctgtgccctgctggtgggggtggcttggttgggaggcttcctgcattccttggtctagctcctcctggtccttcagctgcccttctgtgggcctaatgtgatcaatcactttgtctgtgacttgtaccccttgctggaagtcgcctgcaccaacacgtatgtcatcggcgtgctggtggtcgccaacagtggtgtgatctgcctgttgaacttcctcatgctggttgcttcctatgctgtcatcctgcgttccttgaggtaccatggtgtggaggcgagacgtaaagctctgtcaacctgtggggctctcttcactgttgttgccctgttctttgtgccttgtatatttatttatatgcagccatcggctactttgtccatagacaaaatagtgtcagtttttttttatggtattttgacacctatgttgaatccactcatttatactctgagaaatgaagaggtaaaagatgccataagaaagctcttcactcag

SEQ ID NO: 650 - protein, 202 aa, Canis familiaris
MVPQGTQDDSIGSNQHEEVQQADHTTVGDHQHADDIRVGAGDFQQGVQVTDKVIDHIRPTEGQLKDQEELDQGMQEASQPSHPHQQGTEMPGHDGRVVQGLADGHIAVIGHDHEQNDLNTSQKMGSKELSQAALKRDGSPLTQEVSNEFRSHRGRITGVNKGQVGQEIIHGGSQHGTGGDSDHSEHVATHRGHIDDQKKNTK

SEQ ID NO: 651 - DNA, 909 bp, Canis familiaris
atggatagttcacgaaacatcacggaatttttcatgctgggactctcacaaaactccgaagtgcagagagtattatttgtgttctttttgattgtctaccttgtttctgttggaggcaacctacttatcatgatcaccattatcttcagtcccaccctgggctctcctatgtactttttcctctcatgcttgtcattcattgatacttgctattcctcgtgtatgacccccaaactcatcgctgactccttgtatgaggggagggccatctcttttgagggctgcctggttcaattctttgttgcccatttattgggaggaacggaaatcattctgctcacggtcatggcctatgaccgctacgtggccatctgcaagcccctgcactacacgaccatcatgaccaggcatctctgtgccctgctggtgggggtggcttggttgggaggcttcctgcattccctggtccagctcctcctggtccttcagctgcccttctgtgggcctaatgtgatcaatcactttgtctgtgacttgtaccccttgctggaacttgcctgtaccaacacgtatgtcatcggcgtgctggtggtcgccaacagtggtgtgatctgcctgttgaacttcctcatgctggttgcttcctatgctgtcatcctgcgttccttgaggtgccatggtgcggaggcgagacgtaaagccctgtccacctgtggggcccacttcactgttgttgccctgttctttgtgccttgtatatttatttatatgcagccatcatctactttgtccatagacaaaatagtggctgtgttttattgtattttgacacccatgttcaaccccctgatttatacattgagaaatgcagaggtgaaaaatgccatgaaaaatctatggaaaaaatga

SEQ ID NO: 652 - protein, 302 aa, Canis familiaris
MDSSRNITEFFMLGLSQNSEVQRVLFVFFLIVYLVSVGGNLLIMITIIFSPTLGSPMYFFLSCLSFIDTCYSSCMTPKLIADSLYEGRAISFEGCLVQFFVAHLLGGTEIILLTVMAYDRYVAICKPLHYTTIMTRHLCALLVGVAWLGGFLHSLVQLLLVLQLPFCGPNVINHFVCDLYPLLELACTNTYVIGVLVVANSGVICLLNFLMLVASYAVILRSLRCHGAEARRKALSTCGAHFTVVALFFVPCIFIYMQPSSTLSIDKIVAVFYCILTPMFNPLIYTLRNAEVKNAMKNLWKK

SEQ ID NO: 653 - DNA, 930 bp, Canis familiaris
atgggaaccaagaacaacgtgactgaatttgtgttgttcggccttttccagagcagggagatgcagcttgtgtgctttgtggtcttctccctcttccacgtgctcactgtcctgggaaaccttctggttatcatcaccattaatgccagcaagaccctgaatgctcccatgtatttcttcctcagccacctgtcttttgcggacatgtgctatccatctgctaccacacccaagatgattgctgacactttcgtggagcgaaagaccatctccttcaatgggtgcatgacccagctcttttctgcccacttctttggtggcactgagatctttctcctcacagctatggcctatgaccgctatgtggccatctgtaggcccctgcactacacggctatcatggatcggtggaagtgtggtctgctggcaggggcctcttgggtgggtggcttcctgcattccatcctacagaccctcctcacagtccagctgcccttttgtgggcctaatgagattgacaacttcttttgtgatgttcatcccttgctgaagctggcctgtgcagacacttatgtggtggggctcattgtggtggccaacagtggcatgatatctctcgtgtcctttatcatccttatcatctcctacgtggtcatcttactgaacctgagaagccagtcatctgagggtcggcgcaaggctctctctacatgtggctcacacatcgtcactgttcttttggtccttctgccccccatgttcatgtacattcgtccctccaccaccctggctgttgacaaacttgtcatcctctttaacattgtcatgccacctttgctgaaccctctcatctacacgttgaggaataatgaggtgaaaaatgcaatgaggaaactgtttagagtagaggggaacatgggggagaagtga

SEQ ID NO: 654 - protein, 309 aa, Canis familiaris
MGTKNNVTEFVLFGLFQSREMQLVCFVVFSLFHVLTVLGNLLVIITINASKTLNAPMYFFLSHLSFADMCYPSATTPKMIADTFVERKTISFNGCMTQLFSAHFFGGTEIFLLTAMAYDRYVAICRPLHYTAIMDRWKCGLLAGASWVGGFLHSILQTLLTVQLPFCGPNEIDNFFCDVHPLLKLACADTYVVGLIVVANSGMISLVSFIILIISYVVILLNLRSQSSEGRRKALSTCGSHIVTVLLVLLPPMFMYIRPSTTLAVDKLVILFNIVMPPLLNPLIYTLRNNEVKNAMRKLFRVEGNMGEK

SEQ ID NO: 655 - DNA, 732 bp, Canis familiaris
atggcgactccaagcaatgtgactgaaatcattctcttggggtttccccccaacagggaggtgcagaagaccgtttctgtgctgtttctcctcatgtacatgaccattgtgctgggtaacggccttattttggtgatggtgatggccagcaaagggctcacctcccccatgtatttcttcctcagcttcctgtcctttgtggagatttgttactgctctgtcacagcccccaagctcatccttgactcttttattgaaaggcaaaccatttccctcaagggctgcatcacacagatatttttcctccatttctttggtggtactgagatctttctcctgacagtgatggcctatgaccgctatgtggccatctgcaagcccctgcactacaccgtcatcatgaaccggcgtgtgtgtggcctcttggtgggtgcagcatggagtgggggcttgctgcattctgttgggcagacattcctcattttccagctgcccttctgtggcctcaaggtccttgaccactacttctgtgatgtccatcctgtattgaagctggcctgctcagacaccttcctcattggtgtgctgatcatcgccaatggtggctccatttcagtggtcagcttcgtggggctgcttgcttcctacgtggtcatcctgtactccctgaggacacagacctcagaaggtcggcgcaaggctctgtccacctgcgcctctcacattgcagtt

SEQ ID NO: 656 - protein, 244 aa, Canis familiaris
MATPSNVTEIILLGFPPNREVQKTVSVLFLLMYMTIVLGNGLILVMVMASKGLTSPMYFFLSFLSFVEICYCSVTAPKLILDSFIERQTISLKGCITQIFFLHFFGGTEIFLLTVMAYDRYVAICKPLHYTVIMNRRVCGLLVGAAWSGGLLHSVGQTFLIFQLPFCGLKVLDHYFCDVHPVLKLACSDTFLIGVLIIANGGSISVVSFVGLLASYVVILYSLRTQTSEGRRKALSTCASHIAV

SEQ ID NO: 657 - DNA, 930 bp, Canis familiaris
atggcgaatacaagtaacgtgactcagttaattatcattggtcttttccaggatccagaggttcagagagtgtgttttgtggtgtttattctcgtgtacctggccacagtagttggcaatggcctcattgtcctgacagtcaatgtcagtaagagtctgcattcccccatgtacttcttcctcagctacctgtccctggtggagatcacgtactcctctactgttgtccctaaattcatcacagacttacttgccaagattaaaaccatttccctggagggctgtgtagctcagatattcttcttccacttctttggagtcactgagatcttcctgcttacggtaatggcctatgaccgctatgtggccatctgcaaaccccttcactacacaaccatcatgagccggtctgtgtgtcgccttctggtggctggttcctggcttgggggcataattcactctatggtccagatccttgttgctgttcagctgcccttctgtggtcccaatgtgattgaccactacttctgtgacctccatcccttattcaagcttgcctgcactgacacttctgtggagggggttattgtgttggccaacagtgggttaatctctgttttctcctttcttatcttggtatcctcctatattgtcatcttgttcaacttgaggaaccattctgcagaggggaggcgcaaagccctctccacctgtgcctctcacatcacggtggtccttttgttctttggacctgccatctttctctatatgcgaccctcttccaccttcactgaggacaaactggtggccgtgttctacacagtcgtcactcccatgctgaaccccatcatctacacactcagaaatgcagaggtcaaaagtgccattaggaagctgtggcggaagaaagtgaactcagtagtggaataa

SEQ ID NO: 658 - protein, 309 aa, Canis familiaris
MANTSNVTQLIIIGLFQDPEVQRVCFVVFILVYLATVVGNGLIVLTVNVSKSLHSPMYFFLSYLSLVEITYSSTVVPKFITDLLAKIKTISLEGCVAQIFFFHFFGVTEIFLLTVMAYDRYVAICKPLHYTTIMSRSVCRLLVAGSWLGGIIHSMVQILVAVQLPFCGPNVIDHYFCDLHPLFKLACTDTSVEGVIVLANSGLISVFSFLILVSSYIVILFNLRNHSAEGRRKALSTCASHITVVLLFFGPAIFLYMRPSSTFTEDKLVAVFYTVVTPMLNPIIYTLRNAEVKSAIRKLWRKKVNSVVE

SEQ ID NO: 659 - DNA, 930 bp, Canis familiaris
atgggaaccaagaacaacgtgactgaatttgtgttgttcggccttttccagagcagggagatgcagcttgtgtgctttgtggtcttctccctcttccacgtgctcactgtcctggggaaccttctggtcatcatcatcatcaatgccagcaagaccctgaattctcccatgtatttcttcctcagccacctgtcttttgcggacatgtgctatccatctgctaccacacccaagatgattgctaacagtttcatggagcgaaagaccatctccttcaatggctgcatgacccagctcttttctgcccacttctttggttgcactgagatctttctcctcacagctatggcctatgaccgctatgtggccatctgtaggcccctgcactacacggctatcatggatcggtggaagtgtggtctgctggcaggggcctcctgggtgggtggctttctgcattccatcctacagaccctcctcacagtccagctgcccttttgtgggcctaatgagattgacaacttcttctgtgatgttcatcccttgctgaagctggcctgtgctgacacttatttggtggggctcattgtgatggtcaacagtagtatgatcactttggggtcctttatcatccttatcatctcctacatggtcatcttactgaacctgagaaaccagtcatctgagggctggcgtaaggctctctctacatgtggctcacacatcatcactgttcttttggtccttctgccccccatgttcatgtatactcgtccctccaccaccctggctgctgacaaacttgtcatcctctttaacattgtcatgccacctttgctgaaccctctgatctacactttgaggaacaatgaggtgaaaaatgcaatgaggaaactgtttagagtagaggggagcatgggggagaagtga

SEQ ID NO: 660 - protein, 309 aa, Canis familiaris
MGTKNNVTEFVLFGLFQSREMQLVCFVVFSLFHVLTVLGNLLVIIIINASKTLNSPMYFFLSHLSFADMCYPSATTPKMIANSFMERKTISFNGCMTQLFSAHFFGCTEIFLLTAMAYDRYVAICRPLHYTAIMDRWKCGLLAGASWVGGFLHSILQTLLTVQLPFCGPNEIDNFFCDVHPLLKLACADTYLVGLIVMVNSSMITLGSFIILIISYMVILLNLRNQSSEGWRKALSTCGSHIITVLLVLLPPMFMYTRPSTTLAADKLVILFNIVMPPLLNPLIYTLRNNEVKNAMRKLFRVEGSMGEK

SEQ ID NO: 661 - DNA, 954 bp, Canis familiaris
atgatcagatacatgaaagaagtccaaggcagaaatcaaacagaaatgactgaatttatcctcttaggactctcagacaactcagatctacaaattgtcctctttggattgtttctgtttatttatatggcaaccatggtgggtaatttggggatgattgtgttaattaagattgacccctgtctccacacccccatgtacttctttctcagtagcctgtcttttgttgatgcatcttactcttcttctgtcactcctaagatgctggtaaacctcatggccaagaataaagccatttcttttaatggatgtgctgctccgttctacttctttggttccttcttggggactgaatgctttctgttggccacgatggcatatgaccgctatgcagccatttggaaccctctgcgatactcagttctcatgtctgggaaaatttgcttcttactaatagctacctctttcttagcaggctttgggaatgcagccatacacacaggaatgactttcagattgtccttttgtggctctaataggatcaaccatttctactgtgacaccccacccctgctcaaactctcttgctctgacactcgcatcaatggcattgtgatcatggctttctccagctttaatgtcatcagttgtgttatgattgttctcatttcctacctgtgtatcctcattgccatcttgagaatgccttctttagaaagcagacacaaagccttctccacctgtgcctcccacctcatggctgtcaccatattctttgggacaattctcttcatgtatttgcgccctacatctagctattcaatggaacaggacaagattgtctctgtcttttatacagtagtgatccctatgctaaatcccctcatctacagtttgaaaaataaggatgtgaaaggggccttaaagaagattttacagaaacacctactgtaa

SEQ ID NO: 662 - protein, 317 aa, Canis familiaris
MIRYMKEVQGRNQTEMTEFILLGLSDNSDLQIVLFGLFLFIYMATMVGNLGMIVLIKIDPCLHTPMYFFLSSLSFVDASYSSSVTPKMLVNLMAKNKAISFNGCAAPFYFFGSFLGTECFLLATMAYDRYAAIWNPLRYSVLMSGKICFLLIATSFLAGFGNAAIHTGMTFRLSFCGSNRINHFYCDTPPLLKLSCSDTRINGIVIMAFSSFNVISCVMIVLISYLCILIAILRMPSLESRHKAFSTCASHLMAVTIFFGTILFMYLRPTSSYSMEQDKIVSVFYTVVIPMLNPLIYSLKNKDVKGALKKILQKHLL

SEQ ID NO: 663 - DNA, 930 bp, Canis familiaris
atggcgactccaagcaatgtgactgaaatcattctcttgggattttcccccaacagggaggtgcagaagactgtttctgtgctgtttctcctcatgtacatggccattgtgctgggtaacggccttattgtggtgatggtgatggccagcaaagggctcacctcccccatgtatttcttcctcagcttcctgtcctttgtggagatctgttactgctctgtcacagcccccaagctcatccttgactcttttattgaaaggcaaaccatttccctcaagggctgcatcacacagatatttttcctccatttctttggtggtactgagatctttctcctgacagtgatggcctatgaccgctatgtggccatctgcaagcccctgcactataccgtcatcatgaaccggcgtgtgtgtggcctcctggtgggtgcagcatggagtgggggcttgctgcattctgttgggcagacattcctcattttccagctgcccttctgtggcctcaaggtccttgaccactacttctgtgatgtccatcctgtattgaagctggtctgctcagacaccttcctcattggtgtgctgatcatcgccaatggtggctccatttcagtggtcagcttcatggggctgcttgcttcctacgtggtcatcctgtactccctgaggacacagacctcagaaggtcggcgcaaggctctgtccacctgtgcctctcacattgcagttgtgagtctgttcttcataccctgttcctttgtctacatgaggccctgtgtcaccctccctgcagacaagatagttgctgtgttttacacagtggtcacacctctcttaaaccccatcatttactccttcaggaatgctgacatgaaaaatgccatgagaagactgatggggaggacagtgatctggggaaatagatga

SEQ ID NO: 664 - protein, 309 aa, Canis familiaris
MATPSNVTEIILLGFSPNREVQKTVSVLFLLMYMAIVLGNGLIVVMVMASKGLTSPMYFFLSFLSFVEICYCSVTAPKLILDSFIERQTISLKGCITQIFFLHFFGGTEIFLLTVMAYDRYVAICKPLHYTVIMNRRVCGLLVGAAWSGGLLHSVGQTFLIFQLPFCGLKVLDHYFCDVHPVLKLVCSDTFLIGVLIIANGGSISVVSFMGLLASYVVILYSLRTQTSEGRRKALSTCASHIAVVSLFFIPCSFVYMRPCVTLPADKIVAVFYTVVTPLLNPIIYSFRNADMKNAMRRLMGRTVIWGNR

SEQ ID NO: 665 - DNA, 930 bp, Canis familiaris
atgggtaacacacacaatgtgaccgaattcgtttttctgggactttcttccaatcaggatgtacagaaagttttctttgtgctgtttctgtttttgtacacagcagttgtgctggggaatctcctcattgtgctcattgtcatgaccagcagaaggcttggttcccccatgtacttcttcctcagctatctatcctttgtggagatctgctactcctctacaacagcacccaaactcatctcggatttgctggctgaaaggaaagcaatttctttgtggggctgcatgacacagctttttttcatgcacttcttcggtggcactgagatcctcctgctcactgtgatggcctatgaccgctatgtggccatctgtaggcccctcaactataccgttatgatgaaccggcaggtatgcgctgtcctggtgggaatggcatgggtgggaggctttgtacattcctttgcccaaatccttttgatcttccgcttgcccttctgcggtcccaatgtgattgaccactatttctgtgacctgcttcctgtgctcaaacttgcctgctctgacaccttcctcattggtgtgctgattgttgccaatggggggaccttgtctgtgatcagctttgggatcatcttagcctcctacgtggtcattttgctccatttgaggactcgaagctctgaggggcggagcaaggccctctccacctgtgggtcccatatcactgtggttaccttattctttgggccatgtatcttcatctatctgaggccttctaccaccttgtctgcagacaagacagtggctgtgttctacacagtgatcaccccactcctcaaccctgtcatttactccctaagaaatgctgaagtgaagaaggccatgaagaagctgtggatcaggacgatgaagctagaagagaaatag

SEQ ID NO: 666 - protein, 309 aa, Canis familiaris
MGNTHNVTEFVFLGLSSNQDVQKVFFVLFLFLYTAVVLGNLLIVLIVMTSRRLGSPMYFFLSYLSFVEICYSSTTAPKLISDLLAERKAISLWGCMTQLFFMHFFGGTEILLLTVMAYDRYVAICRPLNYTVMMNRQVCAVLVGMAWVGGFVHSFAQILLIFRLPFCGPNVIDHYFCDLLPVLKLACSDTFLIGVLIVANGGTLSVISFGIILASYVVILLHLRTRSSEGRSKALSTCGSHITVVTLFFGPCIFIYLRPSTTLSADKTVAVFYTVITPLLNPVIYSLRNAEVKKAMKKLWIRTMKLEEK

SEQ ID NO: 667 - DNA, 930 bp, Canis familiaris
atggcgaatacaaataacgtgactgagttaattatcattggtcttttccaggatccagaggtgcagagagtgtgttttgtgatatttcttctcgtgtacctggccacggtggtgggcaatggcctcattgtcctgacagtcaatgtcagtaagagtttgcattcccccatgtactttttcctcagctacctgtccctggtggagatcacgtactcttctactgttgtccctaaattcatcacagacttacttgccaagattaaaaccatttccctggagggctgtgtagctcagatattcttcttccacttctttggagtcactgagatcttcctgcttacggtaatggcctatgaccgctatgtggccatctgcaaaccccttcactacacaaccatcatgagccggtctgtgtgttgccttctggtggctggttcctggattggtggcttttttcactccatggttcagattattattacactccagttgtctttctgtggtcccaatgtgattgaccactacttctgtgacctccatcccttattcaagcttgcctgcactgacacttctgtggagggggttattgtgttggccaacagtgggttattttctatcttttccttcctcctcctagtgtcctcctatattgtcatcctgttcaacttgaggaaccattctgcagaggggaggcgcaaagccctctccacctgtgcctctcatatcatggtggtccttttgttctttggacctgccatctttctctacatgcgacctccgtccaccttcactgaggacaaactggtggccgtgttctacacggttgtcactcccatgctgaaccccatcatctacacactcagaaatgcagaggtgaaaaatgccatgaggaagctgtgggggaagaaagtgaactctgggatgggataa

SEQ ID NO: 668 - protein, 309 aa, Canis familiaris
MANTNNVTELIIIGLFQDPEVQRVCFVIFLLVYLATVVGNGLIVLTVNVSKSLHSPMYFFLSYLSLVEITYSSTVVPKFITDLLAKIKTISLEGCVAQIFFFHFFGVTEIFLLTVMAYDRYVAICKPLHYTTIMSRSVCCLLVAGSWIGGFFHSMVQIIITLQLSFCGPNVIDHYFCDLHPLFKLACTDTSVEGVIVLANSGLFSIFSFLLLVSSYIVILFNLRNHSAEGRRKALSTCASHIMVVLLFFGPAIFLYMRPPSTFTEDKLVAVFYTVVTPMLNPIIYTLRNAEVKNAMRKLWGKKVNSGMG

SEQ ID NO: 669 - DNA, 930 bp, Canis familiaris
atggaatccactacaaataatgtgactgaattaatcttcgttggccttttccaggatccagaggttcagagagtgtgttttgtggtatttcttctcatgtacctggccacggtggtgggcaatggcctcattgtcctgacagtcaatgtcagtaagagtctgcattcccccatgtacttcttccttagctacctgtccctggtggagatcacgtactcctctactgttgtccctaaattcatcacagacttacttactaagattaaaaccatttccctggaaggctgtgtagctcagatattcttcttccacttctttggggtcactgagatccttttgcttgtggtgatggcctatgaccgctatgtggctatttgcaggcctcttcattatatgaatattatgagccgccaactatgtcatatactggtggctggctcctggcttggcggcttttttcactccattatacagattcttatcaccatccagttgcccttctgtggccccaatgtgattgaccactacttctgtgatcttcagccattattcaaacttgcctgcactgacacctttgtggagggggttattgtgttgaccaacagtggcttaattgctctgtgctccttccttatcttggtgtcttcctatattgtcatcctgttcaacttgaggaaccattctgcagaggggaggcgcaaagctctctctacctgtgcctctcacatcatggtggtcctcttgttctttggacctgccatctttctctacatgcgaccttcctccaccttcactgaggacaaactggtggctgtgttctacacggttgtcacacccatgctgaaccccatcatctacacactcagaaatgcagaggtgaaaaatgccatgagaaagttgtggagcaaaaagaactcagggatggaatga

SEQ ID NO: 670 - protein, 309 aa, Canis familiaris
MESTTNNVTELIFVGLFQDPEVQRVCFVVFLLMYLATVVGNGLIVLTVNVSKSLHSPMYFFLSYLSLVEITYSSTVVPKFITDLLTKIKTISLEGCVAQIFFFHFFGVTEILLLVVMAYDRYVAICRPLHYMNIMSRQLCHILVAGSWLGGFFHSIIQILITIQLPFCGPNVIDHYFCDLQPLFKLACTDTFVEGVIVLTNSGLIALCSFLILVSSYIVILFNLRNHSAEGRRKALSTCASHIMVVLLFFGPAIFLYMRPSSTFTEDKLVAVFYTVVTPMLNPIIYTLRNAEVKNAMRKLWSKKNSGME

SEQ ID NO: 671 - DNA, 1110 bp, Canis familiaris
atggtaccatgttcccaaatccaattttccttcaattttcttcatatagataatgctacactgtatttctctcttgtgaacttcccaggttccatggaaaataatgttactgagtttatcttcatgggtctttcccaaaatgagaaagtgcaacaactatgcttctttttgttcttattcttttatatgatactcatgactggaaattttctcattataatgactattcaaaggagttcaaatctcaactctcccatgtactttttccttagcttcctatcatttgtggacatctgctattcctctgttacagctcccaagctgattattgattcctacgccaaagtcaagagcatctcctttgttggttgtatggcccagctctttttctgccatctatttggctgcacagagatcttcattctcacagtgatggcctatgacaggtatgtggctatctgtaagcctctacgctatatgaccatcatggaccggaaggtctgctccatactggtggcaacctgttggttaggagggtttgtgcattcctttatccagaccatcctcactgtacaactgcctttctgtggccctaacctaattgaccactacttctgtgatgtccaccctttactgaagctggcttgcatagacacaaaagttgtgggactcattgtgatagcaaacagtggtatgatttcactgagctgttttgtcattcttgttggctcttacattgtcatcttgctttcctttaagacccgttcatcagaagggaggcgtaaggccctgtccacatgtgcttctcacatcatagtggtgatcttgttttttgtcccctgcctcttcatctacctaaggccttccaccacttttactgaagacaagatggtggctgtgttttataccatcatcacacccatgttaaaccctctgatctataccctgagaaacatggaagtgaaaaatgccatgaagagactgtggatggagaagttggtggtcagaaataagagaggctctggtgtaaacctcaatgggattgatagagcttcagttgtaccagtttccaaaaggattgctgggaacaagtcagtaatcatcccttaa

SEQ ID NO: 672 - protein, 369 aa, Canis familiaris
MVPCSQIQFSFNFLHIDNATLYFSLVNFPGSMENNVTEFIFMGLSQNEKVQQLCFFLFLFFYMILMTGNFLIIMTIQRSSNLNSPMYFFLSFLSFVDICYSSVTAPKLIIDSYAKVKSISFVGCMAQLFFCHLFGCTEIFILTVMAYDRYVAICKPLRYMTIMDRKVCSILVATCWLGGFVHSFIQTILTVQLPFCGPNLIDHYFCDVHPLLKLACIDTKVVGLIVIANSGMISLSCFVILVGSYIVILLSFKTRSSEGRRKALSTCASHIIVVILFFVPCLFIYLRPSTTFTEDKMVAVFYTIITPMLNPLIYTLRNMEVKNAMKRLWMEKLVVRNKRGSGVNLNGIDRASVVPVSKRIAGNKSVIIP

SEQ ID NO: 673 - DNA, 939 bp, Canis familiaris
atgagcaaccatacaacagtgactgaatttattcttgtgggattcggggatcatccagaactactgtgccttctttttatggtgtttctggtcgtctatatgatcactgtatttggaaatcttggcatgatcctattaatcaagattgactcacatctccatactccaatgtattttttcctcagtaacttatcccttgttgatttctgttattcttctgtcattgcccctaatatgctagtgaatttctgggtggagaacccagtcatttcatttaatggatgtgccactcaattcttcttttttggttcctttgccggcattgagggcttcctgttggccgtgatggcttatgaccgttatgtggccatctgcaagcctcttctttatgcagttattatgtctccccatcttaatgtccttctggtgttggccacgtatcttgcaggctttctgaatgctgccattcacactggcttcacctttcggctgtctttctgccgttcaaatgtcatcaaccactttttctgtgacactccacccctcctgaaactctcttgttctgatacacatatcaatgaagttgtcatttttgcttttgccagttttaatgaactgagctgcctcttgattattctcatttcttatctgtacatactcattgccattttgaggatccattctgctgaagggaggcacaaagccttttccacctgtgcttcccacttgatggtggttaccatcttctttggtacaattctgtttatgtatctgcgccccagctccagctactcaatggaccaggacaaagtggtatctgtgttttatacagtggtcatccctatgttaaatcctctcatctatagtctgagaaacaaggaggtcaaagcttccttaggtaaaatttttaaaacaacttgtttttacctctgtacttag

SEQ ID NO: 674 - protein, 312 aa, Canis familiaris
MSNHTTVTEFILVGFGDHPELLCLLFMVFLVVYMITVFGNLGMILLIKIDSHLHTPMYFFLSNLSLVDFCYSSVIAPNMLVNFWVENPVISFNGCATQFFFFGSFAGIEGFLLAVMAYDRYVAICKPLLYAVIMSPHLNVLLVLATYLAGFLNAAIHTGFTFRLSFCRSNVINHFFCDTPPLLKLSCSDTHINEVVIFAFASFNELSCLLIILISYLYILIAILRIHSAEGRHKAFSTCASHLMVVTIFFGTILFMYLRPSSSYSMDQDKVVSVFYTVVIPMLNPLIYSLRNKEVKASLGKIFKTTCFYLCT

SEQ ID NO: 675 - DNA, 969 bp, Canis familiaris
atgtcttcctcgaaccacacttcagtgacgggattcattctcttgggactcacagacgacccagtactagagaagatcctgtttggggtgtttctggtgatctatctagtcacgctggcagggaatctgtgcatgattgtgctgatcgggaccaattcccacctgcaaactcccatgtacttcttccttagccacctctcctttgtagacatctgctattcttccaatatcactccaaacatgctgtataatttcctctcagaccagaagaccatctcctatgctggatgcttcacgcagtgtcttctcttcattgccctggtgatcactgagttttacatccttgcttcaatggcattggatcgctatgtagccatctgtagccctctacattacagtaccagaatgtccaagaacatttgcatctccctagtggtgatctcttatacttgtggttaccttaatggactctcccagacactgttgacttttcacttgtccttctgtgactcccttgaaatcaaccacttctactgtgcagatcctcctcttatcctgttggcctgctctgacacccatgtcaaaaagatggcgatgctggtagtagctggcttgactctgtcaagctctctcttcatcattgtgctatcctactttttcattattgtagccatcttgaggatccgttctgctgaaggcaggcacaaagccttttctacttgtgcttcccacttgacaatagtcaccttattttatggcaccctcttctgcatgtacttaaggagtccatctgagaagtctgtagaggagtccaaaataattgctgtcttttatacgtttttaagcccaatgttgaacccattgatttatagtctaaggaacaaggatgtgatccatgctatgcagcaaatgattaagggaaatctctttcatacaattgaaatttgggtctctgttaatttgaaatga

SEQ ID NO: 676 - protein, 322 aa, Canis familiaris
MSSSNHTSVTGFILLGLTDDPVLEKILFGVFLVIYLVTLAGNLCMIVLIGTNSHLQTPMYFFLSHLSFVDICYSSNITPNMLYNFLSDQKTISYAGCFTQCLLFIALVITEFYILASMALDRYVAICSPLHYSTRMSKNICISLVVISYTCGYLNGLSQTLLTFHLSFCDSLEINHFYCADPPLILLACSDTHVKKMAMLVVAGLTLSSSLFIIVLSYFFIIVAILRIRSAEGRHKAFSTCASHLTIVTLFYGTLFCMYLRSPSEKSVEESKIIAVFYTFLSPMLNPLIYSLRNKDVIHAMQQMIKGNLFHTIEIWVSVNLK

SEQ ID NO: 677 - DNA, 930 bp, Canis familiaris
atggaacaaaacaatggcactaaagtaactgaattcatcctcctgggatttgctggtcaacacaagtcttggcatatcctcttcatagcatttctagtgatctatgtggccaccctaatggggaatattgggatgatcctactcatcaagattgattctcgccttcacaccccaatgtacttttttctccaacacctggcatttgtggatctctgctacacctctgctatcactcccaagatgctgcaaaaccttgtagaaacagagcaatccatctcattcataggatgtatggtgcaattactagtctatggagcttttgcaacaaccgactgctacatcctggctgcaatggcagtggacaggtatgtggccatctgcaacccactccgctatccgacagtcatgtcccaggcagtctgcattcaactcctgattggctcatacttcgtaggcttcttgaatgcctctgtaaacacaagttttgctttttcattgaacttttgcaaatccaataaaattaaccactttttctgtgatgaacccccactccttgccctctcgtgctccaacattgacttcaacatcatgctactaactgtctttgtggggtttaacttgatgttcactgtgctggttgtcatcttttcctacatatatattctggctgccatcctgaagatatcttctgctgcagggaggaagaaagccttctccacatgcgcctcccacctgacagccatcactgtgttctatgggactctctcttacatgtacctgcatcatgggaccaaggagtctcaagagcaagaaaaaatggcttctgtgttttatggcattatgatccccatgttaaaccccctcatctacagcctgagaaaccaagatgtgaaggaagccctaaaagggattcgaaagaaggctttctag

SEQ ID NO: 678 - protein, 309 aa, Canis familiaris
MEQNNGTKVTEFILLGFAGQHKSWHILFIAFLVIYVATLMGNIGMILLIKIDSRLHTPMYFFLQHLAFVDLCYTSAITPKMLQNLVETEQSISFIGCMVQLLVYGAFATTDCYILAAMAVDRYVAICNPLRYPTVMSQAVCIQLLIGSYFVGFLNASVNTSFAFSLNFCKSNKINHFFCDEPPLLALSCSNIDFNIMLLTVFVGFNLMFTVLVVIFSYIYILAAILKISSAAGRKKAFSTCASHLTAITVFYGTLSYMYLHHGTKESQEQEKMASVFYGIMIPMLNPLIYSLRNQDVKEALKGIRKKAF

SEQ ID NO: 679 - DNA, 948 bp, Canis familiaris
atgtcttcctcgaaccacacttcagtgacgggattcattctcctgggactcacagatgacccagtactagagaagatcctgtttggggtgtttctggtgatctatctagtcacactggcagggaatctgtgcatgattgtactgatcgggaccaattcccacctgcaaactcccatgtacttcttccttagccacctctcctttgtagacatctgctattcttccaatatcactccaaacatgctgtacaatttcctctcagaccagaagaccatctcctatgctggatgcttcacgcagtgtcttctcttcattgccctggtgatcactgagttttacatccttgcttcaatggcattggatcgctatgtagccatctgtagccctctacattacagtaccagaatgtccaagaacatttgcatctccctagtggtgatctcttatacttgtggttaccttaatggactctcccagacactgttgacttttcacttgtccttctgtgactcccttgaaatcaaccacttctactgtgcagatcctcctcttatcctgttggcctgctctgacacccatgtcaaaaagatggcgatgctggtagtagctggcttgactctgtcaagctctctcttcatcattgtgctatcctaccttttcattattgtagccatcttgaggatccgttctgctgaaggcaggcacaaagccttttctacttgtgcttcccacttgacaacagtcactttgttttatggcaccctcttctgcatgtacttaaggagtccatctgagaagtctatagaggagtctaaaataattgctgtcttttatacatttttaagcccaatgttgaacccattgatttatagtctaaggaacaaggatgtgatccatgctatgcagcaaatcattcagggaaatatttttcataaaattgcagtgtag

SEQ ID NO: 680 - protein, 315 aa, Canis familiaris
MSSSNHTSVTGFILLGLTDDPVLEKILFGVFLVIYLVTLAGNLCMIVLIGTNSHLQTPMYFFLSHLSFVDICYSSNITPNMLYNFLSDQKTISYAGCFTQCLLFIALVITEFYILASMALDRYVAICSPLHYSTRMSKNICISLVVISYTCGYLNGLSQTLLTFHLSFCDSLEINHFYCADPPLILLACSDTHVKKMAMLVVAGLTLSSSLFIIVLSYLFIIVAILRIRSAEGRHKAFSTCASHLTTVTLFYGTLFCMYLRSPSEKSIEESKIIAVFYTFLSPMLNPLIYSLRNKDVIHAMQQIIQGNIFHKIAV

SEQ ID NO: 681 - DNA, 984 bp, Canis familiaris
atgaagatggacatatttctcccacacaacagcactgaagcaactgagttcatcctgctgggactgaccagccaacaagagctgcaacccatcctttttgtggtgtttctactgatttacatcatcaccctgacaggaaactttggattgattgcattaatcagattcactccccggctgcaaacacccatgtactttttcctcacccacttagcatgcgtggatattttttattctactaatgtctctcctcagatgcttgttaatttcctctctgagaagaaaactatttcctacacagggtgtctggcccagtgttttgtttttgtgactctgctccttactgagtattacatgcttggtgccatggcctatgacaggtacatggcaatctgccatccgctgcattacaacagcagaatgtccaggccactttgcatctgccttgtcacttttccctacctctggggttctatggtgggcacaatgcaagtaatattgacctctcgcttgtccttttgtggacctaacatcatcaatcatttctactgtgctgacccacctctcctcatgctgacgtgttctgacacttacataaagcagactgcactatttgtgtctgcggggattaacctcactggttccctactcatcatcctcatctcttatgttttcatttttatcaccattatgaggatccattccagtgaagggcaatgcaaagccttctccacctgtggctctcacctgaccgctgtcaccatgttctatgggtccctattctgcatgtatctgagaccagcaaatgagcagtctgttgaacaagggaaaattgtggcagtggtctgtatctttgtgagtcccatgttgaacccatttatctacagcctgaggaacaaagatgtgaagcaggctttgagaatagtatttacgaggaaacttggtacagtggagaaaatgtctattttgacagtctcccaatga

SEQ ID NO: 682 - protein, 327 aa, Canis familiaris
MKMDIFLPHNSTEATEFILLGLTSQQELQPILFVVFLLIYIITLTGNFGLIALIRFTPRLQTPMYFFLTHLACVDIFYSTNVSPQMLVNFLSEKKTISYTGCLAQCFVFVTLLLTEYYMLGAMAYDRYMAICHPLHYNSRMSRPLCICLVTFPYLWGSMVGTMQVILTSRLSFCGPNIINHFYCADPPLLMLTCSDTYIKQTALFVSAGINLTGSLLIILISYVFIFITIMRIHSSEGQCKAFSTCGSHLTAVTMFYGSLFCMYLRPANEQSVEQGKIVAVVCIFVSPMLNPFIYSLRNKDVKQALRIVFTRKLGTVEKMSILTVSQ

SEQ ID NO: 683 - DNA, 936 bp, Canis familiaris
atgttaaagaacaactacacagcagtgactgagtttattctcctgggactgacagatcaagctgagttacagcctgtcctttttgtggtcttcctagtcatctaccttatcacagtgcttggcaatgttagcatgattttgttaatcagaagtgactcaaaacttcacactccaatgtacttcttcctcagtcatctctcttttgtggacctctgttataccaccagtgtcgctccacagatgctggttcatttcttatccaagagaaaagccatttccttcctgggttgccttctgcaattccactttttcattgccctggtgatcaccgattattatatgctcacagtgatggcctatgaccgctacgtggccatctgcaaacccctgttgtatggcagcaagatgtccaggtgtgtctgcttctctctcgttgccaccccttatatttatggctttgtgaatggtctggcacagaccatcctgatgcttcgcctctccttctgtggacccaatgaaatcaaccacttttactgtgcagacccacctctcatagtccttgcctgctcagatacttatgtcaaagaaactgccatgtttgtggtggctggtttcaatctcacctgttctctagccatcattctcatctcatacattttcattttctccaccattctgcgcatccactctgctgagggcaggcgcaaagccttctccacctgtgggtcccatttgacggctgtcaccatcttttatgggactctgttctgcatgcacctaagacccccttctgagacatctgtagaacagagcaaaattgttgccgtgttttatatctttgtgagtcctatgttaaacccttttatttatagcctgcggaacaaagatgttaaaaatgcaatcaggaaagttttccaaaggaaattgttaaattaa

SEQ ID NO: 684 - protein, 311 aa, Canis familiaris
MLKNNYTAVTEFILLGLTDQAELQPVLFVVFLVIYLITVLGNVSMILLIRSDSKLHTPMYFFLSHLSFVDLCYTTSVAPQMLVHFLSKRKAISFLGCLLQFHFFIALVITDYYMLTVMAYDRYVAICKPLLYGSKMSRCVCFSLVATPYIYGFVNGLAQTILMLRLSFCGPNEINHFYCADPPLIVLACSDTYVKETAMFVVAGFNLTCSLAIILISYIFIFSTILRIHSAEGRRKAFSTCGSHLTAVTIFYGTLFCMHLRPPSETSVEQSKIVAVFYIFVSPMLNPFIYSLRNKDVKNAIRKVFQRKLLN

SEQ ID NO: 685 - DNA, 936 bp, Canis familiaris
atgttaaagaacaactacacagcagtgactgagtttattctcctgggactgacagatcgagctgagttgcagcctgtcctttttgtggtcttcctagtcatctaccttatcacagtgcttggcaatgttagcatgatcttgttaatcagaagtgactcaaaacttcacactccgatgtacttcttcctcagtcatctctcttttgtggacctctgttataccaccaatgtctctccacagatgctggttcatttcttatccgagagaaaagccatttccttcctgggttgccttctgcaattccactttttcattgccctggtgatcaccgattattatatgctcacagtgatggcctatgaccgctacgtggccatctgcaaacccctgttgtatggcagcaagatgtccaggtgtgtctgcttctctctcgttgccaccccttatatttatggctttgtgaatggtctggcacagaccatcctgatgcttcgcctctccttctgtggacccaatgaaatcaaccacttttactgtgcagacccacctctcatagtccttgcctgctcagatacttatgtcaaagaaactgccatgtttgtggtggctggtttcaatctcacctgttctctagccatcattctcatctcatacattttcattttctccaccattctgcgcatccactctgctgagggcaggcgcaaagccttctccacctgtgggtcccatttgacggctgtcaccatcttttatgggactctgttctgcatgtacctgagacctccttctgagacatctgtagaacagagcaaaattgttgccgtgttttatatctttgtgagtcctatgttaaacccttttatttatagcctgcggaacaaagatgttaaaaatgcaatcaggaaagttttccaaaggaaattgttaaattaa

SEQ ID NO: 686 - protein, 311 aa, Canis familiaris
MLKNNYTAVTEFILLGLTDRAELQPVLFVVFLVIYLITVLGNVSMILLIRSDSKLHTPMYFFLSHLSFVDLCYTTNVSPQMLVHFLSERKAISFLGCLLQFHFFIALVITDYYMLTVMAYDRYVAICKPLLYGSKMSRCVCFSLVATPYIYGFVNGLAQTILMLRLSFCGPNEINHFYCADPPLIVLACSDTYVKETAMFVVAGFNLTCSLAIILISYIFIFSTILRIHSAEGRRKAFSTCGSHLTAVTIFYGTLFCMYLRPPSETSVEQSKIVAVFYIFVSPMLNPFIYSLRNKDVKNAIRKVFQRKLLN

SEQ ID NO: 687 - DNA, 969 bp, Canis familiaris
atgtccatcacaaatgacagtgcaataagagaattcattctcctggggctcacagatcgtcccgagctccaacctctcctctttgtgctgtttctgggtgtgtacctcgtcaccctcttgggcaacctgggcatgatggtattaatcaggctggactcccgccttcacaaacccatgtacttcttcctcactaatttggcctttgtagacttgtgctacacctcaaatgcaaccccgcagatgttgactaattttttatcagagaagaagaccatcagttttgctggctgctttacgcagtgttacattttcattgcacttctcctcactgagttttacatgctggcagcaatggcctatgaccgctatgtggccatatgtaaccctctacattatagtatgaaaatgtccaggcgtgtctgcatcggcttggccacatttccttatgtctatggattctcagatgggctcttgcaggctatcctgacctttcgcttgaacttctgtagatccaatgtcatcaaccacttctactgtgctgacccgccactgattaagctttcttgctctgatacttatgtcaaagagcatgccatgctcatatcagctggcttcaacctctccaactccctcagcatcatcctggtatcctatgctttcattattgctgccatcctccggatcaaatcagcagagggaagacagaaggcattctccacctgtggttcccacatgatggctgtgaccttattttatgggacgctcttctgcatgtatgtaagaccaccaacagataagactgtcgaggaatccaaaatcatagcagtcttctacacttttgtgagtccagtgcttaatccactgatatacagtctgcggaacaaagatgtaaagcaagccttgaagaatgtcctcagaagaaatatgatcattaagatgagactgcctccagtttccaataaatcataa

SEQ ID NO: 688 - protein, 322 aa, Canis familiaris
MSITNDSAIREFILLGLTDRPELQPLLFVLFLGVYLVTLLGNLGMMVLIRLDSRLHKPMYFFLTNLAFVDLCYTSNATPQMLTNFLSEKKTISFAGCFTQCYIFIALLLTEFYMLAAMAYDRYVAICNPLHYSMKMSRRVCIGLATFPYVYGFSDGLLQAILTFRLNFCRSNVINHFYCADPPLIKLSCSDTYVKEHAMLISAGFNLSNSLSIILVSYAFIIAAILRIKSAEGRQKAFSTCGSHMMAVTLFYGTLFCMYVRPPTDKTVEESKIIAVFYTFVSPVLNPLIYSLRNKDVKQALKNVLRRNMIIKMRLPPVSNKS

SEQ ID NO: 689 - DNA, 957 bp, Canis familiaris
atgctgacagctaagaaaatggtcagaggaaattccaccctggtgactgaatttgttctcttgggattaacagatcgtccagagcttcagcccatcctttttgtgctgttcctgctgatctacttgatcactgtgtgtgggaaccttgggatgttggtcttgattaagatagactcacgcctccacactcctatgtacttctttcttgccagtttgtcctgcttggacttgtgctattccactaatgtgactcccaagatgttggtgaatttcttatcagagaagaaaaccatttcctatgctgcttgtttagtccagtgttatttttttattgccatggtgattacagaatattacatgctggctgtaatggcttatgataggtacatggccatctgtaaccctttgctttacagcagcaagatgtccagaggagtctgtattcgcctgattgttggtccatatgtctatgggttccttagtggcctgatggaaaccatgtggacctaccgcttgaccttctgtggctccaatattattaatcacttctattgcgctgaccctcccctcatccagctctcctgctctgacactttcattaaggagacatccatgtttgtggtagcaggatttaacctctccaactccctcctcataatcctcatctcctacatctttattctcattgccatcctgaagatgcattctgctgaagggaggcacaaagccttttccacctgtggatcccatctggtggcagtgactgtgttttatgggactctgttctgcatgtatgtgagacctcccacggacaagtcagtggagcagtcaaaaattattgctgttttctacacttttgtaagccctatgttgaatcctatcatttatagtctgaggaacaagaatgtgaaacaagctttttggaaattgatcaaaagaaatgtacttttgaaataa

SEQ ID NO: 690 - protein, 318 aa, Canis familiaris
MLTAKKMVRGNSTLVTEFVLLGLTDRPELQPILFVLFLLIYLITVCGNLGMLVLIKIDSRLHTPMYFFLASLSCLDLCYSTNVTPKMLVNFLSEKKTISYAACLVQCYFFIAMVITEYYMLAVMAYDRYMAICNPLLYSSKMSRGVCIRLIVGPYVYGFLSGLMETMWTYRLTFCGSNIINHFYCADPPLIQLSCSDTFIKETSMFVVAGFNLSNSLLIILISYIFILIAILKMHSAEGRHKAFSTCGSHLVAVTVFYGTLFCMYVRPPTDKSVEQSKIIAVFYTFVSPMLNPIIYSLRNKNVKQAFWKLIKRNVLLK

SEQ ID NO: 691 - DNA, 936 bp, Canis familiaris
atgagaagaaacttcacctcagtgactgagttcattctcctcggactgaccagtcgcctggagttgcagatcgtcctcttcctgctgtttctggccatttacttggtcaccctcgcagggaatcttggcatgattgtactcatccaggtcaatgctcagctccacaagcccatgtactttttcctgagccacttatcctttgtggatctgtgcttctcttccaacgtgactcccaagatgctggaggttttcttatcagagaagaaaaccatttcctaccctgcttgtctggtgcagtgttacttctttatcaccttggtgcacgtggagatctacatcctggctgtgatggcttttgatcggtacatggccatctgcaaccctctgctttatggcagcaagatgtccaagagtgtgtgcacatccctcatcacggggccttatgtgtacggagcactcactggcctcatggagaccatgtggacctacaacctagtcttctgtggccccaatgaaattaaccacttctactgtgctgacccaccactgattaagctggcttgttctgacacttacaacaaagagctgtcaatgtttgttgtggcaggatgtaacctttccttttctctgctcatcatcctgatttcctacctttatattgttcctgctatcctgaagattcgttcaacagaaggcaggcataaagctttctctacctgtggctcccatctgacagctgtcaccatattctatgcaactcttttcttcatgtatctcagacgcccctcaaaggaatctgtggaacagggaaaaatggtagctgtattttatacaacggtaatccccatgctgaaccccatgatttatagccttaggaataaagatgtgaaagaagcattaaccaaagagttgttaggaaacaaaaggttttcttaa

SEQ ID NO: 692 - protein, 311 aa, Canis familiaris
MRRNFTSVTEFILLGLTSRLELQIVLFLLFLAIYLVTLAGNLGMIVLIQVNAQLHKPMYFFLSHLSFVDLCFSSNVTPKMLEVFLSEKKTISYPACLVQCYFFITLVHVEIYILAVMAFDRYMAICNPLLYGSKMSKSVCTSLITGPYVYGALTGLMETMWTYNLVFCGPNEINHFYCADPPLIKLACSDTYNKELSMFVVAGCNLSFSLLIILISYLYIVPAILKIRSTEGRHKAFSTCGSHLTAVTIFYATLFFMYLRRPSKESVEQGKMVAVFYTTVIPMLNPMIYSLRNKDVKEALTKELLGNKRFS

SEQ ID NO: 693 - DNA, 933 bp, Canis familiaris
atgctcaattttactgatgtaacagaattcattcttttgggattaaccagtcgtcctgaactgcaagtccttttctttgcggtgttcttactggtctacactatcacgctggtcgggaacattggcatgatcattctaatcaggatcagtccccagctcaacagtcccatgtacttcttcctcagccacttatcttttgccgatgtgtggttctcctctaatgtcacaccgaagatgttagaaaatctggtggctgagatcaaaaccatttcctacactggctgtatagtgcagtgttttttcttcattgcctttgtccacgtggaggtgttcatccttgccgtaatggcctttgacagatacatggcgattggcaaccctctgctctacagcagccgaatgtcaaggaccatctgtattcgactgatctcttttccttacatatatggcttcttcattagtctgatctccacactgtggacccatggtctatacttttgtgggaaggtagagatcaaccacttctactgtgcagatccagctctcatcaaaatggcctgtgcagggaccttcatcaaagaatacaccatgcgcacattggcagggctcaacttctcttattctctactagtcattatcatctcctacattttcatcctcatcgccatcctaaggatgcgctcagcagaaggaagaaagaaagccttttccacatgtggctcccacttgacagctgtcaccatattctatggaaccctcttcttcatgtatctcagaagtccgacagaagagtctgtggaacagggcaagatggtggctgtgttttacaccacagtaattcctatgttgaaccccatgatctacagtctcaggaacaaagatgtaaaggaggccatgagcagagcagtcagtagaacttttttaactaagtaa

SEQ ID NO: 694 - protein, 310 aa, Canis familiaris
MLNFTDVTEFILLGLTSRPELQVLFFAVFLLVYTITLVGNIGMIILIRISPQLNSPMYFFLSHLSFADVWFSSNVTPKMLENLVAEIKTISYTGCIVQCFFFIAFVHVEVFILAVMAFDRYMAIGNPLLYSSRMSRTICIRLISFPYIYGFFISLISTLWTHGLYFCGKVEINHFYCADPALIKMACAGTFIKEYTMRTLAGLNFSYSLLVIIISYIFILIAILRMRSAEGRKKAFSTCGSHLTAVTIFYGTLFFMYLRSPTEESVEQGKMVAVFYTTVIPMLNPMIYSLRNKDVKEAMSRAVSRTFLTK

SEQ ID NO: 695 - DNA, 933 bp, Canis familiaris
atgctcaatttcaccgatgtgacagaattcattctcttgggactcaccagtcgtcaggaatggcaagttctcctctttgccatttttcttgcagtctacattgtcacggtggtgggcaatgttggcatgattgtgttgattaaggtcagtccacagcttaacagccccatgtacttttttctcagccatttgtcatttgtggatgtgtggttttcttccaacgtgacccccaaaatgctggaaaatctgttatctgagacaaaaacgatttcttatgctggctgtttggtacagtgtttcttcttcattgcccttgtccatgtggaaattttcattcttgctgtgatggcctttgataggtacatggcaattgggaagcccctgctgtatggcagcaaaatgtctagggctgtgtgtattcggctgatttccttcccttacgtatatggttttctgactagtctggcagcaaccctgtggacatatggcttgtccttttgtgggaatattgagatcaaccacttctactgtgcagacccacctctcatcaaaatggcatgtgctgggacctttgtaaaagaatacactatgatcatacttgcaggtattaatttcacatattccctaactgtagtgaccatttcttatctgttcattctccttgccattctacggatgcactcggcgcaagggaggcggaaggccttttccacctgtgggtcccacttgacagctgtcgtcatattttatgggactctcatattcatgtatctcagacgtcccacagaggagtctgtggagcaggggaaaatggtggctgtgttttataccacagtgattcccatgctgaatcccatgatctacagtctgaggaacaaagatgtgaaagaagccatgagcaaagtgatcagcagaacatgtttaacaaaataa

SEQ ID NO: 696 - protein, 310 aa, Canis familiaris
MLNFTDVTEFILLGLTSRQEWQVLLFAIFLAVYIVTVVGNVGMIVLIKVSPQLNSPMYFFLSHLSFVDVWFSSNVTPKMLENLLSETKTISYAGCLVQCFFFIALVHVEIFILAVMAFDRYMAIGKPLLYGSKMSRAVCIRLISFPYVYGFLTSLAATLWTYGLSFCGNIEINHFYCADPPLIKMACAGTFVKEYTMIILAGINFTYSLTVVTISYLFILLAILRMHSAQGRRKAFSTCGSHLTAVVIFYGTLIFMYLRRPTEESVEQGKMVAVFYTTVIPMLNPMIYSLRNKDVKEAMSKVISRTCLTK

SEQ ID NO: 697 - DNA, 930 bp, Canis familiaris
atgccaaatttcacagatgtgacggaatttattcttctgggcttgaccagtcgtcaggagtttcaagttctcttttttgtggtattcctggtagtttacatgatcactctgttagggaacattggcatgatctttttgatcagcatcagtcctcagcttcagagccctatgtactttttcttgagtcatctgtctttcgtggatgtgtggttctcttccaatgttacccccaaaatgctggaaaacttgttatcagggacaaaaaccatttcctacgtagggtgtttggtgcagtgctactttttcattgccctcgtgcatgtggaggtttatatcttggcagtgatggcttttgatcgctacatggccatctgcaaccctctgctttatggcagtaaaatgtccaggaccgtctgtgttcagcttatctctgtgccttatgtctatgggttctctgttagtctaatatgtacactatggacatatggcttgtatttctgtggaaactttgaaatcaaccatttctactgtgcagaccctcctctcatcaagattgcctgtgggggggtccacatcaaagaatacacgatgattgttattgctggaattaacttcacatactctctctctgtggtcctcatctcttacaccctcattgtagtcgctgtgctacgcatgcgctccgctgatggcaggaggaaggcattctccacatgtgggtcccacttgacagctgttaccatgttttatgggactctcatattcatgtatctcaggcgtcccactgaagagtctgtggagcagggaaaaatggtggctgtgttttataccacagtgatccccatgctgaatcccatgatctacagtctgcggaacaaggatgtgaaagaggcagtcaacaaagcaattgccaaagcaaacttggggtag

SEQ ID NO: 698 - protein, 309 aa, Canis familiaris
MPNFTDVTEFILLGLTSRQEFQVLFFVVFLVVYMITLLGNIGMIFLISISPQLQSPMYFFLSHLSFVDVWFSSNVTPKMLENLLSGTKTISYVGCLVQCYFFIALVHVEVYILAVMAFDRYMAICNPLLYGSKMSRTVCVQLISVPYVYGFSVSLICTLWTYGLYFCGNFEINHFYCADPPLIKIACGGVHIKEYTMIVIAGINFTYSLSVVLISYTLIVVAVLRMRSADGRRKAFSTCGSHLTAVTMFYGTLIFMYLRRPTEESVEQGKMVAVFYTTVIPMLNPMIYSLRNKDVKEAVNKAIAKANLG

SEQ ID NO: 699 - DNA, 930 bp, Canis familiaris
atgacaagagaaaatagcactgaagtgactgaattttttcttctgggatttggtgcccaacacaagtatcgatacttcctcttcattgtatttctggtgatctatgcgacttccatgatgggtaacattggaattatcctactcatcaagacagattccagacttcaaacacctatgtactttttcctgcaacatttggcctttgttgatatttgttatacctctgctatcactcccaagatgctgcaaaacttcatattagaaaataagtctatatcatttgagggctgtgcaatgcaattattggtttatgcaacatttgcaaccagtgactgctacctcctggctgctatggcagtggaccgttatgtagccatctgtaacccacttcactatcccatgatcatgtcccaaagagtctgcatccaactggtagctggttcatacatcatgggttcaataaatgcttctgtgcacacaggttttacattttcactgtacttttgcaaatctaacaccatcaatcactttttctgtgatgttcccccaattctggccctttcatgctccagcattgacatcaacatcatgctccttgttgtctttgtgggatttaacttgatgttcactgtgttagttgtcatctcttcctatatatatatcatggctgccatcctgaagatatcttctgctaccgagaggaaaaaagccttctccacgtgctcttcccacctgacagccatcatcattttctatacaaccctatcatacatgtacttacagcctcaggctaataattctcaggagaatatgaaagtgacttctgtattttacggcattgtgattccttttttgaaccccttgatctatagtttgagaaataaggaggtaaaagaggctctaaaagtgatgaggaagaagttcttctag

SEQ ID NO: 700 - protein, 309 aa, Canis familiaris
MTRENSTEVTEFFLLGFGAQHKYRYFLFIVFLVIYATSMMGNIGIILLIKTDSRLQTPMYFFLQHLAFVDICYTSAITPKMLQNFILENKSISFEGCAMQLLVYATFATSDCYLLAAMAVDRYVAICNPLHYPMIMSQRVCIQLVAGSYIMGSINASVHTGFTFSLYFCKSNTINHFFCDVPPILALSCSSIDINIMLLVVFVGFNLMFTVLVVISSYIYIMAAILKISSATERKKAFSTCSSHLTAIIIFYTTLSYMYLQPQANNSQENMKVTSVFYGIVIPFLNPLIYSLRNKEVKEALKVMRKKFF

SEQ ID NO: 701 - DNA, 957 bp, Canis familiaris
atggctgaaaggaatagcaccaaggtgacagaattcattcttttgggtttttccgtccacagagagattgaaatcattctctttctgctcatttcagtggtctacactctaacattggtagggaacctagggatgatttctttaatccgattggattctcgacttcacacacccatgtacttttttctcagtaatctggcctttatagacctctgttactcctcatcgatagcccccaagttcctggagaccctcctgaccaagcacaggtctatatctttctatgcatgtgcaacacagctgggctttttcttgaacttcctgatttctgagatgttccttcttgcagtaatggcttatgaccgttatgtggccatctgcaatcctcttctctacatgatgatcatgtctcgaaaggtgtgtatgcagctggtgataggcccctacttatacagcttttctgttgctttgctccacacagttgttactttccaactgatgtattgtggccccaatatcatcaatcacttctattgtgacgatgttcctttgatggcacttgcctgctcggacaccagcctcaaagaaatcttgattttcatctttgctggattcaacatgatcagctctttgaccactgttcttatttcttacttatacattgtggccgccatcttgaaaatccagtctacagaagggaggtgcaaagctttctcgacttgtgcttctcatttgactgctgtgactatattctatgggacattgatcttcatgtatctgcagccaaaatcaaaccactcccttgacacagacaaaatggcctctgtattttacacaatagtaattcctatgctaaaccccattatctatagcttgaggaaccaagaggtaaaaaatgccttaagaaaagcaactgacaagtgttatgtcctgtttctaacaaacctaaaaaaatga

SEQ ID NO: 702 - protein, 318 aa, Canis familiaris
MAERNSTKVTEFILLGFSVHREIEIILFLLISVVYTLTLVGNLGMISLIRLDSRLHTPMYFFLSNLAFIDLCYSSSIAPKFLETLLTKHRSISFYACATQLGFFLNFLISEMFLLAVMAYDRYVAICNPLLYMMIMSRKVCMQLVIGPYLYSFSVALLHTVVTFQLMYCGPNIINHFYCDDVPLMALACSDTSLKEILIFIFAGFNMISSLTTVLISYLYIVAAILKIQSTEGRCKAFSTCASHLTAVTIFYGTLIFMYLQPKSNHSLDTDKMASVFYTIVIPMLNPIIYSLRNQEVKNALRKATDKCYVLFLTNLKK

SEQ ID NO: 703 - DNA, 960 bp, Canis familiaris
atggctgatgtcaatatcacctatgtcactgagttcattctcaagggaattacagaccggccagagctccaggccccatgctttgtggtgtttttcatcatctatctggtcacagtggtgggaaacctggggttgataactttaatcaggattgactctcgactccacacacctatgtactattttctcagtcacttggcctttgttgacctttgctattcttctgctatcacaccaaagatgatggtgaattttgttgtggaactcaacattattcctttccatgcttgtgcaacacaactgggctgttttctcaccttcatgatcactgagtgtttccttttggcttctatggcttatgatcgctatgtagctatctgtagtcccctacactattcaaccctgatgtcaagaagactatgcattcaattagtggcagttccatatatatacagctttctggttgccctgttccataccattatcaccttccgtctaagttactgtggccccaatgtaattaaccacttctactgtgatgacctccctctcttggctctgtcctgctcagacacacacatgaaggaaattctgatctttgcctttgctggttttgatatgatatgttcctcttccattgtcctcacctcctacatctttatcattgcggccattctaaggatccgctctacccaggggcgacgcaaggccatttccacctgtggctcccatatggtggctgtcactattttttatggaaccttgatctttatgtacctacagcccaaatcaaatcactccttggacacagacaaaatggcatctgtattttacacagtggtgatcccaatgttgaaccccctgatctatagtctaaggaacaaagaggtgaaagatgcctcaaagaaagccttggataaaggttgtgaaaccttaaatctgttaaaattaagaaaataa

SEQ ID NO: 704 - protein, 319 aa, Canis familiaris
MADVNITYVTEFILKGITDRPELQAPCFVVFFIIYLVTVVGNLGLITLIRIDSRLHTPMYYFLSHLAFVDLCYSSAITPKMMVNFVVELNIIPFHACATQLGCFLTFMITECFLLASMAYDRYVAICSPLHYSTLMSRRLCIQLVAVPYIYSFLVALFHTIITFRLSYCGPNVINHFYCDDLPLLALSCSDTHMKEILIFAFAGFDMICSSSIVLTSYIFIIAAILRIRSTQGRRKAISTCGSHMVAVTIFYGTLIFMYLQPKSNHSLDTDKMASVFYTVVIPMLNPLIYSLRNKEVKDASKKALDKGCETLNLLKLRK

SEQ ID NO: 705 - DNA, 942 bp, Canis familiaris
atggccagaggcaatcattcagtagtatctgagtttatcctcttggggctcactgataatccagagcttcaagccattctctttggtatattcctagtcatctatttagctagtgtcatgggtaatctcggtatgattgtgctcatccaagtcagccctcagcttcacacacccatgtacttttttctcaaccacctggcttttgttgatttttgttttacttcatctgtcaccccaaacaccttggtgaattttctgtgtgatgtgaaaagtataacattttatgcatgtgctcttcaggtgtgctgcttcatcacatttgtagtttgtgaactgtatttgcttgcagtcatggcctatgatcggtatgtggccatctgcaaccctctactgtacatcattctcatgcctagaaagctctgtaatcaaatgattgctagcacatatgcttatggattcacagtgggtctcatacagacagtggcaacattccacttgtctttttgtggctccaacgtgatcaatcacttttattgtgatgatgttcccttggttgctctggcctgctctgacactcacctcaaagagctgatgttgttcatcattgctggattcaataccctctgctctctactacttgtaataatttcttatatcttcatcttctttaccatcctaaggatccattctactgaaggaagacagaaagccttttatacgtgtgcttcccacctaacctccatcacaatattttatgggacaatcatttttatgtatctactgcccaagtcaagccattctctgaacagagataaatttgcttcagtgttttatgtggtagtgattcccatgttaaacccactgatctacagcttgagaaatcaggaggtaaaaaatgcactgaaaagaattatagcaaagttgtgtttggctgtcaaataa

SEQ ID NO: 706 - protein, 313 aa, Canis familiaris
MARGNHSVVSEFILLGLTDNPELQAILFGIFLVIYLASVMGNLGMIVLIQVSPQLHTPMYFFLNHLAFVDFCFTSSVTPNTLVNFLCDVKSITFYACALQVCCFITFVVCELYLLAVMAYDRYVAICNPLLYIILMPRKLCNQMIASTYAYGFTVGLIQTVATFHLSFCGSNVINHFYCDDVPLVALACSDTHLKELMLFIIAGFNTLCSLLLVIISYIFIFFTILRIHSTEGRQKAFYTCASHLTSITIFYGTIIFMYLLPKSSHSLNRDKFASVFYVVVIPMLNPLIYSLRNQEVKNALKRIIAKLCLAVK

SEQ ID NO: 707 - DNA, 942 bp, Canis familiaris
atggcaaaaggcaatcactcagcagtcactgagtttattctcttgggcctcacagataatccggagattcaggccgttcttttctgtgtattcctattgatatacttagttactgtcttgggtaatcttggtttgattgtgctcatccaaatcagtcctcaacttcacacccccatgtattttttcctctgtcatctggcttttgttgatttttatggtacctctgccatcactccaaacacactggtgaactctctacgtgaaattaaaagtatgccattttatgcatgtgccactcaagtatgttgctttatcacattttcagtttgggaattactaatgctctctgtcatggcctatgaccggtatgtggccatctgtagccctctactctacatcattctcatgtccaagaaactctgcatccagttggtcactagttcttatatttatggattcactgtggggctcatacaaacaatggttacattccacatgtctttctgtgattccaatgtggtcaaccagttctactgtgatgatgttcccttgattgctctggcctgctctgacactcaagtcaaagaattgatgttgctcatcattgctgggttcaatgtcttctgctctcttatcattgttcttatatcctatgggttcattgtctttgccatcttaaagatccattctgctgcaggaagacaaaaagccttttccacctgtgcttctcacctgttttctattactatgtattatgggaccctcagttttatgtacctgcgccccaagtcaagccactcactggataaagacaaatttgcctcagtattctatgcagtggtgattcccatgctaaacccgttaatttacagcttgaggaatcaggaggtaaaaaatgccttcaagaaaatatttgaaaaggtatattctagtaatcaataa

SEQ ID NO: 708 - protein, 313 aa, Canis familiaris
MAKGNHSAVTEFILLGLTDNPEIQAVLFCVFLLIYLVTVLGNLGLIVLIQISPQLHTPMYFFLCHLAFVDFYGTSAITPNTLVNSLREIKSMPFYACATQVCCFITFSVWELLMLSVMAYDRYVAICSPLLYIILMSKKLCIQLVTSSYIYGFTVGLIQTMVTFHMSFCDSNVVNQFYCDDVPLIALACSDTQVKELMLLIIAGFNVFCSLIIVLISYGFIVFAILKIHSAAGRQKAFSTCASHLFSITMYYGTLSFMYLRPKSSHSLDKDKFASVFYAVVIPMLNPLIYSLRNQEVKNAFKKIFEKVYSSNQ

SEQ ID NO: 709 - DNA, 819 bp, Canis familiaris
ttgatctacttaattagcgtcacaggtaatcttgggttaattatgctaattcatatcaattctcagccaatacccacctatgtattttttcctcagcatcctactttttttcctggatttttgctagacctcttctatttcccctaacaccctggtgaaccgtctccaagaaattaagagatatccttacctgcttgtgccactcacttgtgttactttatcatgtttgtggtttatgaagtgtatttgctctccatcatggcatatgataggtatgtcgccatttgcaaccctttcaccactatcattaacagaagggtctgtattcaaatggtggttagttcatatttgtatggcttttctgtgggtttcctacaggcagtccttacattccacttatctttctgtaattcaaatataataaatcacttctactgtgatgatgttcccctggttggtccggggtgctgtaaaacccattacaaagataccaaagaactagtattgttcacacttactgtttaaataccctttgttctcttattattatctccatctcttacatattcattctatttgccattctgaagattaattcatctgatggtaggcaaaaagcattttctacttgtgcctcccctctgacttccttcactatattttatagcacaatcatcttcatgtatatgcagccaaaaacaagccattctctagatactgacaagacagcttctgttttctaatattgtagtaatccccatgctaaatcctttaatgtacagcctgaggaaccaggaagtaaaaaatgttttgaaaaga

SEQ ID NO: 710 - protein, 48 aa, Canis familiaris
LIYLISVTGNLGLIMLIHINSQPIPTYVFFPQHPTFFPGFLLDLFYFP

SEQ ID NO: 711 - DNA, 960 bp, Canis familiaris
atggtccagagaaattgcacccaagtgacagaatttattctcatgggcctcacagatcgtcaggagttgaagatgcccctctttgtggctttcttatctatctacctcttcacagtagtaggtaacctgggtttgatcctagtcattagaacagactcaagactcaacacaccaatgtacttctttcttagcaacctagcttttgttgatttctgttatgcttctgtcattacacccaaaatgcttggcaatttcttgtacaaacaaaatgttatctccttcaatgcatgtgctgctcaattaggctgtttcctggccttcatgactgctgagtgcttgctactggcatccatggcctatgaccgatacgtggccatttgtaaccctctcctctacatggttgtaatgtccccaggaatctgcattcagcttgtagctgttccctacagctatagcttcctggttgcactatttcataccatcctcacttttcgcctctcctattgtcattccaatatcatcaatcatttctattgtgatgacatgcctctccttaggctaacctgttcagacactcactccaaacagctgtggatctttgcctgtgctgggatcatgttcatttcttcccttttgattgtcttcgtctcctatacatacattatttctgccatcctgaggatgcgctcagccgagggcaggcgcaaggctttctccacatgtggctctcacatgctggcagtcaccatcttctatgggaccctcatctttatgtacttacagccgagctcaaaccattccctagacacagacaaaatggcctcagtcttctacacagtgatcattcccatgttgaaccctcttatctacagcctcaggaataaggaggtgaaagatgccttgaagaaagttatcatcagtagaaaccaggcttttatgttcatgaaattaaagaagtga

SEQ ID NO: 712 - protein, 319 aa, Canis familiaris
MVQRNCTQVTEFILMGLTDRQELKMPLFVAFLSIYLFTVVGNLGLILVIRTDSRLNTPMYFFLSNLAFVDFCYASVITPKMLGNFLYKQNVISFNACAAQLGCFLAFMTAECLLLASMAYDRYVAICNPLLYMVVMSPGICIQLVAVPYSYSFLVALFHTILTFRLSYCHSNIINHFYCDDMPLLRLTCSDTHSKQLWIFACAGIMFISSLLIVFVSYTYIISAILRMRSAEGRRKAFSTCGSHMLAVTIFYGTLIFMYLQPSSNHSLDTDKMASVFYTVIIPMLNPLIYSLRNKEVKDALKKVIISRNQAFMFMKLKK

SEQ ID NO: 713 - DNA, 963 bp, Canis familiaris
atgcctttaagagatatggctcagataaattgtacccacgtacaggagtttattctcatgggcctcacagatcgaaaggagttgaagatgcccttctttgtggttttcttgtctatctacttcttgacagtagtaggcaatctaggtttgatcctagtcattagaacagattcaagacttactaacacaccgatgtacttctttcttagcaacctagcttttgttgatttctgttatgcttctgtcattacacccaaaatgcttggcaatttcttgtacaaacaaaatgttatctccttcaatgcatgtgctgctcagttaggctgtttcctcactttcatggtatctgagtgcttgctactggcatccatggcctatgaccgatacgtggccatttgtaaccctctcctctacatggttgtaatgtccccaggaatccgcattcagcttgtagctgttccctacagctatagctttcttatggcactatttcataccatcctcacttttcgcctctcctattgtcattccaatatcatcaatcatttctattgtgatgacatgcctctccttaggctaacctgttcagacactcactccaaacagctgtggatcttggcctgtgctgggatcacattcatttcctctgttctgattgtcttcgtctcctatatgtacattatttctgccatcctgaggatgcgctcagctgagggcaggcgcaaggctttctccacatgtggctctcacatgctggcagtcaccatcttctatgggaccctcatctttatgtacttacagccgagctcaaaccattccctagacacagacaaaatggcctcagtcttctacacagtgatcattcccatgttgaaccccttgatctacagcctcaggaataaagatgtaaaagatgccctgaaaaaagccatccttaatagaaaccaagctttgtgtttatga

SEQ ID NO: 714 - protein, 320 aa, Canis familiaris
MPLRDMAQINCTHVQEFILMGLTDRKELKMPFFVVFLSIYFLTVVGNLGLILVIRTDSRLTNTPMYFFLSNLAFVDFCYASVITPKMLGNFLYKQNVISFNACAAQLGCFLTFMVSECLLLASMAYDRYVAICNPLLYMVVMSPGIRIQLVAVPYSYSFLMALFHTILTFRLSYCHSNIINHFYCDDMPLLRLTCSDTHSKQLWILACAGITFISSVLIVFVSYMYIISAILRMRSAEGRRKAFSTCGSHMLAVTIFYGTLIFMYLQPSSNHSLDTDKMASVFYTVIIPMLNPLIYSLRNKDVKDALKKAILNRNQALCL

SEQ ID NO: 715 - DNA, 930 bp, Canis familiaris
atggctcctggaaatttcacacagatcactgagtttgttctcgtgggagtctcagaccgcccagacctccagatgccactcttctttgttttcctggtgatctatgggctcacggtggcagggaacctgggcatcatcaccctcaccagtgttgactcgcagcttcaaacgcccatgtacttcttcctcaggcacttggctatcatcaatcttggcgattctactgtcatttcccctaagatgctcttcaattttttagtaaaagagaaaaccactttgtactatgaatgtgccacccaactgggaggattcttggttttcattgtagctgaggtattcaccttagctgtgatggcctatgaccgctatgtggccatttgcaaccccctgctctacatggtggtggtatctccacagatttgccttttcttggtgtccctcacatacctctacagtttttccacagcacttgtagtttcatcttgtatattttctctgtcttattgctcttccaatgtaatcaatcattttttctgtgatattgtccctctgttaacattgtcctgctcagatacttaccttccagagacaatagtatttatatctgcagctacaaatttggttttatccttgattatagttctagtatcctatttcaacattgttttgtccattctaaggatgcattcatcagaaggaaggaaaaaagccttttccacatgtgcttcacatatgatggcagtcacagttttctacggaacactactattcatgtatttgcagcctcaaactaactactcattggatactgataaaattgcttctgtattttataccctggtgatccccatgttgaatcccatgatctacagcctgcggaataaggatgtgaaggctgccttacagagatttctgaaaaactcatgctga

SEQ ID NO: 716 - protein, 309 aa, Canis familiaris
MAPGNFTQITEFVLVGVSDRPDLQMPLFFVFLVIYGLTVAGNLGIITLTSVDSQLQTPMYFFLRHLAIINLGDSTVISPKMLFNFLVKEKTTLYYECATQLGGFLVFIVAEVFTLAVMAYDRYVAICNPLLYMVVVSPQICLFLVSLTYLYSFSTALVVSSCIFSLSYCSSNVINHFFCDIVPLLTLSCSDTYLPETIVFISAATNLVLSLIIVLVSYFNIVLSILRMHSSEGRKKAFSTCASHMMAVTVFYGTLLFMYLQPQTNYSLDTDKIASVFYTLVIPMLNPMIYSLRNKDVKAALQRFLKNSC

SEQ ID NO: 717 - DNA, 960 bp, Canis familiaris
atgaaccatatggataaacagaattatactgcagtgagtgaggtgactgaatttattctcatgggaatcaccaaaaaccctcgacttcaagcacccctctttggaatcttcttcatcatatacttggtcacggtgacaggcaatctgggcataattatcttgacccatttggactccaggctacagactccgatgtactttttccttagacatttgtcaattactgatcttggttactctactgtcattggcccaaaaatgatggtaaattttgtggtgcacaaaaatacaatctcctaccattggtgtgccacccagctggcagtctttgagattttcatcatcactgaactgtttattctttcagcaatggcctatgatcgctatgtagccatctgcaaacctcttttgtatgcggtcatcatggcagagaaggtacgttgggcgctggtccttgttccctatctctacagcatatttgtgtctctttttcttacaattaagttatttaaactgtccttctgtggatctaacattatcagttatttttactgtgactgccttcctctcatatccctgctctgttctgacacacatgagttagaattgatcattttaattttttcaggctgtaatttgctctcttctctcttgattgttcttgtatcctatatatttattcttgtggccattatcagaatgaactcaactgaagggagatacaaagccttctccacctgtagctcccatctgacagtggtgactgtgttctatgggacattactctttatttacctgcaacccaaatccagccatacatttgatattgataaaatggcttctgtgttttatactctggtgatccctatgctgaatccattgatctacagcttaaggaacaaagaagtaaaaggtgctctgaagagaactttaaccaatgggtgcaaaatccccacttag

SEQ ID NO: 718 - protein, 319 aa, Canis familiaris
MNHMDKQNYTAVSEVTEFILMGITKNPRLQAPLFGIFFIIYLVTVTGNLGIIILTHLDSRLQTPMYFFLRHLSITDLGYSTVIGPKMMVNFVVHKNTISYHWCATQLAVFEIFIITELFILSAMAYDRYVAICKPLLYAVIMAEKVRWALVLVPYLYSIFVSLFLTIKLFKLSFCGSNIISYFYCDCLPLISLLCSDTHELELIILIFSGCNLLSSLLIVLVSYIFILVAIIRMNSTEGRYKAFSTCSSHLTVVTVFYGTLLFIYLQPKSSHTFDIDKMASVFYTLVIPMLNPLIYSLRNKEVKGALKRTLTNGCKIPT

SEQ ID NO: 719 - DNA, 945 bp, Canis familiaris
atgggtaaacagaacctaacgtcagtgactgagttcattctgatgggagtcacacggcagcctgagcttcaagttcctctttttggggtcttcctcatcatctacatgatcacagtggtgggaaatttgggcatgatcaccttgatccaggtggactcccgcctccacacacctatgtatttttttatcaaacacctggctttcattgaccttggtaattctactgtcatctgtcccaagatgctggtaaattttgttgtggaccaaaatatcatttcttattatgcatgtgccacacagttggctttcttccttatgttcattatcagtgaatttttcatcttgtcagctatggcctatgaccgctatttggccatctgtaaccctttgctctacaacgttattatgtcccagagactttgctacatgctggtgggcattccatacctctacagtacctttcaggctctactgttcactattaagattttcacactgaccttctgtggatctaatgttatcaatcatttctattgtgatgatgttcccttgttacttatactctgctcaaatgcacaagaaataggattgttgatcatactattttcagcattgaatttgatctcttctttcctggtagtcctagtgtcctacatactaattctgacatgcatatttcaaatccattctacagagagcaggaaaaaagctttctccacatgtggttctgatctgacagtggtagttgtattctatgggtctctgctatttatgtacatgcagcccaaatctgcccattcttttgaaactgacaaaatggcctccgtattttacactttagtgatccccatgcttaaccccttaatctacagcctaaggaacaaagaggtaaaaaatgctttccgcaggttcttttttttttttttttttccgcaggttctttaa

SEQ ID NO: 720 - protein, 314 aa, Canis familiaris
MGKQNLTSVTEFILMGVTRQPELQVPLFGVFLIIYMITVVGNLGMITLIQVDSRLHTPMYFFIKHLAFIDLGNSTVICPKMLVNFVVDQNIISYYACATQLAFFLMFIISEFFILSAMAYDRYLAICNPLLYNVIMSQRLCYMLVGIPYLYSTFQALLFTIKIFTLTFCGSNVINHFYCDDVPLLLILCSNAQEIGLLIILFSALNLISSFLVVLVSYILILTCIFQIHSTESRKKAFSTCGSDLTVVVVFYGSLLFMYMQPKSAHSFETDKMASVFYTLVIPMLNPLIYSLRNKEVKNAFRRFFFFFFFPQVL

SEQ ID NO: 721 - DNA, 951 bp, Canis familiaris
atggaagagaagaatcagacaggagtgactgaatttcttttcttgggcctcacagatcatctccaccaacagattgtcctctttgtcatgcttctcttcgtctatcttgtcaccctggggggtaacatagggatgatcattctcatatggactgatcccagattccacacgcctatgtacttttttctcagccacttgtcctttgttgatctctgttcctcttcttccattgcccccaagatgctgtgtgatatctttgcagagaaaaaagacatctctttcatgggttgtgctgcacagatgtggttctttggcctttttgtggcaactgaatgttttctcctggcttccatggcatatgatcggtatatggccatctgtaagcccttgctgtatacactcattatgtcccagagggtctgtgtgcagctggtggtagggccttattccatggctcttataagcacaatgactcatacaattctcacatttcgcttacccttctgtggtccaaatgtcatcaatcacttcttctgtgacatttctccactgctttccctagcatgtgcagacacctggatcaataaattagtgttgttcatcatggcaggatctataggaatgctcagtggcctgatcatcatggtctcctatgtttgtatcctggtggccatcttgaagatccagactgctgatggaaggcagaaagctttctctacctgctcttctcacctggctgttgtctctgtgctgtatgggacacttttctttatctatgttcagcctggctccagtccctccctggatatcaataaagtgatttctctattttatactgtggtaatccccatgttgaaccccctcatctacagtctgaggaacaaggaggtgaaaaatgcattcaggaagaagtttgaaatgaaaaattccataatggctttggcaaaataa

SEQ ID NO: 722 - protein, 316 aa, Canis familiaris
MEEKNQTGVTEFLFLGLTDHLHQQIVLFVMLLFVYLVTLGGNIGMIILIWTDPRFHTPMYFFLSHLSFVDLCSSSSIAPKMLCDIFAEKKDISFMGCAAQMWFFGLFVATECFLLASMAYDRYMAICKPLLYTLIMSQRVCVQLVVGPYSMALISTMTHTILTFRLPFCGPNVINHFFCDISPLLSLACADTWINKLVLFIMAGSIGMLSGLIIMVSYVCILVAILKIQTADGRQKAFSTCSSHLAVVSVLYGTLFFIYVQPGSSPSLDINKVISLFYTVVIPMLNPLIYSLRNKEVKNAFRKKFEMKNSIMALAK

SEQ ID NO: 723 - DNA, 939 bp, Canis familiaris
atggccaaagagaatttcacagctgttactgaatttattcttttgggactgacagaccaccctgacctgaaaatcatactttttgtgttgttcttggtgatttatgcgattaccttgctggggaatctgggtatgatcttcataatccaaataactcccaagctccacacacccatgtattttttcctcagctgcctttcatttgtggatgcctgctattcatctgttattgcaccgaaaatgctgatcagcttcttggttgtgaaggaaaccatctcattctctgcctgcattgtgcaacatttgttttttggggtgtttattaccacagaaggcttcttgttgtcagtgatggcatatgaccgttatgtggccattgtcaactctttgctttacagtgcagccatgtctaagaggaagtgtgtagggtgggtcaatggatcttggatatgtggaataattaactcattaatacacacaataagcttaggcagactgtccttctgtgggtccaatgttgttaaccacttcttctgtgatattccctcactcctaaagctatcatgttctgatactaccatgaatgaattgttgctcttaactttctctggagtcattgccatggccaccttcttgattgtgatcatttcctacgtgtttattgctgttgctattctgaggatccgctcagcagcaggcggacagaaagccttctccacgtgtgcctcccacctgactgttgtgaccatattctatggtactttaagctttagctacatccagccaagttcccagtattctgtggagcaggagaaggtggtgtctgtgttctatacactagtgattcccatgttaaacccacttatttacagtctgaggaacaaagaggtaaaggatgctgtcaaaagggccatcgaaatgacacatttcccttgttaa

SEQ ID NO: 724 - protein, 312 aa, Canis familiaris
MAKENFTAVTEFILLGLTDHPDLKIILFVLFLVIYAITLLGNLGMIFIIQITPKLHTPMYFFLSCLSFVDACYSSVIAPKMLISFLVVKETISFSACIVQHLFFGVFITTEGFLLSVMAYDRYVAIVNSLLYSAAMSKRKCVGWVNGSWICGIINSLIHTISLGRLSFCGSNVVNHFFCDIPSLLKLSCSDTTMNELLLLTFSGVIAMATFLIVIISYVFIAVAILRIRSAAGGQKAFSTCASHLTVVTIFYGTLSFSYIQPSSQYSVEQEKVVSVFYTLVIPMLNPLIYSLRNKEVKDAVKRAIEMTHFPC

SEQ ID NO: 725 - DNA, 957 bp, Canis familiaris
atgagaagaaacaaacaaatggctgaagagaattatacaactgttactgaatttattcttttgggactgacggacctcactgacctgaaaattatactttttgtgttattcttggtgatttatgccattaccttactgggaaatatggttatgatcttcataatccaaataactcccaagctccacacacccatgtaccttttcctcagctgcctttcatttgtagatgcctgctattcatctgcaattgcaccaaaaatgttggtcaaccttctagttgtgaagggaaccattactttctctgcctgtatggtacaacatttgtgttttggggtgtttgttaccacagaaggcttcttgttgtcagtgatggcatatgaccgttatgtggccattgtcaactctttgctttacagtgcagccatgtctaagaggaagtgtgtagggtgggtcaatggatcttggatatgtggaataattaactcattaatacacacaataagcttaggcagactgtccttctgtgggtccaatgttgttaaccacttcttctgtgatattccctcactcctaaagctatcatgttctgatactaccatgaatgaattgttgctcttaactttctctggagtcattgccatggccaccttcttgattgtgatcatttcctacgtgtttattgctgttgctattctgaggatccgctcagcagcaggcagacagaaagccttctccacgtgtgcctcccacctgactgctgtgaccatattctatggtactttaagctttagctacatccagccaagttcccagtattttgtggagcaggagaaggtggtgtctgtgttctatacactagtgattcccatgttaaacccacttatttacagtctgaggaacaaagaggtaaaggatgctgtcaaaagggccatcgaaatgacacatttcccttgttaa

SEQ ID NO: 726 - protein, 318 aa, Canis familiaris
MRRNKQMAEENYTTVTEFILLGLTDLTDLKIILFVLFLVIYAITLLGNMVMIFIIQITPKLHTPMYLFLSCLSFVDACYSSAIAPKMLVNLLVVKGTITFSACMVQHLCFGVFVTTEGFLLSVMAYDRYVAIVNSLLYSAAMSKRKCVGWVNGSWICGIINSLIHTISLGRLSFCGSNVVNHFFCDIPSLLKLSCSDTTMNELLLLTFSGVIAMATFLIVIISYVFIAVAILRIRSAAGRQKAFSTCASHLTAVTIFYGTLSFSYIQPSSQYFVEQEKVVSVFYTLVIPMLNPLIYSLRNKEVKDAVKRAIEMTHFPC

SEQ ID NO: 727 - DNA, 942 bp, Canis familiaris
atggaaactcaaaatctaacagtgctcaatgagttcattctcatgggaatcacagacaaacctgagctgcaggctccactatttgggctcttcctcatcatctatttgatctcagtggtgggcaacctgggcatgattgtcctcaccaaggtggacgccagactacaaacacccatgtatttcttcctcagacacctggccttcactgatctgggttattcaacaactataggaccaaaaatgttagtaagtttttttttggaagaaaacacaatttcttattatttatgtgccacacagggagctttctacatgatcttcatcattagtgaactttttattctaactgctatgtcctacgaccgctacatggccatctgtaaccctctgctctaccccgtcatcatgtcacagaaggtgtgtcaggtgctggtggcaatcccttatctctacagcacatttgtgtctcttatagtcaccataaagatttttagttcattcttctgtggctacaatgttgtcaatcatttctactgtgactgtctccccttgttatctttgctctgctcaaatacacatgaaactgaaatgattattcttatcttagctggttttgatttgatttcatcccttctggtagttcttgtgtcttacctactgatcctagtagccatcatcaagatgaactcagctgagggtaggctcaaggctttttccacctgtggttcccacctgacagtggccacagtgttctatgggactttgatatttatgtatgtgcaacctgagtccagtcattcctttgacactgataaagtggcgtccatattttacaccctcgttatccccatgctgaatcccttgatctatagcttgaggaacaaagatgtaaaatatgcaagacaaaggatgtggaaaaaaatatgtaatatcttttcttaa

SEQ ID NO: 728 - protein, 313 aa, Canis familiaris
METQNLTVLNEFILMGITDKPELQAPLFGLFLIIYLISVVGNLGMIVLTKVDARLQTPMYFFLRHLAFTDLGYSTTIGPKMLVSFFLEENTISYYLCATQGAFYMIFIISELFILTAMSYDRYMAICNPLLYPVIMSQKVCQVLVAIPYLYSTFVSLIVTIKIFSSFFCGYNVVNHFYCDCLPLLSLLCSNTHETEMIILILAGFDLISSLLVVLVSYLLILVAIIKMNSAEGRLKAFSTCGSHLTVATVFYGTLIFMYVQPESSHSFDTDKVASIFYTLVIPMLNPLIYSLRNKDVKYARQRMWKKICNIFS

SEQ ID NO: 729 - DNA, 942 bp, Canis familiaris
atggaaaaacacaatctgaccatgctcaatgaattcattctcatgggaatcacacatcgtcctgagctgcaggctccattatttgggctcttctttatcatctatttgatctccgtggtgggcaacctgggcatgatcatcctcaccaaagtggatgccagactacaaacacccatgtacttcttcctcaaacacctggcttttactgaccttggttattcaacaaccgtgggacccaaaatgttagtaaattttattgtggatcaaaatacaatctcctattatttttgtgctatgcaactagctttctttcttgtgtttatcataagtgaacttttcattctaacagctatgtcctacgaccgttacgtggccatctgcaaccctctgctctaccccgtcatcatgtcacagagggtgtgtcaggtgctggtggcaatcccttatctctacagcacatttgtgtctcttctagtcaccataaagatttttagttcattcttctgtggctacaatgttgtcaatcatttctactgtgactgtctccccttgttatctttgctctgctcaaattcacatgaaactgaaatgattattcttatcttagctggttttgatttgatttcatcccttctggtagttcttgtgtcttacctactcatcctagtagccatcatcaggatgagctcagctgagggtaggctcaaggctttttccacctgtggttcccacctgacagtggccacagtgttctatgggactttgatatttatgtatgtgcaacctgagtccagccattcctttgacactgataaagtggcgtccatattttacaccctcgttatccccatgctgaatcccttgatctatagcttgaggaacaaagatgtaaaatatgcagtgcaaacaatgtggaaaaaactatgcaataatttttcttaa

SEQ ID NO: 730 - protein, 313 aa, Canis familiaris
MEKHNLTMLNEFILMGITHRPELQAPLFGLFFIIYLISVVGNLGMIILTKVDARLQTPMYFFLKHLAFTDLGYSTTVGPKMLVNFIVDQNTISYYFCAMQLAFFLVFIISELFILTAMSYDRYVAICNPLLYPVIMSQRVCQVLVAIPYLYSTFVSLLVTIKIFSSFFCGYNVVNHFYCDCLPLLSLLCSNSHETEMIILILAGFDLISSLLVVLVSYLLILVAIIRMSSAEGRLKAFSTCGSHLTVATVFYGTLIFMYVQPESSHSFDTDKVASIFYTLVIPMLNPLIYSLRNKDVKYAVQTMWKKLCNNFS

SEQ ID NO: 731 - DNA, 942 bp, Canis familiaris
atggcaaaacacaatctaacggtgctcaatgagttcattctcatgggaatcacagacaaacctgagctgcaggctccactatttgggctcttcctcatcatctatttgatctcagtggtgggcaacctgggcatgatcgtcctcaccaaggtggacgccagactacaaacacccatgtacttcttcctcagacacctggccttcactgatctgggttattcaacaactataggaccaaaaatgttagtaagtttttttttggaagaaaacacaatttcttattatttatgtgccacacagggagctttctacatgatcttcatcattagtgaactttttattctaactgctatgtcctacgaccgctacatggccatctgtaaccctctgctctaccccgtcatcatgtcacagaaggtgtgtcaggtgctggtggcaatcccttatctctatagcatatttgtttcactttttgtcaccgtaaagatctttagttcattcttctgtggctacaatgttgtcaatcatttctactgtgactgtctccccttgttatctttgctctgctcaaatacacatgaaattgaattgatgattttgattttctcagtttttgatgtcagttcatcccttctgatagttcttgtgtcttacctgctgatcctggtagccatcgtcaggatgaattcagctgagggtaggctcaaggctttttccacctgtgggtcccacctgacagtggccacagtgttctatgggactttgatatttatgtatgtgcaacctgagtccagccattcctttgacactgataaagtggcgtccatattttacacccttataatccccatgctgaatcccttgatctatagcttgaggaacaaagatgtaaagtatgctctacataggatatggaaaaaaatatgcaataccttttcttaa

SEQ ID NO: 732 - protein, 313 aa, Canis familiaris
MAKHNLTVLNEFILMGITDKPELQAPLFGLFLIIYLISVVGNLGMIVLTKVDARLQTPMYFFLRHLAFTDLGYSTTIGPKMLVSFFLEENTISYYLCATQGAFYMIFIISELFILTAMSYDRYMAICNPLLYPVIMSQKVCQVLVAIPYLYSIFVSLFVTVKIFSSFFCGYNVVNHFYCDCLPLLSLLCSNTHEIELMILIFSVFDVSSSLLIVLVSYLLILVAIVRMNSAEGRLKAFSTCGSHLTVATVFYGTLIFMYVQPESSHSFDTDKVASIFYTLIIPMLNPLIYSLRNKDVKYALHRIWKKICNTFS

SEQ ID NO: 733 - DNA, 351 bp, Canis familiaris
tgtgatagtctatcattgatagctttgctctgctcaggcacacatgaaattaagttgataattctgatcttttcagcttttaatttagtgtcatctcttatgatagccctgtgttttacatgctgatccttattgccatcctcaggatgaactttgcagaaggtaggcacaaggctttctccacctgtgaatcccatatgacactgatagtcatattttacggttctccatttttttatgtatgtgcagcccaaaccaattcattcatttgatagtgataaaatagcctccttattttacactttgattatattcatgctgaatcccatgatctacagtttgaggaaaaaa

SEQ ID NO: 734 - protein, 66 aa, Canis familiaris
  MOD_RES (66)..(66): Any amino acid
MGFTGGESLVPTFCKVHPEDGNKDQHVKHRAIIRDDTKLKAEKIRIINLISCVPEQSKAINDRLSX

SEQ ID NO: 735 - DNA, 510 bp, Canis familiaris
atggagaaacacaatctaacacagtggaaagaacacatccaaatgggaatcacagaactccctgagctgcaggctccattgtctggactcttcctcactgtttacctggtgtcactggtggataacctgagcttgatcatcctcaccaaggtggactctaggccacaaacacccatgtacatcttcctcagacacctagctttcactaatattggttgttcaatagctgtgggaccccaaatgctagtaagccttgttgtagatcaatctatcatctcttctaactgatgtgctacccaactcacttttttcattatgtttattactagtgaaattctcattttgtcagcaatggcctatgactgctatgtggccatctataatcctctgctctgcatagtcattatgtcacatagattatgtcagttgctggtggcataatctatcattttgtctttgctgatcattataaaaatttccctttcatagtttggtgactataatgtcatt

SEQ ID NO: 736 - protein, 95 aa, Canis familiaris
MEKHNLTQWKEHIQMGITELPELQAPLSGLFLTVYLVSLVDNLSLIILTKVDSRPQTPMYIFLRHLAFTNIGCSIAVGPQMLVSLVVDQSIISSN

SEQ ID NO: 737 - DNA, 852 bp, Canis familiaris
atgacctggatgaacagacaaaatctaacagtgttaacagaattcatcctaatgggaatcaccgaccgtcctgagctgcaggctcccttctttgggcttttcctcatcatctactcagtttcagtggtgggcaacctgggcatgatcatcctcaccaaggtggactccaggctccaaacacccatgtacttcttcctcagacacctggctttcattgatcttggctactcatcagctgtggcacccaaaatgttagtaaattttgtagctgatcaaaataccatcccctataactggtgtgctacccagctggctttcttcatcttgttcatcatcagtgagctgttcattctgtcagcaatggcctatgaccgctatgtggccatctgtaaccctctgctctacaccattgttatgtcacaaagggtgtgctgggtgctagtagcaatcccttatgtctacagtgcctttctttctctgataaccaccatcaagatttttatgtcatccttctgtggacataatgtcattagacatttttactgtgatagtcttcccttgttaactttgctgtgttcaagcacacgtgacattgagttgataatactgatcttttcagcatttaatttgatttcctcccttctcatagtgcttgtgtcctacatcctactcatggaggccatcatgtacgtgcaacccaaatccagtcattcctttgatactgataaaatcgcctctgcattttacactttgataatccctatgctgaatcccatgatctacagcttaaggaacaaagaggtaaaaggtgccctgcatagagtatggaaaaacttgcacatactgcctatg

SEQ ID NO: 738 - protein, 284 aa, Canis familiaris
MTWMNRQNLTVLTEFILMGITDRPELQAPFFGLFLIIYSVSVVGNLGMIILTKVDSRLQTPMYFFLRHLAFIDLGYSSAVAPKMLVNFVADQNTIPYNWCATQLAFFILFIISELFILSAMAYDRYVAICNPLLYTIVMSQRVCWVLVAIPYVYSAFLSLITTIKIFMSSFCGHNVIRHFYCDSLPLLTLLCSSTRDIELIILIFSAFNLISSLLIVLVSYILLMEAIMYVQPKSSHSFDTDKIASAFYTLIIPMLNPMIYSLRNKEVKGALHRVWKNLHILPM

SEQ ID NO: 739 - DNA, 948 bp, Canis familiaris
atggcctcagggaacctgacccacctgactgagttcattctcaggggagtctcagaccgcccagacctccagatgccactcttctttgttttcctggtgatctatgggctcaccatggcagggaacctgggcatcatcaccctcaccagtgttgactcgcagcttcaaacgcccatgtacttcttcctcaggcacttggctatcatcaatcttggcgattctactgtcattgcccctaagatgctggtcaacttcttggcttcaaagaaaaccatatcctactatggatgtgcagcccagctgggtggcttcttagtttttatcgtgggggagattttcatgctggctgcaatggcctacgaccgctacgtggctatttgcaaccccctgctctacatggtggtggtatctccgcagatctgccttctgctggtgtccctcacatacctctacagtctgaccacagcactgacggtctcctgctgtgtgttctctgtgtcatactgctcttccaatgtcatcaaccatttttactgtgatactgtccctttgttggcattgtcctgttctgatacctacattccagaaacagcggtgtttacctctgctgggaccaatttgtttttctccatgattattgttctaacctcctacttccacattgtccttgccattttgaggatacgttcctcagagggccgaagaaaagccttttccacctgtgcctcccacatgatggctgtcactgtgttctatgggaccattctctttatgtatttgcaaccaaggaccaaccactcattagatactgataaaatggcctctgtcttctacactctcgtgataccaatgctgaatcccctcatttacagcctaaggaacaaggatgtgaaggatgcattcaagagattcctaaagagcccttgccagtctttcaaattaatgtaa

SEQ ID NO: 740 - protein, 315 aa, Canis familiaris
MASGNLTHLTEFILRGVSDRPDLQMPLFFVFLVIYGLTMAGNLGIITLTSVDSQLQTPMYFFLRHLAIINLGDSTVIAPKMLVNFLASKKTISYYGCAAQLGGFLVFIVGEIFMLAAMAYDRYVAICNPLLYMVVVSPQICLLLVSLTYLYSLTTALTVSCCVFSVSYCSSNVINHFYCDTVPLLALSCSDTYIPETAVFTSAGTNLFFSMIIVLTSYFHIVLAILRIRSSEGRRKAFSTCASHMMAVTVFYGTILFMYLQPRTNHSLDTDKMASVFYTLVIPMLNPLIYSLRNKDVKDAFKRFLKSPCQSFKLM

SEQ ID NO: 741 - DNA, 951 bp, Canis familiaris
atgacctggatgaacagacaaaatctaacagtgttaacagaattcatcctaatgggaatcaccgaccatcctgagctgcaggctctcttctttgggcttttcctcatcatctacacagtttcagtggtgggcaacctgggcatgatcatcctcaccaaggtggactccaggctccaaacacccatgtacttcttcctcagacacctggctttcattgatcttggctactcatcagctgtggcacccaaaatgttagtaaattttgtagctgatcaaaataccatcccctataactggtgcgctacccagctggctttcttcatcttgttcatcatcagtgagctgttcattctgtcagcaatggcctatgaccgctatgtggccatctgtaaccctctgctctacaccgttgttatgtcacaaagggcgtgctgggtgctagtagcaatcccttatgtctacagttcctgtctctctctgataatcaccatcaagatttttatggcatccttctgtggacataatgtcattagacatttttactgtgacaatcttcctttgttaactttgctgtgttcaagcacacgtgacattgagttgataatactgatcttttcagcatttaatttgatttcctcccttctcatagtgcttgtgtcctacatcctcatccttatggccatcctgaggatgaactccacagagggcaggcacaaggccttctccacctgtggatcccacctgacggtggttgttgtattgtatgtcactctcttcttcatgtacgtgcagcccaaatccagtcattcctttgatactgataaaattgcctctatattttacactttgataatccctatgctgaatcccatgatctacagcctaaggaacaaagaggtaaaagatgccctgcatagaatatggaaaaacctgcataaaccacctatgtag

SEQ ID NO: 742 - protein, 316 aa, Canis familiaris
MTWMNRQNLTVLTEFILMGITDHPELQALFFGLFLIIYTVSVVGNLGMIILTKVDSRLQTPMYFFLRHLAFIDLGYSSAVAPKMLVNFVADQNTIPYNWCATQLAFFILFIISELFILSAMAYDRYVAICNPLLYTVVMSQRACWVLVAIPYVYSSCLSLIITIKIFMASFCGHNVIRHFYCDNLPLLTLLCSSTRDIELIILIFSAFNLISSLLIVLVSYILILMAILRMNSTEGRHKAFSTCGSHLTVVVVLYVTLFFMYVQPKSSHSFDTDKIASIFYTLIIPMLNPMIYSLRNKEVKDALHRIWKNLHKPPM

SEQ ID NO: 743 - DNA, 948 bp, Canis familiaris
atggcctcagggaacctgacccacctgactgagttcattctcaggggagtctcagaccacccagacctccagatgccactcttctttgttttcctggtgatctatgggctcaccgtggcagggaacctgggcatcatcaccctcaccagtgttgactcgcagcttcaaacgcccatgtacttcttcctcaggcacttggctatcatcaatcttggcgattctactgtcattgcccctaagatgctggtcaacttcttggcttcaaagaaaaccatatcctactatggatgtgcagcccagctgggtggcttcttagtttttatcgtgggggagattttcatgctggctgcaatggcctacgaccgctacgtggctatttgcaaccccctgctctacatggtggtggtatctccgcagatctgccttctgctggtgtccctcacatacctctacagtctgaccacagcactgaccgtttcctcctgtgtgttctctgtgtcatactgctcttccaatgtcatcaaccatttttactgtgatactgtccctttgttggcattgtcctgttctgatgcctacattccagaaacagtggtgtttgccttttcagggaccaatttgtttttctccatgattattgttctaacctcctacttccacattgtccttgccattttgaggatacgttcctcagagggccgaagaaaagccttttccacctgtgcctcccacatgatggctgtcactgtgttctatgggacccttctcttcatgtatttgcaaccaaggaccaaccactcattagatactgataaaatggcctctgtcttctacaccctggtgataccaatgctgaatcccctcatttacagcctaaggaacaaggatgtgaaggatgcattcaagagattcctaaagagcccttgccaggctttcaaattagtgtaa

SEQ ID NO: 744 - protein, 315 aa, Canis familiaris
MASGNLTHLTEFILRGVSDHPDLQMPLFFVFLVIYGLTVAGNLGIITLTSVDSQLQTPMYFFLRHLAIINLGDSTVIAPKMLVNFLASKKTISYYGCAAQLGGFLVFIVGEIFMLAAMAYDRYVAICNPLLYMVVVSPQICLLLVSLTYLYSLTTALTVSSCVFSVSYCSSNVINHFYCDTVPLLALSCSDAYIPETVVFAFSGTNLFFSMIIVLTSYFHIVLAILRIRSSEGRRKAFSTCASHMMAVTVFYGTLLFMYLQPRTNHSLDTDKMASVFYTLVIPMLNPLIYSLRNKDVKDAFKRFLKSPCQAFKLV

SEQ ID NO: 745 - DNA, 975 bp, Canis familiaris
atggttgttcccacagcaatttcgcttaatggcctggatgaacaaaatctaacagtgctaacagaattcatcctaatgggaatcaccgaccatcctgagctgcaggctctcttctttgggcttttcctcatcatctacacagtttcagtggtgggcaacctgggcatgatcatcctcaccaaggtggactccaggctccaaacacccatgtacttcttcctcagacacctggctttcattgatcttggctactcatcagctgtggcacccaaaatgttagtaaattttgtagctgatcaaaatacaatcccctataactggtgcgctacccagctggctttcttcatcttgttcatcatcagtgagctgttcaatctatctgcaatggcctatgaccgttatgtggccatctgtaaccctctgctctacaccattgttatgtcacaaagagtgtgctgggggctgataacaatcccttatgtctacagtgcctgtctctctctgataatcaccatcaagatttttatggcatccttctgtggacataatgtcattagacatttttactgtgatagtcttcccttgttaactttgctgtgttcaagcacacgtgacattgagttgataatactgatcttttcagcatttaatttgatttcctcccttctcatagtgcttgtgtcctacatcctcatccttatggccatccttaggatgaactctgcagagggcaggcacaaggccttctccacctgtggatcccacctgacggtggttgttgtattgtatgtcactctcttcttcatgtacgtgcagcccaaatccagtcattcctttgatactgataaaatcgcctctatattttacactttgataatccctatgctgaatcccatgatctacagtctaaggaacaaagaggtaaaaggtgccctgcatagaatatggaaaaacctgcataaaccacctgtgtag

SEQ ID NO: 746 - protein, 324 aa, Canis familiaris
MVVPTAISLNGLDEQNLTVLTEFILMGITDHPELQALFFGLFLIIYTVSVVGNLGMIILTKVDSRLQTPMYFFLRHLAFIDLGYSSAVAPKMLVNFVADQNTIPYNWCATQLAFFILFIISELFNLSAMAYDRYVAICNPLLYTIVMSQRVCWGLITIPYVYSACLSLIITIKIFMASFCGHNVIRHFYCDSLPLLTLLCSSTRDIELIILIFSAFNLISSLLIVLVSYILILMAILRMNSAEGRHKAFSTCGSHLTVVVVLYVTLFFMYVQPKSSHSFDTDKIASIFYTLIIPMLNPMIYSLRNKEVKGALHRIWKNLHKPPV

SEQ ID NO: 747 - DNA, 948 bp, Canis familiaris
atggcctcagggaacctgacccacctgactgagttcattcttaggggagtctcagaccgcccagacctccagatgccactcttctttgttttcctggtgatctatgggctcaccgtggcagggaacctgggcatcatcaccctcaccagtgttgactcgcagcttcaaacacccatgtacttcttcctcaggcacttggctatcatcaatcttggcgattctactgtcattgcccctaagatgctggtcaacttcttggcttcaaagaaaaccatatcctactatggatgtgcagcccagctgggtggcttcttagtttttatcgtgggggagattttcatgctggctgcaatggcctacgaccgctacgtggctatttgcaaccccctgctctacatggtggtggtatctccgcagatctgccttctgctggtgtccctcatatacctctacagtctgaccacagcactgaccgtttcctcctgtgtgttctctgtgtcatactgctcttccaacataatcgaccatttttactgtgataatgtccctttgttggcattgtcctgttctgatacctacattccagaaacagtagtgtttacctctgccgggaccaatttgtttttctccatgattattgttctaacctcctacttccacattgtccttgccattttgaggatacgttcctcagagggccgacgaaaagccttttccacctgtgcctcccacatgatggctgtcactgtgttctatgggacccttctcttcatgtatttgcaaccaaggaccaaccactcattagatactgataaaatggcctctgtcttctacaccctggtgataccaatgctgaatcccctcatttacagcctaaggaacaaggatgtgaaagatgcattcaagagattcctaaagagcccttgccaggctttcaaattagtgtaa

SEQ ID NO: 748 - protein, 315 aa, Canis familiaris
MASGNLTHLTEFILRGVSDRPDLQMPLFFVFLVIYGLTVAGNLGIITLTSVDSQLQTPMYFFLRHLAIINLGDSTVIAPKMLVNFLASKKTISYYGCAAQLGGFLVFIVGEIFMLAAMAYDRYVAICNPLLYMVVVSPQICLLLVSLIYLYSLTTALTVSSCVFSVSYCSSNIIDHFYCDNVPLLALSCSDTYIPETVVFTSAGTNLFFSMIIVLTSYFHIVLAILRIRSSEGRRKAFSTCASHMMAVTVFYGTLLFMYLQPRTNHSLDTDKMASVFYTLVIPMLNPLIYSLRNKDVKDAFKRFLKSPCQAFKLV

SEQ ID NO: 749 - DNA, 921 bp, Canis familiaris
atgaaaaatgtcactgaagttactacatttgtactaaagggcttcacagacaaacttgagctacaaatcatcttattcttcctgtttctaacaatctatgtctttactctgatgggaaatttaggactggttgcattggtcattggggattcccggctccacaaccccatgtactattttctgagtgtattatcatctgtggatgcctgctattcttcagtaattactccaaatatgctagtagattttatgtcaaagaataaagtcatttcattccttggatgtgcagcacagatgtttctcgctgttacttttgggaccacagaatgctttctcttggccgccatggcttatgatcgctatgtagcaatctacaaccctctcctatattctgtgagcatgtcgcccagagtctatgtgccactcatcattgcttcctatgttggtggcattttgcatgcttctgtacacacagtggccacgttcagcctatccttctgtgcttcaaatgaaattagacatgtcttttgtgacatccctccactacttgctatttcttgttctgacacccacacaaaccagctactgctcttctattttgcgggatctattgagataactactatactggtagtcctgatctcctatggtttcattgtcttggtaattctgaggatgcattctgctgaaggcagacgaaaaatcttttctacatgtggctctcacttaactggagtgtcaatctttcatggtacagttctcttcatgtatgtgagaccaagttccagctatgccctggaccatgacatgatagtgtcaatattttacacgattgtgattcccatgctgaatcctatcatctatagtttgaggaacaaagatgtaaaagatgcaatgcagaaagtgtttaggaaaaattga

SEQ ID NO: 750 - protein, 306 aa, Canis familiaris
MKNVTEVTTFVLKGFTDKLELQIILFFLFLTIYVFTLMGNLGLVALVIGDSRLHNPMYYFLSVLSSVDACYSSVITPNMLVDFMSKNKVISFLGCAAQMFLAVTFGTTECFLLAAMAYDRYVAIYNPLLYSVSMSPRVYVPLIIASYVGGILHASVHTVATFSLSFCASNEIRHVFCDIPPLLAISCSDTHTNQLLLFYFAGSIEITTILVVLISYGFIVLVILRMHSAEGRRKIFSTCGSHLTGVSIFHGTVLFMYVRPSSSYALDHDMIVSIFYTIVIPMLNPIIYSLRNKDVKDAMQKVFRKN

SEQ ID NO: 751 - DNA, 945 bp, Canis familiaris
atgaaaaatgtgactgaggccaccatgtttatattgatgggcttcacagatgattttgagatgcaggtcttcctatttttactatttctagcaatctatctttttactctgataggaaacttgggactggttatattggtgatgggggaatctcggctccacaaccccatgtattattttctgagcgttttatcattcctggatgcctgctattcttcagttgtcaccccaaaaatgttggtcaatttcctagcagaggataaatccatttcctatctcggatgtgcagcacagatgcttctcttcgttacttttggaaccacagaatgctttctcttggctgccatggcttatgaccgctatgtagcaatctacaaccctctcctgtattccgtgagcatgtcacccagggtctatgtgccactcatcgttgcttcctatgttggtggcattttgcatgcttctgtacacacagtggccacgttcagcctatccttctgtgcttccaatgaaattagacatgtcttttgtgacatccctccactacttgccatttcgtgttctgacacccacacaaaccagctgctgctcttctacttcgtgggctctattgagatagtcactatcctcattgttctgatctcctatggtttcattctcttggccattctgaacatccattctgccgaggggaggcggaaagtcttttctacgtgtggttctcacctaactggagtgtcaatttatcatggaaccatccttttcatatatatgagaccaagttccagttatgctttggagcatgacatgatagtgtcaatattttacacgattgtgattcctatgctgaatcccatcatctacagtttaaggaacaaagatgtaaaagaggcgatgaagaaattgtttatgagaaattggttcttaagtaaaacacataattag

SEQ ID NO: 752 - protein, 314 aa, Canis familiaris
MKNVTEATMFILMGFTDDFEMQVFLFLLFLAIYLFTLIGNLGLVILVMGESRLHNPMYYFLSVLSFLDACYSSVVTPKMLVNFLAEDKSISYLGCAAQMLLFVTFGTTECFLLAAMAYDRYVAIYNPLLYSVSMSPRVYVPLIVASYVGGILHASVHTVATFSLSFCASNEIRHVFCDIPPLLAISCSDTHTNQLLLFYFVGSIEIVTILIVLISYGFILLAILNIHSAEGRRKVFSTCGSHLTGVSIYHGTILFIYMRPSSSYALEHDMIVSIFYTIVIPMLNPIIYSLRNKDVKEAMKKLFMRNWFLSKTHN

SEQ ID NO: 753 - DNA, 567 bp, Canis familiaris
ttgagactggttatattggtcattggagattctcggctccacaaccccatgtattattttctgagtgttttatcattcctggatgcctgctattcttcagttgtcaccccaaaaatgttggtcaatttcctagcagaggataaatccatttcctatctcagatgtgcagcacagatgcttctcttcgttacttttggaaccacagaatgctttctcttggctgccatggcttatgaccgctatgtagcaatctacaaccctctcctgtattccgtgagcatgtcacccagggtctatgtgccactcatcgttgcttccaatgttggtcgcattttgcatgcttctgtacacacagtggccacgttcagcctatctttctgtgcatccaatgaaattagacatgtcttttgtgacatccctccactacttgccatttcttgttctgacatccacacaagccatacatacatacatacatgcatacatatacacacacatatatataaaacatgtgtgtaaaatatatataatgtatatatatggagtctatacaatgtacatacatct

SEQ ID NO: 754 - protein, 172 aa, Canis familiaris
LRLVILVIGDSRLHNPMYYFLSVLSFLDACYSSVVTPKMLVNFLAEDKSISYLRCAAQMLLFVTFGTTECFLLAAMAYDRYVAIYNPLLYSVSMSPRVYVPLIVASNVGRILHASVHTVATFSLSFCASNEIRHVFCDIPPLLAISCSDIHTSHTYIHTCIHIHTHIYKTCV

SEQ ID NO: 755 - DNA, 963 bp, Canis familiaris
atgaaaaatgtgactgaggccaccatgtttatattgatgggcttcacagatgattttgaggtgcaggtcttcctatttttactatttctagcaatctatctttttactctgataggaaacttgggactggttatattggtgatgggggaatctcggctccacaaccccatgtattattttctgagcgttttatcattcctggatgcctgctattcttcagttgtcaccccaaaaatgttggtcaatttcctagcagaggataaatccatttcctatctcggatgtgcagcacagatgcttctcttcgttacttttggaaccacagaatgctttctcttggctgccatggcttatgaccgctatgtagcaatctacaaccctctcctgtattccgtgagcatgtcacccagagtctatgtgccactcatcgttgcttcctatgttggtggcattttgcatgcttctgtacacacagtggccacgttcagcctatccttctgtgcttccaatgaaattagacatgtcttttgtgacatccctccactacttgccatttcgtgttctgacacccacacaaaccagctgctgctcttctacttcgtgggctctattgagatagtcactatcctcattgttctgatctcctatggtttcattctcttggccattctgaacatccattctgccgaggggaggcgtaaagtcttttctacgtgtggttctcacctaactggagtgtcaatttatcatggaaccatccttttcatgtatgtgagaccaagttccagctatgccctggaccatgacatgatagtgtcaatattttacacgattgtgattcctatgctgaatcccatcatctacagtttaaggaacaaagatgtaaaagcagcaatgaagaaatcgtttggtaaaaattggtgtatcaataaagtacacttttcacattcaccattaaattaa

SEQ ID NO: 756 - protein, 320 aa, Canis familiaris
MKNVTEATMFILMGFTDDFEVQVFLFLLFLAIYLFTLIGNLGLVILVMGESRLHNPMYYFLSVLSFLDACYSSVVTPKMLVNFLAEDKSISYLGCAAQMLLFVTFGTTECFLLAAMAYDRYVAIYNPLLYSVSMSPRVYVPLIVASYVGGILHASVHTVATFSLSFCASNEIRHVFCDIPPLLAISCSDTHTNQLLLFYFVGSIEIVTILIVLISYGFILLAILNIHSAEGRRKVFSTCGSHLTGVSIYHGTILFMYVRPSSSYALDHDMIVSIFYTIVIPMLNPIIYSLRNKDVKAAMKKSFGKNWCINKVHFSHSPLN

SEQ ID NO: 757 - DNA, 939 bp, Canis familiaris
atgaagaatgctacagaagtcaccatatttgtactgaagggcttcacagataagcttgagctgcaaacagccttgttcttcctgtttctagcaacctacctctttactatgatgggaaatttggttttagttttgttggtcattgtagattcccagctccacaaccccatgtactattttctgagtgtgttatcatctgtggatgcctgcttttcctccgtaattactccaaatatgttagtagattttatgttaaagaataaagtcatttcattccttggatgtgcagcacagatgtttcttgctgttacttttggaaccacagaatgctttctcttggctgccatggcttatgaccgctatgtagcaatctacaaccctctcctgtattctgtgggcatgtcacccagggtctatgtgccactcatcgttgcttcctatgttggtggcattttgcatgcttctgtacacacagtggccacgttcagcctatccttctgtgcatccaatgaaattagacatgtcttttgtgacatccctccactacttgccatttcgtgttctgacacccacacaaaccagctgctgctcttctacttcgtgggctctattgagatagtcactatcctcattgttctgatctcctatggtttcattgtcttggccattctgaacattcattctgctgaggggaggtggaaagtcttttctacgtgtggttctcacctaactggagtgtcaatttatcatggaaccatcgttttcatgtatgtgagaccaagttccagctatgctccagaccatgacatgatagtttcaatgttttatagcattgtgattcccatgctgaatcccatcatctacagtttaaggaacaaagatgtaaaagaggcaatgaaaagaatgtttcagaaaaaatggtttattaattcatactaa

SEQ ID NO: 758 - protein, 312 aa, Canis familiaris
MKNATEVTIFVLKGFTDKLELQTALFFLFLATYLFTMMGNLVLVLLVIVDSQLHNPMYYFLSVLSSVDACFSSVITPNMLVDFMLKNKVISFLGCAAQMFLAVTFGTTECFLLAAMAYDRYVAIYNPLLYSVGMSPRVYVPLIVASYVGGILHASVHTVATFSLSFCASNEIRHVFCDIPPLLAISCSDTHTNQLLLFYFVGSIEIVTILIVLISYGFIVLAILNIHSAEGRWKVFSTCGSHLTGVSIYHGTIVFMYVRPSSSYAPDHDMIVSMFYSIVIPMLNPIIYSLRNKDVKEAMKRMFQKKWFINSY

SEQ ID NO: 759 - DNA, 936 bp, Canis familiaris
atggagagaaagaataacacacccgtgcatgacttcatctttctgggattgacagattctgaagagatccagtcgatcctcttcatgctgtttctcctaatatacctggttactgtgctgggcaatgcagggatgatactgataatccacctggatctccagctacacacccccatgtattttttccttagtcacctgtcattccttgacctcagttactcaactgtcatcacacctaaaaccttagagaacttactgacttctaccaagcatatttcatacgggggctgcctcgtccagatgtatttttttgtcttcttgggggccactgaatgtttccttctctcctcaatggcctatgatcgctatgttgctatctgtaatcctctgcattacccagtggttatgtccacaagattctgctgttccctcgtctttgggtcctatttgattggctttgtggactcctttgtcactgtgcttcgaatgagcagattgcatttctgtgactccaatgtaatccatcacttcttctgtgatacacccccagttttagccctgtcttgcactgacacacatgacatcgaaatcatgatatttattgttgctggctccaccctaatggtgtctcttatcacaatatctgtgtcctatgtgtccattctgtctactatcctgaaaattacttccacttcaggaaagcgaaaagccttctctacttgtgcctctcatctcctgggagtcaccatcttttatggcactatgatttttacttatttaaagccaagtaagtcttactccctgggaaaggatcaagtggcttctgttttttatactattgtgatccccatgctgaatccacttatttatagtcttaggaacaaagaagtgaaaaatgctctcattagagtcatgcagaagggagaaggcaattga

SEQ ID NO: 760 - protein, 311 aa, Canis familiaris
MERKNNTPVHDFIFLGLTDSEEIQSILFMLFLLIYLVTVLGNAGMILIIHLDLQLHTPMYFFLSHLSFLDLSYSTVITPKTLENLLTSTKHISYGGCLVQMYFFVFLGATECFLLSSMAYDRYVAICNPLHYPVVMSTRFCCSLVFGSYLIGFVDSFVTVLRMSRLHFCDSNVIHHFFCDTPPVLALSCTDTHDIEIMIFIVAGSTLMVSLITISVSYVSILSTILKITSTSGKRKAFSTCASHLLGVTIFYGTMIFTYLKPSKSYSLGKDQVASVFYTIVIPMLNPLIYSLRNKEVKNALIRVMQKGEGN

SEQ ID NO: 761 - DNA, 918 bp, Canis familiaris
atggctggaaacaatttcactgaggtgacggtcttcatcctctctggatttgcaaattaccctgaactacaagtcagtcttttcttaatgtttctctttatttatctgttcactgttttggggaaccttgggctgatcatgttaatcagaattgactctcagcttcacacaccaatgtacttttttcttagcaacttagcattcattgacatattttattcctccactgtaacacccaaggcactggtaaatttccaatcccaacagaaaaccatctcttttgttgcctgctttgttcaaatgtacttttttgtgggtttggtgtgcagtgagtgttttcttctggggtcaatggcctaggaccgctacgtagccatctgcaatcctctattgtactcagtggttatgtcccagaaagtgtgcaactggctgggagccctgccatatgcaataggcttcacaaattctctggtatcagtctgtgtgataagtagtttgtcattctgtgattccagcatcaatcatttcttctgtgataccacagctcttttggccctatcctgtgcagatgcattcagcacagaaatggtgatctttattttagctgggatcacacttctcagttccctgctcctcatcacggtcacttacactgccatcatctcagccatcctgaggatccagtctacagcaggcagacagaaggccttttccacctgtgcatcccacctcatgggtgtaactatcttctatgggtctctgattttcacatatttgcagcctgataacacatcatccctgacccaggcacaggtggcatctgtcttctataccattgtcattccaatgctgaatccactgatctacagtctgaggaacaaagatgtgaaaaatgctctcctgagagtcatacacaga

SEQ ID NO: 762 - protein, 171 aa, Canis familiaris
MSQKVCNWLGALPYAIGFTNSLVSVCVISSLSFCDSSINHFFCDTTALLALSCADAFSTEMVIFILAGITLLSSLLLITVTYTAIISAILRIQSTAGRQKAFSTCASHLMGVTIFYGSLIFTYLQPDNTSSLTQAQVASVFYTIVIPMLNPLIYSLRNKDVKNALLRVIHR

SEQ ID NO: 763 - DNA, 903 bp, Canis familiaris
gtggaagagaagaatcagacaggagtgactgaatttcttttcttgagcctcacagatcatctccatcaacagattgtcctctttgtcatgctcctcttcatctatcttgtcaccctggggggtaacatagggatgatcattctcatatggactgatcccagattccacacgcctatgtactttttctcagccacttgtcctttgttgatctctgttcctcttcttccattgcccccaagatgctgtgtgatatctttgcagagaaaaaaggcatctctttcacggggttgtgctgcacagatatggttctttgacctttctgtggcaactgaatgttttctcctggcttccatggcatatgaccagtatatggccatctgtaagcctttgctatatagacttattatgtcccagagggtctgtgtgcagcttgtggtagggccttatgccatggctcttatatacagcatgacctatatgatgttggttttgcttacccttctgtggtcaaatgtcattaatcatttctgtgatttttcaccactgctttctcttgcatgtgcagacacttccatgattcagtttgtatttttctttttggctggatctatacaaatattcagtggcctgatcatcatgatctcctacgtttgcatcctggctgccttgaagatccagactgctgatgggaggcagaaagctttctccacttgctcttctcacctggccattgtctccatgctgtatgggactcttttctttatctatgtttggcctggctcaatttcatccctggatatcaataaagtgatttctctattttatactgtggtaatccccatgttgaacccccttatctacagtctgaagaacaaggaggtaaaaaaatgtattcaggaagaa

SEQ ID NO: 764 - protein, 301 aa, Canis familiaris
VEEKNQTGVTEFLFLSLTDHLHQQIVLFVMLLFIYLVTLGGNIGMIILIWTDPRFHTPMYFFSATCPLLISVPLLPLPPRCCVISLQRKKASLSRGCAAQIWFFDLSVATECFLLASMAYDQYMAICKPLLYRLIMSQRVCVQLVVGPYAMALIYSMTYMMLVLLTLLWSNVINHFCDFSPLLSLACADTSMIQFVFFFLAGSIQIFSGLIIMISYVCILAALKIQTADGRQKAFSTCSSHLAIVSMLYGTLFFIYVWPGSISSLDINKVISLFYTVVIPMLNPLIYSLKNKEVKKCIQEE

SEQ ID NO: 765 - DNA, 945 bp, Canis familiaris
atggattatggaaatcagactttggtgactgaatttttttttgtgggcttaacaaatcaattgcagcaccaggttgttctctttgtgatatttctcttggtttatcttgttactcttctgggaaatgtggggatgatcaccctcatttggttggatccccgactccacacacctatgtacttttttcttagccacttgtcctttgtggatgtctgctcttcttctgccattggtcctaagatgttgactgacatctttgtggagaaaaaagtaatctctttttttggttgtgctgctcagatctgtttttttggtcagtttgtagtgactgagtgttttctcctggcctccatggcatatgaccggtatatggccatctgtaagcccttgctgtatacactcattatgtcccagcgtgtctgtgtgcagctagtggtaggaccttatgccatgggtctgatgagcaccatgacccacacgactttagcctttaacctaccttattgtggcccccaaatcatcaatcacttcttctgtgaccttcttcctgttctgtccttggcatgtgcagacacccaggtcaatcagtttctacttttcatcttggctggagctctaggtgtgctcagtggtgtgatcatcctagtttcctacacttacattgtcatcactatcctgaggatccgctctgctgcggggaggcacaaagccttttccacctgctcttcacacctgacagctgtctccatcctgtatgggacactcttctttatctacgtacgccccagttctagtttctccctggacatcaataaagtggtttcagtgttctatacatctgtgactcctatgttgaacccccttatctacagcctgagaaacagagaggtcaaggattcattcagaaggacgtttgagaagaagcagtttctcatgagtagataa

SEQ ID NO: 766 - protein, 314 aa, Canis familiaris
MDYGNQTLVTEFFFVGLTNQLQHQVVLFVIFLLVYLVTLLGNVGMITLIWLDPRLHTPMYFFLSHLSFVDVCSSSAIGPKMLTDIFVEKKVISFFGCAAQICFFGQFVVTECFLLASMAYDRYMAICKPLLYTLIMSQRVCVQLVVGPYAMGLMSTMTHTTLAFNLPYCGPQIINHFFCDLLPVLSLACADTQVNQFLLFILAGALGVLSGVIILVSYTYIVITILRIRSAAGRHKAFSTCSSHLTAVSILYGTLFFIYVRPSSSFSLDINKVVSVFYTSVTPMLNPLIYSLRNREVKDSFRRTFEKKQFLMSR

SEQ ID NO: 767 - DNA, 939 bp, Canis familiaris
atggccaacagaaatgtcagtgtggtaactgaattcattctcctgggactgactgataaccctgacctgaacactgccctgttcgtgctgtttctctcaatctacctcgtcacagtggtgggcaatgcttggattatcgcagtaatctgggtaagtgcccagctccattcccccaagtactttttcctttgtcagttggctttcttggatttctgctattcctcagtctttattcctaagatgttggtgaactacataacaggacagaaatccatctcctatcatggttgcctcctgcagtattccttcgtcaacatgttcttgaccaccgaatgcttcctcctggccgccatggcctatgatcggtatgtcgccatttgctgcccacttcactacaaaggcctcatgacccacacattctgtgtccacttggtgactgcttgctacctagtaggttctgctagctcactcacccacctgagcagcttgctcagcctgtctttctgtgggcccaacgtcatcaaccattacttctgtgacatcccactgctttttcaactgtcctgttctgacacccaatctagtgagattttatttattgtcttctctggcacaacatcggtgactacctttctgatagtggttagttcttatctgggaatcctccgcactgtcctgaagttacactccacaaggagcagatataaagcattctccacatgtgcttctcacctcacagtagtgactcttttctatggaacagtgatatttacttatctgggaagcagctctagctacccacgggatagagccaaaatcttgtccatattttatactcttttgctaccagtcctaaatttcctgatatacagtgtgagaaacagagaggccaaagaagcaatgaaaagaattattttgagaaaagtatttgctcagtga

SEQ ID NO: 768 - protein, 312 aa, Canis familiaris
MANRNVSVVTEFILLGLTDNPDLNTALFVLFLSIYLVTVVGNAWIIAVIWVSAQLHSPKYFFLCQLAFLDFCYSSVFIPKMLVNYITGQKSISYHGCLLQYSFVNMFLTTECFLLAAMAYDRYVAICCPLHYKGLMTHTFCVHLVTACYLVGSASSLTHLSSLLSLSFCGPNVINHYFCDIPLLFQLSCSDTQSSEILFIVFSGTTSVTTFLIVVSSYLGILRTVLKLHSTRSRYKAFSTCASHLTVVTLFYGTVIFTYLGSSSSYPRDRAKILSIFYTLLLPVLNFLIYSVRNREAKEAMKRIILRKVFAQ

SEQ ID NO: 769 - DNA, 939 bp, Canis familiaris
atggctgatgttaattttacattggttacagagtttatccttttgggactgacagatcgtgctgaactgaaagttgtcctctttgtgcttttcctgctgatctataccatttctttggtggggaatctaggaatggtctttctaatccaagtaactcccaaactccaaacacccatgtatcatttccttagctgcctgtcatttgttgatgcctgctattcatcagtctttgcaccaaaaatgctgctgaacttctttgttgaacgggagacaatctcattctctgcatgcattgtgcagtattttttatttgtgtcactccttaccactgagggcttcttgctggcggcaatggcttatgaccgctacatggccattgtgaaccctttattttacacagtggctatgactaaaatagtttgcattgtcctggtcattgggtcatgtgtaggaggcttaatcaactcattgacacacacaattggtttggtgaaattgtctttctgtgggccaaatatcatcagtcacttcttctgtgaccttcccccactattgaagttgtcatgttctgacacatccatgaatgaactgttgcttttaatcttctctggaattattgctatgatcactttcttgattgtgatgatctcctatgtcttcattgttgctgctattctgaggatccgctcagcagcaggtagacacaaagccttctccacctgtgcttcacatttaacggctgtgactttattctatggctctataagctttagttacattcaaccaagctctcaatattccttagaacaagaaaaggtggtatctgtgttttataccctggtgattcctatgttaaacccagtgatttacagcctgagaaacaaggaagtaaaagatgctgtgaaaagagctacagaaataaaatattgtccttgttaa

SEQ ID NO: 770 - protein, 312 aa, Canis familiaris
MADVNFTLVTEFILLGLTDRAELKVVLFVLFLLIYTISLVGNLGMVFLIQVTPKLQTPMYHFLSCLSFVDACYSSVFAPKMLLNFFVERETISFSACIVQYFLFVSLLTTEGFLLAAMAYDRYMAIVNPLFYTVAMTKIVCIVLVIGSCVGGLINSLTHTIGLVKLSFCGPNIISHFFCDLPPLLKLSCSDTSMNELLLLIFSGIIAMITFLIVMISYVFIVAAILRIRSAAGRHKAFSTCASHLTAVTLFYGSISFSYIQPSSQYSLEQEKVVSVFYTLVIPMLNPVIYSLRNKEVKDAVKRATEIKYCPC

SEQ ID NO: 771 - DNA, 933 bp, Canis familiaris
atggcaggttggaatcatacaggggtgaaggaattccttctggtaggtttaacagaaaaccctaatttgcagatccctctttttttgcttttcacccttatttacttcaccactctggcaggtaactggggcatgattatgttgatctggttaaatgcccaacttcatactcctatgtacttcttccttagcaacctctctttttgtgatatctgctactctactgtctttgctccaaagatgttggtcaatttcctatcgaaacacaagtccagcacattttctggttgtgttctacagagtttcttttttgcagtatatgtaaccacagaaggcatcctcctatctatgatggcttatgaccgctatgtggcaatagctaatcctttgttgtatagagtcataatgacccaaagagtttgtattcagatggtccttgcatcttacttgggtgggctcattaactcactgacacatacaataggtttgctcaaactggacttctgtggtcctaacattgtgaatcattatttctgtgacattccccctcttctgagactctcttgctctgatgcccacaacaatgagatgctgcttttaatattctctggggtcattgcaatgttcactttcactataattatggtctcttatatgtgcattatcatggccatccagagaatccgctcagctgaggggaggcgcaaagccttctctacttgtgcctctcatctgactgccgtgacattattctatgggtctgtgacctttagttacatccagccaagttcccagtattccctggaacaggagaaggtctctgctgtgttttatacattggtgatccccatgctaaacccattgatttatagcctacgaaataaggatgtaaaagatgcagccaagaggtccatatggtggaagagaacttaa

SEQ ID NO: 772 - protein, 310 aa, Canis familiaris
MAGWNHTGVKEFLLVGLTENPNLQIPLFLLFTLIYFTTLAGNWGMIMLIWLNAQLHTPMYFFLSNLSFCDICYSTVFAPKMLVNFLSKHKSSTFSGCVLQSFFFAVYVTTEGILLSMMAYDRYVAIANPLLYRVIMTQRVCIQMVLASYLGGLINSLTHTIGLLKLDFCGPNIVNHYFCDIPPLLRLSCSDAHNNEMLLLIFSGVIAMFTFTIIMVSYMCIIMAIQRIRSAEGRRKAFSTCASHLTAVTLFYGSVTFSYIQPSSQYSLEQEKVSAVFYTLVIPMLNPLIYSLRNKDVKDAAKRSIWWKRT

SEQ ID NO: 773 - DNA, 939 bp, Canis familiaris
atgtgggagagcaattataccatgccaactgagtttcttcttgttggattcacagattatctacctctcagagtcacactattcttggtatttctcatagtctatacactaactatggtaggaaatatgagtttaataatcctagttaatatcagttctagccttcaaactcctatgtattatctcctcagcaacttgtctttcttagacatctgctattctacagcaatcgcacctaaaatgctggtaaatttcttagcatccaggaaaagcatctctccctatggctgtgcgctacaaatgtttttctttggttgttttgctgatgctgagtgtcttattctggcagcaatggcttatgaccgctatgcagccatctgcaacccattgctctattctgcatttatgtctaggagagtctgtatttgctccattgtgttggcatacttcagcggaagtatgacatctatggtacatgtgtgcctcacattcaggctgccattttgtggctccaatattgttaatcattttttctgtgatatcccacctctcctggctttatcatgtgcagatacctatatcaacgagcttttgctctttgccttgtgtggcttcattcagaccagcacttttgtggtcatatttatctcttacttctgtattctcctcactgttttgagcattaagtcctcagggggcagaagtaaaacattctccacttgtagttcccattttatagcagtcacattattctatggaacactcttgtttacatatttacgtcccaccaccagctattccctagacactgacaaggtagttgcagtgttttatactgttgtcttccccatgtttaacccaataatctacagctttagaaacaaggatgtaaagaatgccctaaaaaagctattagaaagaaactggacttttaaatga

SEQ ID NO: 774 - protein, 312 aa, Canis familiaris
MWESNYTMPTEFLLVGFTDYLPLRVTLFLVFLIVYTLTMVGNMSLIILVNISSSLQTPMYYLLSNLSFLDICYSTAIAPKMLVNFLASRKSISPYGCALQMFFFGCFADAECLILAAMAYDRYAAICNPLLYSAFMSRRVCICSIVLAYFSGSMTSMVHVCLTFRLPFCGSNIVNHFFCDIPPLLALSCADTYINELLLFALCGFIQTSTFVVIFISYFCILLTVLSIKSSGGRSKTFSTCSSHFIAVTLFYGTLLFTYLRPTTSYSLDTDKVVAVFYTVVFPMFNPIIYSFRNKDVKNALKKLLERNWTFK

SEQ ID NO: 775 - DNA, 972 bp, Canis familiaris
atgaccagaagaaaccatacttcactaactgaattcatcctgttgggattagcagacacaatggagctacaggtcatcctctttttgctttttctggtgatttacacacttactgttttggggaatgttgggatgatcctcttaatcaggactgattcccaacttcacacacccatgtatttcttcctggctaacttgtcctttgtggatgtttgttactcctccaccatcaccccaaagatgctggtagacttattgtcagagaagaaaaccatctcctttgctggctgcttcctgcaattgtacttcttcatcgccttggccacaactgaatgcatcctctttgggttaatggcctatgaccgctatgtggccatatgcaacccactactttactccttgatcatgtccaggactgtctgcctcaaaatggcagcaggggcttttacagcaggattcttgaactccatggttaacacaagttatataagcagcttgccattctgcagttccaatgtcattcaccacttcttctgtgacagccctccactttttagactctcatgttctgacacacgcctgaatgaaagcatcttttccacatttgctggtatgaatatggtcggggctttgttggtcatcctgacctcttattcctacattctgttttcaatcttccatatgcattcaggggaggggaagcgcaaagcattctcaacctgtggctctcacttgacagctttaactctgttctatgccaccgccatctacacctatctgagacctagttccagctactccctggataaggacaaagtggcttctgtgttctacacagtggtgatccccatgttgaatcctctgatctacagcctcaggaatagagaagtaaagaaagctttatggaatgtaactatcaggacaaggattcccttcatttctctgatctccttagtaaattttctgaactag

SEQ ID NO: 776 - protein, 323 aa, Canis familiaris
MTRRNHTSLTEFILLGLADTMELQVILFLLFLVIYTLTVLGNVGMILLIRTDSQLHTPMYFFLANLSFVDVCYSSTITPKMLVDLLSEKKTISFAGCFLQLYFFIALATTECILFGLMAYDRYVAICNPLLYSLIMSRTVCLKMAAGAFTAGFLNSMVNTSYISSLPFCSSNVIHHFFCDSPPLFRLSCSDTRLNESIFSTFAGMNMVGALLVILTSYSYILFSIFHMHSGEGKRKAFSTCGSHLTALTLFYATAIYTYLRPSSSYSLDKDKVASVFYTVVIPMLNPLIYSLRNREVKKALWNVTIRTRIPFISLISLVNFLN

SEQ ID NO: 777 - DNA, 957 bp, Canis familiaris
atggaatccacaggacaaaatcctctgcaggcgaatcacactacattaatggatttcatcctggttggtttttctgatgttcctaacctccgaggactactttttggggtgtttctgataatctatgtgattattctgatgggtaatagcctcattatcataataaccaaggtcaatccctccctccagactcctatgtattttttccttgggaacttttcttccttggaaatatgttatgtgtcggtcactgtccccagattattaacagatctttgtagacaaaatagaaatatttcttttctggcctgtgctactcaaatgtatttctttctgatctttggagccagtgagtgcttcattctgactgcaatggcttatgacaggtatgttgccatttgcaaccccttactctatcctctcatcatgaacaacaggctgtgcatccaattggcaactggctgttggatcactggaattccagtacacatagggttcacctacctcatcttctctctacacttctgtgggtccaataagttgaatcactttttctgtgacatacctccagtacttaagcttgcctgtggggatacgttcatgattgaaatgttggtttatgaggttgctgttctagttgtcactattccttttttgttgattcttgcatcttatgtgaaaataatctcaaccatcctgaaattgccatcagcagctgggcgagccaaggccttctccacttgttcttcacatctcatggttgtggctttattctttggatcaggcatcattacatacttaagaccaaagtccagtcattcaacaggaatggacaagtttctttctcttttttataccattgtgacaccaatgtttaaccccataatatattgtctaagaaacaaagaagttatggtggcattcaaaaaatccctaccaaaatggattgtactatga

SEQ ID NO: 778 - protein, 318 aa, Canis familiaris
MESTGQNPLQANHTTLMDFILVGFSDVPNLRGLLFGVFLIIYVIILMGNSLIIIITKVNPSLQTPMYFFLGNFSSLEICYVSVTVPRLLTDLCRQNRNISFLACATQMYFFLIFGASECFILTAMAYDRYVAICNPLLYPLIMNNRLCIQLATGCWITGIPVHIGFTYLIFSLHFCGSNKLNHFFCDIPPVLKLACGDTFMIEMLVYEVAVLVVTIPFLLILASYVKIISTILKLPSAAGRAKAFSTCSSHLMVVALFFGSGIITYLRPKSSHSTGMDKFLSLFYTIVTPMFNPIIYCLRNKEVMVAFKKSLPKWIVL

SEQ ID NO: 779 - DNA, 933 bp, Canis familiaris
atggaaaatgtgactgaagtcaccacgtttatattgacgggcttcacagatgattttaaactgcaagttttcctatttttactatttctagcaatctacctttttacaatgataggaaatttgggaatggttttattggtccttggggattctcggctccacaaccccatgtattattttctgagcgtgttatcattcctggatgcctgttattcttcagctgttactccaaaaatgttagtcaatttcctagcagaggataaaaccatttcattccttggatgtgcagcacagatgtttctctttatttcttttgggaccacagaatgctttattttagctgcaatggcatatgatcgctacgaagcgatctacaaccctctcctgtattcagttcgaatgtcacccagagtctatgtgccactcataatttcctgctatgtatgtggattcctgcatgctactttacacactgtggctacttttactctatccttttgtgcatccaatgaaattagacatgtcttttgtgacatccctcctctccttgccatttcttgttctgacacccacacaaaccagctgctagtcttctactttgcgggatctattgagatatccactattctgatagtcctggtctcttatggtttcattctggtggccattatgagggtgcattctgctgaagggaggcggaaagtcttttctacatgtggctctcacttaactggagtgtcaatttttcatggtacggttctcttcatgtatgtgagacccaattccagctatgctttggatcatgatatgatagtgtcagtattttacacaattgtgattcccatgctgaatcctatcatctatagtttgaggaacaaagatgtgaaagatgcagtgaaaagggtatttggtaaaaactggtttgccaattaa

SEQ ID NO: 780 - protein, 310 aa, Canis familiaris
MENVTEVTTFILTGFTDDFKLQVFLFLLFLAIYLFTMIGNLGMVLLVLGDSRLHNPMYYFLSVLSFLDACYSSAVTPKMLVNFLAEDKTISFLGCAAQMFLFISFGTTECFILAAMAYDRYEAIYNPLLYSVRMSPRVYVPLIISCYVCGFLHATLHTVATFTLSFCASNEIRHVFCDIPPLLAISCSDTHTNQLLVFYFAGSIEISTILIVLVSYGFILVAIMRVHSAEGRRKVFSTCGSHLTGVSIFHGTVLFMYVRPNSSYALDHDMIVSVFYTIVIPMLNPIIYSLRNKDVKDAVKRVFGKNWFAN

SEQ ID NO: 781 - DNA, 933 bp, Canis familiaris
atggaaaaaaaaacagcagaagtaaatctcacttcgatgacggaatttattcttttgggattttctgatattcccaatcttcaaatgtttctttttgtagtatttttctttgtctatgtgataattttgatgggaaacggcatcattgttctcataaccaagactgaccaggctctccagactcccatgtattttttccttagtaatttttccttcttggaaatctgttttgtatctgccactcttcccaaaatgctcacaaacctttggacccagaaaagaaatatttcgttgtttgcctgtgcaacacaaatgtgttttgtcctcatgcttgggaatatagagtgcctccttctgatggtgatggcctatgaccgctacgttgccatttgtgaccctctgcactaccctctaatcatgaaccacaaggtctgtgttcagcttgtgaccgcctgctggatcaccggggttccagtcgagatagggcagacatgccagatcttctctctgccattttgtgggtcgagccaaatcaatcacttcttctgtgacatccccccactgcttaagctggcctgtggggatactttcctgaatgagatgttagtctttacagtcgctgttctctttgttatgatcccctttctgttgatacttggatcctacagtaaaatcatctctaccatcctgaggttgccatccgcaacaggacgaaccaaagctttctccacctgctcatctcatgtcatagttgtggccatgttttttggttctgcagtcatcacatatttacgacccaaatccaaacattcttccagaacagacaaatttctttctcttttctataccattgtcaccccaatgtttaatcctatgatatacactctgagaaataaggatgccatgatggccttgagaaaattgttgccttaa

SEQ ID NO: 782 - protein, 310 aa, Canis familiaris
MEKKTAEVNLTSMTEFILLGFSDIPNLQMFLFVVFFFVYVIILMGNGIIVLITKTDQALQTPMYFFLSNFSFLEICFVSATLPKMLTNLWTQKRNISLFACATQMCFVLMLGNIECLLLMVMAYDRYVAICDPLHYPLIMNHKVCVQLVTACWITGVPVEIGQTCQIFSLPFCGSSQINHFFCDIPPLLKLACGDTFLNEMLVFTVAVLFVMIPFLLILGSYSKIISTILRLPSATGRTKAFSTCSSHVIVVAMFFGSAVITYLRPKSKHSSRTDKFLSLFYTIVTPMFNPMIYTLRNKDAMMALRKLLP

SEQ ID NO: 783 - DNA, 951 bp, Canis familiaris
atggagaacacattaaaaacagaaaattttaatgttactaccattgtggaatttgttctcttggggttttctgatattcccaatctccaatggattctttttgggatatttttagtcatctacctaactatactgatgtgtaatagcatcataatattgataataagaattgaccctgctctccagacccccatgtatttttttcttagcaatttttccttcttagaaatctgttatgtaacagtcactatcccaagaatgctcatggacctattgacccagaaaggaaatatttctttctttgcctgtgctgcacaaatgtgttttgtccttatgtttggaggctcagaatgtcttctcctgacagtgatggcctatgatcgctacgtggccatttgtaaccctctgcattaccctctcgtcatgaaccacaaggtctgtgtccagctggtgactgttgcctggatcagtggagtaccagttgtgattggacaaacatgccagattttctctctgcccttctgtgggtctaacacaattaatcatttcttctgtgaccttcccccagtactcaagcttgcttgtggggacacatttttgaacgagatagcagtctatgttgttgcagtggtcttcgtcatgattccttttctgttgattgttgtttcctatggcaaaatcatctccaacattctgaaattgtcaacagccaaaggaagggctaaagccttctccacctgttcttctcacctgatagttgtagtcttattctatggaacagctactatcacttatttacaacccaaaccaaatcaatctgaaggagttgggaaattgatttctcttttctataccattttgatcccaacattgaatccccttatatatactctgaggaacaaagatatcatggtagcactgagaaaactactaacgaagttattaccgtga

SEQ ID NO: 784 - protein, 316 aa, Canis familiaris
MENTLKTENFNVTTIVEFVLLGFSDIPNLQWILFGIFLVIYLTILMCNSIIILIIRIDPALQTPMYFFLSNFSFLEICYVTVTIPRMLMDLLTQKGNISFFACAAQMCFVLMFGGSECLLLTVMAYDRYVAICNPLHYPLVMNHKVCVQLVTVAWISGVPVVIGQTCQIFSLPFCGSNTINHFFCDLPPVLKLACGDTFLNEIAVYVVAVVFVMIPFLLIVVSYGKIISNILKLSTAKGRAKAFSTCSSHLIVVVLFYGTATITYLQPKPNQSEGVGKLISLFYTILIPTLNPLIYTLRNKDIMVALRKLLTKLLP

SEQ ID NO: 785 - DNA, 795 bp, Canis familiaris
tttctcatctacataataatctttatggcaaatggcatcattattctcataactagaattggccagcctgttaattttttccttagtaatttttctttcctgaaaatattttatgtatttgtcattctttctagaatgctcctaaacctttggactcagaaaagaaacatttctttttctgcctgtgttacaaaaatatgttttctctttatgcttggaaacatggaatgctttctcccgatagcgttggcctatgaccactacatggccatttgtcatgttccatcctgtcctccagttatgaaccacaagctccatgtccagctgacattgactggcttttggatcagtagagttccagtcaaaatagggtagacatgccagattttctctctgccattttgtgagtctaaccaaatcagctacttgttctgagacatccctgtactactcaagctggcccgtggggacactttcctggatgggatgttagcttttatagttactgtgctttttattattattcttttttcactgatacttggatcctatagtaaaattatcccctctatcttgaagttgctgttggcaacaagaccagccaaagctttatccacttactcatctcacatcatagttgtagcttgattctctggatcccaaattgttacatatttatgacccaaatccaaatatatttttcagaatagactaatttatttctctttctgtataccattgtcattatgatgtttaaacccatgcatgatatatactctaaggagtaaagattca

SEQ ID NO: 786 - protein, 124 aa, Canis familiaris
FLIYIIIFMANGIIILITRIGQPVNFFLSNFSFLKIFYVFVILSRMLLNLWTQKRNISFSACVTKICFLFMLGNMECFLPIALAYDHYMAICHVPSCPPVMNHKLHVQLTLTGFWISRVPVKIG

SEQ ID NO: 787 - DNA, 945 bp, Canis familiaris
atggctgatggaaaccatacaagaatcacagaatttattttcataggcttgaagtatcatcctcggatgcaagtcttccttttcttgctctttctacttttttactttgttaccgtgacaggaaacttgggtatgattattctcatccagatggattcccgccttcacacacccatgtacttttttctcagtcacctgtctttcgtggacatctgcttttcttcagttgtgggtcccaagatgctcaccgacttcttcgctgaaaagaaggccatctccttcctgggctgtgctttgcagcaatggttctttggattctttgtggccattgagtgtcttctgctggcatccatggcctatgatcgctatgttgccatctgtaacccattattatattctgttgccatgtcacagagactctgcatacagctggtggttggaccctacactgttgggtttctgagcaccatgactcacaccacggctgctttccgacttcccttttgtggctccaacattatcaatcatttcttctgtgacatgtccccccttctttctttggtatgtgctgacacccggatcaataaattgttagttttcattgtggctggagccgtactggttgtcagtagcctgaccattataatctcctatttttacatccttactgccatcctgaggatccgttctgccgatgggaggcgcaaagccttttccacctgttcctcccacctcaccgcggtgtccatcttatacgggacactcttctttatctacgtgaggccaggtgcaattttttccctggatgtcaataaagtggtctcagtgttctacacagcagtgatccccatgttgaatcctctcatctacagcttgagaaataaagaagtgaaagctgccatgcacagaatgatcatcaggaggaagttttgcatcagaagttaa

SEQ ID NO: 788 - protein, 314 aa, Canis familiaris
MADGNHTRITEFIFIGLKYHPRMQVFLFLLFLLFYFVTVTGNLGMIILIQMDSRLHTPMYFFLSHLSFVDICFSSVVGPKMLTDFFAEKKAISFLGCALQQWFFGFFVAIECLLLASMAYDRYVAICNPLLYSVAMSQRLCIQLVVGPYTVGFLSTMTHTTAAFRLPFCGSNIINHFFCDMSPLLSLVCADTRINKLLVFIVAGAVLVVSSLTIIISYFYILTAILRIRSADGRRKAFSTCSSHLTAVSILYGTLFFIYVRPGAIFSLDVNKVVSVFYTAVIPMLNPLIYSLRNKEVKAAMHRMIIRRKFCIRS

SEQ ID NO: 789 - DNA, 942 bp, Canis familiaris
atgaaacaccaagaaaaaccaccagaagataatctaactgaactgatagaatttgttctcttggactttgctgatgttccccatctccagtggcttctatttggactgttcttagtcatctacatcattattgtgatgagtaatggcatcatttttctaataacaaaactggacccttctctccagacccctatgtactttttcctaggcaatttttcctttttggaaatctgctatgtatcagttactctccccagaatgctcatgaacctttggacccagagaagaacaatttctttagttgcctgtgctacccaaatgtgctgcattcttgtgctgggaaccactgaatgtttccttctagcagtgatggcctatgatcgctacatggccatttgcaaccctctacactaccctttaatgatgaaccaaaaaacttgtattcagctggcggctggctcctggatcagtggaattccagtccagatagggcaaacagtccagattttctctctgcccttttgtggctctaatttaattgaccacttcttctgtgacatccccccagtactcaagcttgcttgtgggaacacatttgtgaatgaaatgatggtctacatagttgccgtgttgattgtcacagttccatttctgttgatacttatttcctatggcaaaatcatctccacaatccttaaattgcattcagccacaagtcgggccaaagccttctccacctgttcatctcatcttacagttgtggtgttgttctttggatcagccattattacctatttaagacccaaagccagtcactcagcaagaattgacaaagtgctttctcttttctacacagttgtgactcccatgtttaatcctctcatatacagtctaaggaacaaggaagtcataacagctttgagaaaattgctatgtaaataa

SEQ ID NO: 790 - protein, 313 aa, Canis familiaris
MKHQEKPPEDNLTELIEFVLLDFADVPHLQWLLFGLFLVIYIIIVMSNGIIFLITKLDPSLQTPMYFFLGNFSFLEICYVSVTLPRMLMNLWTQRRTISLVACATQMCCILVLGTTECFLLAVMAYDRYMAICNPLHYPLMMNQKTCIQLAAGSWISGIPVQIGQTVQIFSLPFCGSNLIDHFFCDIPPVLKLACGNTFVNEMMVYIVAVLIVTVPFLLILISYGKIISTILKLHSATSRAKAFSTCSSHLTVVVLFFGSAIITYLRPKASHSARIDKVLSLFYTVVTPMFNPLIYSLRNKEVITALRKLLCK

SEQ ID NO: 791 - DNA, 951 bp, Canis familiaris
atgctacccagagaccaaactacagaaggcaatttgtcttcagttgtggcatttgttctcctgggattttctgaccttcctaacatccagggatttctatttggaattttctttctcatctacatgtccatcttaataggaaatggtcttatcataataattacaagggtagactctgttctccagacacccatgtattttttcattgcaaatttttcctccctggaaatctgttatgtgtctgtcaccctccccaggattctggtgaatctttggactcaggacagaagcatttcttggttgggctgtgccactcaaatgtgcttcttcctcatgctgggagccactgaatgtttcctcttggcagtgatggcctatgaccgctacgtggccatttgtaaccctctgcactaccctctcatcatgaaccacaagatgtgcgtccaactggctgttggtgcctggcttagtggaattccagtccagataggacaaacatgtcaggtgttctcgctgcctttctgtggttctaaccaaattaaccacttcttctgtgacatccccccattgatcaagctggcttgtggggacacttcacttaatgagatgtgtgtctttgtagttgctatattatttgtcatgattccttttctatttatacttggctcttatgtgaaaatcatttccaccatcctaaagttgtcctcagccaggggccggtctaaagccttctccacctgttcttcccatatcattgttgtgcttttattctttggatcggctaccatcacctacttaaggcccaaatccaatcattctgcaagaactgacaagatgctctctcttttctacaccattgtgactcctatgtttaaccctctgatatacagtcttaggaacaaggatgtgaagacagcactgaaaaaattattactcaagaaaacagtgtaa

SEQ ID NO: 792 - protein, 316 aa, Canis familiaris
MLPRDQTTEGNLSSVVAFVLLGFSDLPNIQGFLFGIFFLIYMSILIGNGLIIIITRVDSVLQTPMYFFIANFSSLEICYVSVTLPRILVNLWTQDRSISWLGCATQMCFFLMLGATECFLLAVMAYDRYVAICNPLHYPLIMNHKMCVQLAVGAWLSGIPVQIGQTCQVFSLPFCGSNQINHFFCDIPPLIKLACGDTSLNEMCVFVVAILFVMIPFLFILGSYVKIISTILKLSSARGRSKAFSTCSSHIIVVLLFFGSATITYLRPKSNHSARTDKMLSLFYTIVTPMFNPLIYSLRNKDVKTALKKLLLKKTV

SEQ ID NO: 793 - DNA, 936 bp, Canis familiaris
atgagagcagaagacaatggttccacaataacacaatttgtactcttgggattttctgaccttccaaacctccaagggtttctatttggggtgttctccatcgtttatgttattatcttaattggaaatagcctcataataataataaccagtcttgatgctgcactccagaaacccatgtattttttcctggcaaatttttcctccttggaaatctgttatgtgtctgtcaccctccccaggattctggtgaacctttggactcaggacagaagcatttcttggttgggctgtgccactcaaatgtgcttcttcctcatgctgggagccactgaatgtttcctcttggcagtgatggcctatgaccgctacgtggccatttgtaaccctctgcactaccctctcatcgtgaaccacaagatgtgcgtccaactggctgttggtgcctggcttagtggaattccagtccagataggacaaacatgtcaggtgttctcgctgcctttctgtggttctaaccaaattaaccacttcttctgtgacatccccccattgatcaagctggcttgtggggacacttcacttaatgagatgtgtgtctttgtagttgctatattatttgcaatgattccctttctatttatacttggctcttatgtgaaaatcatttccaccatcctaaagttatcctcagccaggggccggtctaaagccttctccacctgttcttcccatatcattgttgtgcttttattctttggatcggctaccatcacctacttaaggcccaaatccattcattctgctggaactgacaaaatgttgtctcttctctataccattgtgactccgatgtttaatcctatgatatacagtcttaggaacaaggatgtgattgcagcactcagaagactgttacttaaaaaaatagtgtga

SEQ ID NO: 794 - protein, 311 aa, Canis familiaris
MRAEDNGSTITQFVLLGFSDLPNLQGFLFGVFSIVYVIILIGNSLIIIITSLDAALQKPMYFFLANFSSLEICYVSVTLPRILVNLWTQDRSISWLGCATQMCFFLMLGATECFLLAVMAYDRYVAICNPLHYPLIVNHKMCVQLAVGAWLSGIPVQIGQTCQVFSLPFCGSNQINHFFCDIPPLIKLACGDTSLNEMCVFVVAILFAMIPFLFILGSYVKIISTILKLSSARGRSKAFSTCSSHIIVVLLFFGSATITYLRPKSIHSAGTDKMLSLLYTIVTPMFNPMIYSLRNKDVIAALRRLLLKKIV

SEQ ID NO: 795 - DNA, 945 bp, Canis familiaris
atggaattgatggatggaaactacaccttggtgaccgagtttattcttttagggtttccgacccgccctgaactgcagattgtcctattcctcgtgtttctgacattgtatggtataattttaacagggaatattggattgatgatgttaatcaggaccgaccctcaccttcaaacccctatgtattttttccttagcaacctctcctttgcagacctttgtttctcctcagccattgttcccaagatgttggtcaatttcctctcagaaaataaatctatctccctttatggctgtgccctacagttttatttttcctgtgcttttgctgatacagaatcctttatcctggctgccatggcatacgatcgctatgttgccatctgtaatcctttactgtatacagttgtgatgtctcggggcatctgtgtatggttgattgtcttgtcctacattggaggtaacatgagttccctggttcacacgtcctttgcctttattctgaaatactgcgataaaaatgtcattaatcattttttctgcgacctccctcccctgcttaagctatcctgcacagacacctcagttaatgagtggcttctctccacatatggcagctcagtggaaattttctgcttcatcgtcattgtcatctcctactatttcattctgcgctcagtcttgaggatccgctcttccagtggcagaaagaaaaccttctccacgtgtgcctctcacctgacttctgtggccatctatcaggggactcttctcttcatttactcacggcccacctatctgtatactcccaacactgataaaattatctccgtgttctacaccattattatcccagtgctgaatccgttgatttatagtttgagaaataaagatgtaaaagatgccgctaagagagctgtaaggttaaaagtggattcctcatga

SEQ ID NO: 796 - protein, 314 aa, Canis familiaris
MELMDGNYTLVTEFILLGFPTRPELQIVLFLVFLTLYGIILTGNIGLMMLIRTDPHLQTPMYFFLSNLSFADLCFSSAIVPKMLVNFLSENKSISLYGCALQFYFSCAFADTESFILAAMAYDRYVAICNPLLYTVVMSRGICVWLIVLSYIGGNMSSLVHTSFAFILKYCDKNVINHFFCDLPPLLKLSCTDTSVNEWLLSTYGSSVEIFCFIVIVISYYFILRSVLRIRSSSGRKKTFSTCASHLTSVAIYQGTLLFIYSRPTYLYTPNTDKIISVFYTIIIPVLNPLIYSLRNKDVKDAAKRAVRLKVDSS

SEQ ID NO: 797 - DNA, 705 bp, Canis familiaris
  modified_base (705)..(705): a, c, t, g, unknown or other
atgagagcagaagacaatggttccagaataacacaatttgtactcttgggattttctgaccttccaaacctccaagggttactatttggggtgttctccatcatttatgttattatcttaattggaaatagcctcataataataataaccagtcttgatgctgcactccagaaacccatgtattttttcctggcaaatttttcctacttggaaatctgttatgtgtctgtcaccctccccaggattctggtgaacctttggactcaggacagaagtatttcttggttgggctgtgccactcaaatgtgctttttccttatgctgggagccactgaatgtttcctcctggctgtgatggcctatgaccgctacgtggccatttgtaaccctctgcactaccctctcatcatgaaccacaagatgtgcatccaactggctgttgggtcctggattggtggagtcccaggccaaataggacaaacatggcagattttctctctacatttctgtaattctaaccaaatcaaccacttcttctgtgacatacctcccatcctcaagctagcctgtggggacactgttgtgcatgagatagcagtctatgtactagctgtgttgtttgttgcagttcattttctgttaatacttgcctcttacagcaaaatcatttcaaacattctgaggttgccaacagccagaggacgn

SEQ ID NO: 798 - protein, 235 aa, Canis familiaris
MRAEDNGSRITQFVLLGFSDLPNLQGLLFGVFSIIYVIILIGNSLIIIITSLDAALQKPMYFFLANFSYLEICYVSVTLPRILVNLWTQDRSISWLGCATQMCFFLMLGATECFLLAVMAYDRYVAICNPLHYPLIMNHKMCIQLAVGSWIGGVPGQIGQTWQIFSLHFCNSNQINHFFCDIPPILKLACGDTVVHEIAVYVLAVLFVAVHFLLILASYSKIISNILRLPTARGR

SEQ ID NO: 799 - DNA, 945 bp, Canis familiaris
atggaattgatggatggaaactacaccttggtgactgagtttattcttttagggtttccgacccgccctgaactgcagattgtcctattcctcatgtttctgacattgtatggtatgattttaacagggaatattggactgatgatgttaatcaggacagaccctcaccttcaaacccctatgtattttttccttagcaacctctcctttgcagatctttgttactcatcagtcattgttcccaaaatgctggtcaatttcctctcagaaaataaatctatctcctattatggctgtgccctacagttttattttttctgtgcttttgctgatacagaatcctttatcctggctgccatggcatacgatcgctatgttgccatctgtaatcctttactgtatacagttgtgatgtctcggggcatctgtgtatggttgattgtcttgtcctacattggaggtaacatgagttccctggttcacacgtcctttgcctttattttgaaatactgcgataaaaatgtcattaatcattttttctgcgacctccctcccctgcttaagctatcctgcacagacacctcagttaatgagtggcttctctccacatatggcagctcagtggaaattatctgcttcatcgtcattgtcatctcctactatttcattctgcgctcagtcttgaggatccgctcttccagtggcagaaagaaaaccttctccacgtgtgcctctcacctgacttctgtggccatctatcaggggactcttctcttcatttactcacggcccagctatctgtattctcccaacactgataaaattatctccgtgttctacaccattattatcccagtgctgaatccattgatttatagtttgagaaataaagatgtaaaagatgccgctaagagagctgtaaggttaaaagtggattcctcatga

SEQ ID NO: 800 - protein, 314 aa, Canis familiaris
MELMDGNYTLVTEFILLGFPTRPELQIVLFLMFLTLYGMILTGNIGLMMLIRTDPHLQTPMYFFLSNLSFADLCYSSVIVPKMLVNFLSENKSISYYGCALQFYFFCAFADTESFILAAMAYDRYVAICNPLLYTVVMSRGICVWLIVLSYIGGNMSSLVHTSFAFILKYCDKNVINHFFCDLPPLLKLSCTDTSVNEWLLSTYGSSVEIICFIVIVISYYFILRSVLRIRSSSGRKKTFSTCASHLTSVAIYQGTLLFIYSRPSYLYSPNTDKIISVFYTIIIPVLNPLIYSLRNKDVKDAAKRAVRLKVDSS

SEQ ID NO: 801 - DNA, 933 bp, Canis familiaris
atggataaaggaaattgctcatccttgacagaattcattttcttgggaattaccaataaccctggaatgaaagtgaccctatttgcaacgtttcttgttgtttatctcattaatctgtttgcaaatcttggaatgattattttaattataatagattcccagcttcacacaccaatgtactttttccttagtcaactctctttctgtgacctctgctattctacagcggttgggcccaaaatgttggtagaccttttagctaaaaacaaatcaatccccttctttgggtgtgcccttcaattcttgatcttctgtatgtttgctgattctgagtgtctactgctggcagtgatggcctttgatcggtacaaggccattggcaacccgttgctctacacagtcaacatgtccaacagagtgtgctccctgctcatggctggagtttacttgctgggaatggcagatgctctgatacatacaacattaacattccgcttatgcttttgtggatcaaatgagattaatcatttcttctgtgatttacctccactctacctcctttcatgctcagatacagagatcaatgagttggcattattcatcttttttggcttcattgaactgagcaccatttctggagttcttatctcttattgttatataaccctatcagtcttgaagatccgctctgctgaggggaggttcaaagctttctccacctgcacctcccacttaactgctgttgcaattttccagggaactatgctcttcatgtattttcggccaagctcttcctactcccttgatcaagataaaatgacctcattgttttacacccttgtgattcccacattaaacccactgatttatagcctacggaacaaggatgtgaaagaagcgctgaaaaaactgaaaattaaaaagtggttttaa

SEQ ID NO: 802 - protein, 310 aa, Canis familiaris
MDKGNCSSLTEFIFLGITNNPGMKVTLFATFLVVYLINLFANLGMIILIIIDSQLHTPMYFFLSQLSFCDLCYSTAVGPKMLVDLLAKNKSIPFFGCALQFLIFCMFADSECLLLAVMAFDRYKAIGNPLLYTVNMSNRVCSLLMAGVYLLGMADALIHTTLTFRLCFCGSNEINHFFCDLPPLYLLSCSDTEINELALFIFFGFIELSTISGVLISYCYITLSVLKIRSAEGRFKAFSTCTSHLTAVAIFQGTMLFMYFRPSSSYSLDQDKMTSLFYTLVIPTLNPLIYSLRNKDVKEALKKLKIKKWF

SEQ ID NO: 803 - DNA, 936 bp, Canis familiaris
atggatggaaaaaattgctcttccgtgaatgaattccttctcgtgggaattagcaataagcctggagttaaagtgactctatttatcacatttctaattgtctatctcatcattcttgttgcaaacctcgggatgatcattttaattaggatggactcccagcttcacacacccatgtatttcttcctgagccatctctccttcagtgacgtctgctattctacagcagtcggacccaggatgctggtaggcttcattgccaagaacaagtcaattcccttctacagctgtgctatgcaatggttggtgttctgtacctttgtagattctgagtgtctactgctggcagtgatggcctttgatcggtacaaagccattagccaccccttgctctatacagtcagcatgtccagcagaatgtgctccctgctgatggctggggtttacttggtgggaattatggatgcttcagtaaatacaatattaacattccggttatgtttctgtgagtcgaatgtgattaaccatttcttctgtgatgtcccacctctcctcttgttatcttgctcagacacacaagttaatgagttagtgatattcaccatttttggcttcattgaactgattactctttcagggctttttgtgtcttactgctatattatcctagcggtgagaaagatcaactctgctgaggggaggttcaaagctttctccacctgcacctcccacttaactgctgttgcaattttccagggaactctgctctttatatatttccggccaagctcttcctactcccttgatcaagacaaaattatttcattgttttactcccttgtgattcccatgctaaaccctctgatttatagcctacggaacaaggatgtgaaagaggccctgaaaaaacttaaaaataaaaagtggtttcattga

SEQ ID NO: 804 - protein, 311 aa, Canis familiaris
MDGKNCSSVNEFLLVGISNKPGVKVTLFITFLIVYLIILVANLGMIILIRMDSQLHTPMYFFLSHLSFSDVCYSTAVGPRMLVGFIAKNKSIPFYSCAMQWLVFCTFVDSECLLLAVMAFDRYKAISHPLLYTVSMSSRMCSLLMAGVYLVGIMDASVNTILTFRLCFCESNVINHFFCDVPPLLLLSCSDTQVNELVIFTIFGFIELITLSGLFVSYCYIILAVRKINSAEGRFKAFSTCTSHLTAVAIFQGTLLFIYFRPSSSYSLDQDKIISLFYSLVIPMLNPLIYSLRNKDVKEALKKLKNKKWFH

SEQ ID NO: 805 - DNA, 933 bp, Canis familiaris
atggacaaaggaaattgctcttccttgactgaattctttttcttgggaattaccaataatcctgagatgaaagtgaccctattcaccatcactctggttatttatctcattaatctcctggcaaatcttggaatgattattctaattagaatggattttcagctgaatacaccaatgtactttttcctcagccatctctctttctgtgacctctgttattccacagcaattgggcccaagatgctggtggatctatttgccaaaaacaaatcaattcctatcataggctgtgctctgcaattcttgatcttctgtacttttgtagattctgagtgtctactgctggcagtgatggcatttgatcggtacaaggccattagcaacccgttactctacacagtcaacatgtccaacagagtgtgctccctgctgatggctggagtttacttgctgggaacggcagatgctttgatacacacaacattaacattcagtttatgtttctgtggatcaaatgagattaatcatttcttctgtgatgtacctcctctcctattgctctcatgctcagatacacaggtgaatgagttagtgatattcaccattttcggcttcattgaactgagtaccatcacaggagtccttgtctcttattgttatataatcttatcagtcttaaagatccgctctgctgaagggaggttcagagctttctccacctgcacctcccacttaactgctgttgcaattttccagggaactatgctctttatgtatttccggccaagctcttcctactcccttgatcaagacaaaattacttcattgttttacacccttgtgattcccatgttaaacccactgatttatagcctacggaacaaagatgtgaaaggggccctagaaaaattgaaaaataaaatatgtctttaa

SEQ ID NO: 806 - protein, 310 aa, Canis familiaris
MDKGNCSSLTEFFFLGITNNPEMKVTLFTITLVIYLINLLANLGMIILIRMDFQLNTPMYFFLSHLSFCDLCYSTAIGPKMLVDLFAKNKSIPIIGCALQFLIFCTFVDSECLLLAVMAFDRYKAISNPLLYTVNMSNRVCSLLMAGVYLLGTADALIHTTLTFSLCFCGSNEINHFFCDVPPLLLLSCSDTQVNELVIFTIFGFIELSTITGVLVSYCYIILSVLKIRSAEGRFRAFSTCTSHLTAVAIFQGTMLFMYFRPSSSYSLDQDKITSLFYTLVIPMLNPLIYSLRNKDVKGALEKLKNKICL

SEQ ID NO: 807 - DNA, 975 bp, Canis familiaris
atggatggaaaaaattgctcttccgtgaatgaattccttctcgtgggaattagcaataagcctggagttaaagtgactctgtttatcacatttctaattatctatctcatcattcttgttgcaaacctcgggatgatcattttaatcaggatggactcccagcttcacacacccatgtatttcttcctgagccatctctccttcagtgacgtctgctattctacagcagtcggacccaggatgctggtaggcttcattgccaagaacaagtcaatttccttctacagctgtgctctgcaattcttgatcttctgtatttttgcagattctgagtgtctactgctggcagtgatggcctttgatcggtacaaagccattagccaccccttgctctatacagtcagcatgtccagcagagtgtgctccctgctgatggctggggtttacatggtgggaattatggatgcttcagtaaatacaatattaacattccggttatgtttctgtgagtcgaatgtgattaaccatttcttctgtgatgtcccacctctcctcttgttatcttgctcagacacacaagttaatgagttagtgatattcaccatttttggcttcattgaactgattactctttcagggctttttgtgtcttactgctatattatcctagcggtgagaaagatcaactctgctgaggggaggttcaaagctttctccacctgcacctcccacttaactgctgttgcaattttccagggaactctgctctttatgtatttccggccaagctcttcctactcccttgatcaagacaaaattacttcattgttttactcccttgtgattcccatgctaaaccctctgatttatagcctacggaacaaggatgtgaaagaggccctgaagaaacttaaaaaaaacttaaacttaaaaaataaactaaaaaaaaaactaaaaaaaattttaaaaacttaa

SEQ ID NO: 808 - protein, 324 aa, Canis familiaris
MDGKNCSSVNEFLLVGISNKPGVKVTLFITFLIIYLIILVANLGMIILIRMDSQLHTPMYFFLSHLSFSDVCYSTAVGPRMLVGFIAKNKSISFYSCALQFLIFCIFADSECLLLAVMAFDRYKAISHPLLYTVSMSSRVCSLLMAGVYMVGIMDASVNTILTFRLCFCESNVINHFFCDVPPLLLLSCSDTQVNELVIFTIFGFIELITLSGLFVSYCYIILAVRKINSAEGRFKAFSTCTSHLTAVAIFQGTLLFMYFRPSSSYSLDQDKITSLFYSLVIPMLNPLIYSLRNKDVKEALKKLKKNLNLKNKLKKKLKKILKT

SEQ ID NO: 809 - DNA, 942 bp, Canis familiaris
atggcctttgaaaactatacgagggtcaccgaattcattttcacaggtttgaattgcagcccgcaattgcaggttttcctcttcctgctcttcctgagtttttacttcatcaatctaactggaaacttgggtatgattattctgattcgggttgattcccgccttcacacgcccatgtacttttttctcagccacttgtcctttgtggatatctgcttctcctctgttgtgagcccaaagatgctcaccgacttctttgtgaagaggaaggccatctctttcttgggctgtgctttgcaacagtggttttttgggttctttgtggcagcagagtgttttctcctggcgtccatggcctatgaccgctatgtggccatctgcaacccattattgtattcagttgccatgtcccagagactctgtgtccagctggtggttggtccctacatcatcgggtttgtgaacaccatgacccatacaacgaatgcatttcgtcttcctttttgtggccccaatgttcttaatcatttcttctgtgatatgtcccccctgctttcccttgtatgtgctgacagcaggcttactaagttggtagtttttgttgtggctggagctgtgggagtcttcagtggtttgactatcgtggtctcctacatttatatcctcattgccatcatgaagatccactctgccgatgggaggcgcaaagccttttctacatgctcttctcacctgaccgctgtctccatcctatacggtactcttttctttatttatgtacggcctagtgccagtttctcactggatctcaacaaagtggtgtcggtattttacacagcagtgatccccatgttgaacccgcttatctacagcttgaggaacaaggaggtcaaagatgccatccataggactattactaggaggaagttttgtagggcataa

SEQ ID NO: 810 - protein, 313 aa, Canis familiaris
MAFENYTRVTEFIFTGLNCSPQLQVFLFLLFLSFYFINLTGNLGMIILIRVDSRLHTPMYFFLSHLSFVDICFSSVVSPKMLTDFFVKRKAISFLGCALQQWFFGFFVAAECFLLASMAYDRYVAICNPLLYSVAMSQRLCVQLVVGPYIIGFVNTMTHTTNAFRLPFCGPNVLNHFFCDMSPLLSLVCADSRLTKLVVFVVAGAVGVFSGLTIVVSYIYILIAIMKIHSADGRRKAFSTCSSHLTAVSILYGTLFFIYVRPSASFSLDLNKVVSVFYTAVIPMLNPLIYSLRNKEVKDAIHRTITRRKFCRA

SEQ ID NO: 811 - DNA, 657 bp, Canis familiaris
acacaccaatacttttttctcagccacctctcctgtgacctttgctactgcacatcaattggacccaagatgttgctggatccatttgccaacatcaaaacaatttccatcactggcttccatcactcttgagcttctgcacctgcagaatgaatgtctattgctattggtgacaatctctgattgatacaaagctattggcaacccctgtgcttcctgctcatggccaggatttcatgagggatgtcaaatgctttgatactcctgacattaacattccactgtctgtctgtaggtcatgtgatatatcatttcttctgtgatatctctctctctcaacgattttattatttttaacatttttgtcttcactgaactgagtaccattttagcttgactcttactatcctattcatcttgaagaaccactcttctgaaaggaagttcaaagttttctccaccttcacctcccacttaggagctgttgcaatcttctggggaactatgcttttcagatattctgggccaaattctttttttctccttagattaagacaaaatgaactctttgttctacactcatgtaattcctatgttaaattctctgatttacagcctatggaaaagaatgtgaaagaaatggtggaaaaatttgaa

SEQ ID NO: 812 - protein, 61 aa, Canis familiaris
HTNTFFSATSPVTFATAHQLDPRCCWIHLPTSKQFPSLASITLELLHLQNECLLLLVTISD

SEQ ID NO: 813 - DNA, 939 bp, Canis familiaris
atggctgttgagaactgcactgtgattactgatttcatactcctaggactttctggcagaaaagatgtgcagcaggggctctttgtgctctttctgctagtttacagcacaaccatgattgccaatctagggatgatcctgctgatcaagctggactccaggctccacacgcccatgtattatttcctgagcaacctgtctctctgtgacgtctgctactcctccactgtctctcccaagatgctggctgacttcttgtctgagcaaaagagaattccatatgatttatgtgcaattcagatgtatttttttggggtctttgcagatgtggagtgtctcatgttggctgtcatggcttatgaccggtatgtagccatttgtaatccacttctttatacaatcgccatgtccaggcaaatctgcatccagcttgtgtcccttgcctacatcgtcggttttgtggattcagcaatccacacctgctgcacatttcgattgtcgttctgcgattccaatatcatcaatcactttttctgtgacatcccacccttgctagccctttcctcttcagatacatccatcaatgagatagtgatgttcactttcattggttgtgtagtgggctgcagcatcatcactgttctcctctcctacagctatatcctaactaccatccttagaatgaactcagctgaagggagacgcaaagccttctctacatgtgcctcccacttgaccgcagtggctatatttcacggcacacttctgttcatgtatttccgaccgagctccagttactcaatggacacagacaaaatgtcttctgtcttctacactgtggtcatccctatgttaaacccactcatctacagcttaaggaataaggatgtgaaaggtgccctgaaaaaagcaatcagcactaaattatgttctgggtga

SEQ ID NO: 814 - protein, 312 aa, Canis familiaris
MAVENCTVITDFILLGLSGRKDVQQGLFVLFLLVYSTTMIANLGMILLIKLDSRLHTPMYYFLSNLSLCDVCYSSTVSPKMLADFLSEQKRIPYDLCAIQMYFFGVFADVECLMLAVMAYDRYVAICNPLLYTIAMSRQICIQLVSLAYIVGFVDSAIHTCCTFRLSFCDSNIINHFFCDIPPLLALSSSDTSINEIVMFTFIGCVVGCSIITVLLSYSYILTTILRMNSAEGRRKAFSTCASHLTAVAIFHGTLLFMYFRPSSSYSMDTDKMSSVFYTVVIPMLNPLIYSLRNKDVKGALKKAISTKLCSG

SEQ ID NO: 815 - DNA, 933 bp, Canis familiaris
atggagttggagaaccacactgtgaagtctgagttctttctcttgggatttagtgaccatccagaactttggagggtgctttttgttatgtttctttttatctactctgttaccctcatggggaaccttgggatgatcttattaatcacaactagttcccatttgcacaccccgatgtactttttcctctgtatattgtcctttgtagatgtatgttactcttctgttattgcccccaaattacttgtggacttgatttccaaagaaaagaccatttcttacaagggctgtgctgcacagttatattttttctgctctttggttgacacagaatctttcctcttggctgctatggcttatgaccggtacatagcaatctgcaaccctctgctttatatggttattatgtccaagagggtttgctcccagtttgccattggagcatttttgggaggtaccatgagttcaattattcacactactaataccttccatctgtctttctgctccaaagaaattaatcatttcttctgtgatatctccccactcttctctctgtcctgcactgatacttacatgcatgacatcattctggtagtctttgctggtttggtggaagctatctgtcttctagcagtccttctgtcttatgtctgcatcatagcagctattcttaaaacagggtctgctgaaggaagaaagaaagggttttccacttgtgcctcccatctgaccgtagtcacgatctaccatggtaccctcatttttatttatttgcgccccagcactggtcattcgctggatattgacaaagtgacctctgtgttctatacattgatcatacctatgttgaaccccttaatttacagtctaaggaacaaagacgtcaaaaatgcctttaggaaagtaataggcagaaaattgctttcttaa

SEQ ID NO: 816 - protein, 310 aa, Canis familiaris
MELENHTVKSEFFLLGFSDHPELWRVLFVMFLFIYSVTLMGNLGMILLITTSSHLHTPMYFFLCILSFVDVCYSSVIAPKLLVDLISKEKTISYKGCAAQLYFFCSLVDTESFLLAAMAYDRYIAICNPLLYMVIMSKRVCSQFAIGAFLGGTMSSIIHTTNTFHLSFCSKEINHFFCDISPLFSLSCTDTYMHDIILVVFAGLVEAICLLAVLLSYVCIIAAILKTGSAEGRKKGFSTCASHLTVVTIYHGTLIFIYLRPSTGHSLDIDKVTSVFYTLIIPMLNPLIYSLRNKDVKNAFRKVIGRKLLS

SEQ ID NO: 817 - DNA, 960 bp, Canis familiaris
atggcagaaacgggggaagagaactgcaccagtgtgacagaattcattctgcttggattagcagatgccccagagctgagagtcttcctcttcctgctgtttcttctcatctatggagtcacggttttgggaaatctgggcatgatcgcagtgatccaggtcagctctcagcttcacactcccatgtactttttcctcagccacttgtcctttgtggatttttgctactccacgatcatcgtgccaaagatgctgcccaatatcttaaacagggacaaagccatctccttcctcggttgcatggtgcagttctatttattttgtacttatgcaatcactgaggtcttcctgttggctgtgatggcctatgaccgcttcgtggccatctgcaacccactgctgtacatggtcaccatgtcccagaatctctgtatggagctggtgtcctgctgctacctctgtgggacggcctgttctctgatccacttgtgtttagcccttcagatcccatcctatagatcagatgtgattaaccacttcttttgtgatctaccccctctcttatctcttgcttgctctgatgtcactatgaatgaactcatggtgtccattgtggccaccttcaacgagatcatcaccatcatgatcatcctcacctcctatttgctgattctcatcactatcctgaggatgcgctctgcagagggaaggcgcaaagccttttccacctgtgcttctcacttcacagccatccttgtcttccatggaacaatccttttcaattattgtcggcccagttctggcaacagtatggatactgacaaggtggccacggtgttctacaccatagtgattcccatgctgaaccctctcatctatagtctgaggaacaaggatgtgaaagaagctctcaagaaagtattgcgatctagagtaccctttgaaaaactattttcttga

SEQ ID NO: 818 - protein, 319 aa, Canis familiaris
MAETGEENCTSVTEFILLGLADAPELRVFLFLLFLLIYGVTVLGNLGMIAVIQVSSQLHTPMYFFLSHLSFVDFCYSTIIVPKMLPNILNRDKAISFLGCMVQFYLFCTYAITEVFLLAVMAYDRFVAICNPLLYMVTMSQNLCMELVSCCYLCGTACSLIHLCLALQIPSYRSDVINHFFCDLPPLLSLACSDVTMNELMVSIVATFNEIITIMIILTSYLLILITILRMRSAEGRRKAFSTCASHFTAILVFHGTILFNYCRPSSGNSMDTDKVATVFYTIVIPMLNPLIYSLRNKDVKEALKKVLRSRVPFEKLFS

SEQ ID NO: 819 - DNA, 936 bp, Canis familiaris
atgggggaagagaactgcaccagtgtaacagagttcattctgcttggattagcagatgccccagagctgagagtcttcctcttcctgctgtttcttctcatctatggagtcacggttttgggaaatctgggcatgatcgcagtgatccaggtcagctctcagcttcacactcccatgtactttttcctcagccacttgtcctttgtggatttttgctactccacgatcatcgtgccaaagatgctgcccaatatcttaaacagggacaaagccatctccttcctcggttgcatggtgcagttctatttattttgtacttatgcaatcactgaggtcttcctgttggctgtgatggcctatgaccgcttcgtggccatctgcaacccactgctgtacatggtcaccatgtcccggaatctctgtatggagctggtgtcctgctgctacctctgtgggacagcctgttctctgatccacttgtgtttagcccttcagatcccatcctatagatcaaatgtgattaaccacttcttttgtgatctaccccctctcttatctcttgcttgctctgatgtcactatgaatgaactgttgctgtacatcgtggccaccttcaacgagctcaccaccatcctgatcatccttacctcctatttgctgattctcatcaccatcctgaggatgcgctctgcagagggaaggcgcaaagccttttccacctgtgcctcccacctcacagccatccttgtcttccatggaacaatccttttcatttattgtcggccgggttcgggcaacagtatggatgctgacaaggtggccacagtgttctacaccatagtgattcccatgctgaaccccctcatctatagtctgaggaataaggatgtgaaagaagctctcagaaaagtggtgagctccaaaatgttttcctag

SEQ ID NO: 820 - protein, 311 aa, Canis familiaris
MGEENCTSVTEFILLGLADAPELRVFLFLLFLLIYGVTVLGNLGMIAVIQVSSQLHTPMYFFLSHLSFVDFCYSTIIVPKMLPNILNRDKAISFLGCMVQFYLFCTYAITEVFLLAVMAYDRFVAICNPLLYMVTMSRNLCMELVSCCYLCGTACSLIHLCLALQIPSYRSNVINHFFCDLPPLLSLACSDVTMNELLLYIVATFNELTTILIILTSYLLILITILRMRSAEGRRKAFSTCASHLTAILVFHGTILFIYCRPGSGNSMDADKVATVFYTIVIPMLNPLIYSLRNKDVKEALRKVVSSKMFS

SEQ ID NO: 821 - DNA, 936 bp, Canis familiaris
atgggtgaggagaactgcaccagtgtgacagagttcattctgcttggattagcagatgccccagagctgagagtcttcctcttcctgctgtttcttctcatctatggagtcacggttttgggaaatctgggcatgatcgcagtgattcaggtcagctctcagcttcacactcccatgtactttttcctcagccacttgtcctttgtggatttttgctactccacgatcatcgtgccaaagatgctgcccaatatcttaaacagggacaaagccatctccttcctcggttgcatggtgcagttctatttattttgtacatgtgtggtaactgaggtcttcctgttggctgtgatggcctatgaccgcttcgtggccatctgcaacccactgctgtacatggtcaccatgtcccagaatctctgtatggagctggtgtcctgctgctacctctgtgggacggcctgttctctgatccacttgtgtttagcccttcagatcccatcctatagatcagatgtgattaaccacttcttttgtgatctaccccctctcttatctcttgcttgctctgatgtcactatgaatgaattgttgctgtacatcgtggccaccttcaacgagctcaccaccatcctgatcatccttacctcctatttgctgattctcatcaccatcctgaggatgcgctctgcagagggaaggcgcaaagccttttccacctgtgcctcccacctcacagccatccttgtcttccatggaacaatccttttcatttattgtcggccaggttcgggcaacagtatggatgctgacaaggtggccacagtgttctacaccatagtgattcccatgctgaaccccctcatctatagtctgaggaataaggatgtgaaagaagctctcaggaaagtggtgagctccaaaatgttttcctag

SEQ ID NO: 822 - protein, 311 aa, Canis familiaris
MGEENCTSVTEFILLGLADAPELRVFLFLLFLLIYGVTVLGNLGMIAVIQVSSQLHTPMYFFLSHLSFVDFCYSTIIVPKMLPNILNRDKAISFLGCMVQFYLFCTCVVTEVFLLAVMAYDRFVAICNPLLYMVTMSQNLCMELVSCCYLCGTACSLIHLCLALQIPSYRSDVINHFFCDLPPLLSLACSDVTMNELLLYIVATFNELTTILIILTSYLLILITILRMRSAEGRRKAFSTCASHLTAILVFHGTILFIYCRPGSGNSMDADKVATVFYTIVIPMLNPLIYSLRNKDVKEALRKVVSSKMFS

SEQ ID NO: 823 - DNA, 942 bp, Canis familiaris
atgttactgtcagagagaaataaaagtggggctacattcactctcttgggcttctcagattacccagaactgcaaatccctctcttcttgatttttctggccatctatagtgtcactgttgtaggtaatcttgggatgatagttataatcaagattaaccccaagctgcacacccccatgtacttcttcctcagccacctctcagtggtggatttctgctactcctccatcattgctcccaaggccctggcaaacctggttgcagaagacagaaccatttcatttccaggatgtgtagtacagttctttttcttttgtacctttgtggtagctgaatcctttttattagctgtgatggcctatgaccgctttgtggccatttgcaatcctctgctctacacagtgacagcgtcccagaagctctgtgccatgctggtggtcggatcatatgcatggggagtaacatgttccttgatactcacatgctctgtggtcaaattatcttttcagggtttcaacaccatcaatcatttcttctgtgagttctctgcattgatctccctgtcttgctctgatacttacatcagtcagttgctgcttttcatttttgccacctttaatgaggtcagcacactgctcatcattctcttgtcttacgtatttatcgttgtcaccatcctcaagatgcgttcagccagtggtcgccgcaaagccttttccacctgcgcctcccatctgactgccatcaccatcttccatgggaccatcctttttctctactgtgtgcccaactccaaaaactcaaggcacacagtcaaagtggcatctgtgttttacacagtggtgatccccatgttgaatcccctgatctacagtctgagaaataaggatgtcaagggtacagtcaataaattaataggtactaaagttttttctttttga

SEQ ID NO: 824 - protein, 313 aa, Canis familiaris
MLLSERNKSGATFTLLGFSDYPELQIPLFLIFLAIYSVTVVGNLGMIVIIKINPKLHTPMYFFLSHLSVVDFCYSSIIAPKALANLVAEDRTISFPGCVVQFFFFCTFVVAESFLLAVMAYDRFVAICNPLLYTVTASQKLCAMLVVGSYAWGVTCSLILTCSVVKLSFQGFNTINHFFCEFSALISLSCSDTYISQLLLFIFATFNEVSTLLIILLSYVFIVVTILKMRSASGRRKAFSTCASHLTAITIFHGTILFLYCVPNSKNSRHTVKVASVFYTVVIPMLNPLIYSLRNKDVKGTVNKLIGTKVFSF

SEQ ID NO: 825 - DNA, 939 bp, Canis familiaris
atggctgtaagaaatctgagtgtggagatgacctttgccctcttgggtttcgcggattacccagagcttcagattcctctcttcctcttgtttctgatcatgtacattatcaccgtggtaggaaatcttgggatgatagtaatcatcaagattaaccccaaatttcacactcccatgtactttttcctcagccacctttcttttgttgatttttgttactcttccattgttactcccaagctgcttgagaacctggtcatggaggataaaaacatcttctactttagctgcatgttgcagtacttcttgtcctgcactgctgtggtgacggaatccttcctgctggcagtgatggcctatgatcgctttgtggccatttgcaaccctctgctttattcagtggtcatgtcgcagaggctctgtgccctgctggtgtctgggtcgtatctctggggtatgtttggtcccttggtactcctctgctatgctctccagctaaacttttctggacataacacaatcaaccattttttctgtgaatacacagctctcattgctgtctccagctcagacatactcattccccacctgctgccttttggctttgccactttcaatgaggtgagtacactgctgatcatcctcacttcatacacttttatattcgtgactgtactaaatatccattctgccagtgggcatcgcaaagccttctccacctgtgcctcccacctgactgccattaccatcttccacgggaccatcctttccctctactgtgtgcccaactccaaaaactccaggcaaactgtcaaagtggcctctgtattttatacagtggtcaaccctatgctgaaccctctgatctacagcctgaggaataaagatgtgaaagatgccctccggaaattaatagacacaaaagtcccattccactga

SEQ ID NO: 826 - protein, 312 aa, Canis familiaris
MAVRNLSVEMTFALLGFADYPELQIPLFLLFLIMYIITVVGNLGMIVIIKINPKFHTPMYFFLSHLSFVDFCYSSIVTPKLLENLVMEDKNIFYFSCMLQYFLSCTAVVTESFLLAVMAYDRFVAICNPLLYSVVMSQRLCALLVSGSYLWGMFGPLVLLCYALQLNFSGHNTINHFFCEYTALIAVSSSDILIPHLLPFGFATFNEVSTLLIILTSYTFIFVTVLNIHSASGHRKAFSTCASHLTAITIFHGTILSLYCVPNSKNSRQTVKVASVFYTVVNPMLNPLIYSLRNKDVKDALRKLIDTKVPFH

SEQ ID NO: 827 - DNA, 945 bp, Canis familiaris
atgttgttagcagaaggcaatcagagtgttggagccacattcaccctcttgggcttctcggaatatccagacttccaggttcccttgctattggtgttcttgaccatctacacagtcactgtggtagggaacctgggcatgatcatgatcatcagggtcagtccccgactccacacccccatgtactttttcctcagccacttgtcctttgtcgatttctgttattccaccacagttacacccaaactgttggagaatttggttgtggaagacagatccatctccttcgtaggctgcatcatgcagttcttcttggcttgtgtatgtgcggtggcagaaacattcatgttggcagtgatggcctatgaccgatttgtggctgtttgtaaccctctactctacacggttgtcatgtcccagaagctgtgtgcgttgttagtggcggggccctacatatggggtatagcctcttccctgacactcacctgttttctcctgacattatccttctgtgggtctaataccataaataattttgtctgtgagcactctgtcattgtctctgtctcctgctctgacccctacatcagccaaatgctttgttttgtcattgccatattcaacgaagtcagcagcctggtcatcattttcactacttatattttcatttttgtcacagtcataaaaatgtcttctgctggtgggcgccaaaaagctttctccacttgtgcctcccacctgactgccatcaccatcttccatgggactatcctgttcctttattgtgtacccaactcccaaaactcatggctcatagtcaaaataggttctttattttatacagtggtgattcctatgctgaaccctctgatctatagcctccgaaataaagacgtgaaggagagtgtcaagaagttaataaatcactcaatacaagtttgttga

SEQ ID NO: 828 - protein, 314 aa, Canis familiaris
MLLAEGNQSVGATFTLLGFSEYPDFQVPLLLVFLTIYTVTVVGNLGMIMIIRVSPRLHTPMYFFLSHLSFVDFCYSTTVTPKLLENLVVEDRSISFVGCIMQFFLACVCAVAETFMLAVMAYDRFVAVCNPLLYTVVMSQKLCALLVAGPYIWGIASSLTLTCFLLTLSFCGSNTINNFVCEHSVIVSVSCSDPYISQMLCFVIAIFNEVSSLVIIFTTYIFIFVTVIKMSSAGGRQKAFSTCASHLTAITIFHGTILFLYCVPNSQNSWLIVKIGSLFYTVVIPMLNPLIYSLRNKDVKESVKKLINHSIQVC

SEQ ID NO: 829 - DNA, 891 bp, Canis familiaris
gttcctctcttcctggttttcttgtctatctatatggtcactactgtgggaaatttgggcatgataataattatcaagatcaatcctaaattccacacggtcatgtactttttcctcagccacttgtcctttgtagatttctgttattccactgtagttacacctaaattgttggagaacttgactgtggaagacagaaccatctccttttctggttgtattatgcaattttgctttgcttgcttatttggagtcacagaaacttttatgttagcagcgatggctttttatgttagcagcgatggctatgaccgttttgtagcagtttgtaaccccttgctgtataccactactatgtctcagaagctttgcactctgctggtagctgggtcttactcatggggtatagtctgttccatgacactcacatattttcttcttgcattatcctattgtgagtctagcatcataaataatttcatctgtgaccattctgtaattgtttctgtctcctgttcagacccttatatcagccagatgctgtgttttattattgccgtattcaatgaggtgagcagcctgatgattattctgatgtcttatatactcatttttatcactgttatgaagatgccttctgcaagtgggtgccggaaaaccttttccacctgtgcctctcacctgacagccatcaccatattccatgggaccatccttttcctttactgtgtccctaatcctaaaacttcttggctcaccgttaaagtggcatctgtgttttacacagtggtgattcccatgctgaatcccttgatctacagccttaggaacaaagctgtgaaagacacattcagaagactagtggtagcaaaattgctttgtcacttaata

SEQ ID NO: 830 - protein, 297 aa, Canis familiaris
VPLFLVFLSIYMVTTVGNLGMIIIIKINPKFHTVMYFFLSHLSFVDFCYSTVVTPKLLENLTVEDRTISFSGCIMQFCFACLFGVTETFMLAAMAFYVSSDGYDRFVAVCNPLLYTTTMSQKLCTLLVAGSYSWGIVCSMTLTYFLLALSYCESSIINNFICDHSVIVSVSCSDPYISQMLCFIIAVFNEVSSLMIILMSYILIFITVMKMPSASGCRKTFSTCASHLTAITIFHGTILFLYCVPNPKTSWLTVKVASVFYTVVIPMLNPLIYSLRNKAVKDTFRRLVVAKLLCHLI

SEQ ID NO: 831 - DNA, 936 bp, Canis familiaris
atggatgagaaaaatttcaccgaagtgaaagaatttatacttctagggttcacagaggacttgtggttacagaaagtactctttgttattttcctcttcatctatgttaccagtctttcagggaacatgactctgatttctctgatctgtgctgattctcggctccacacagccatgtatttcttcattgggaatctttcattccttgatctctggtactcttctgtttatgctccccaaattcttaggacttgtatggctgaagacaaaagcatctcctttgctggctgcctagctcagttcttcttctctgctggtctggcatacagtgagtgttacctgttggctgccatggcttatgaccgctatgtggccatctccaaccctttgctttattcccagacaatgtcctcaaggttatgtgccagtctcgttgcagcttcataccttggtggctttcttaactcaaccatcattaccagcgagacatttaccctgagcttctgtgggagcaatgtcattgatgattatttctgtgacctgccaccccttgtaaagctggcctgcgatgtgaaggagagctaccaggctgtgctctatttcatactggcctccaatgtcattgctcccactgtgctgatcctggcctcttacctcttcatcattgctgctatcttgaagatccgctccactcagggccgcctcaaagctgtctccacctgtggctctcatctgacagctgtcaccttgtactatggctctattctctttatttactcccgaccaagtaccagctatgccctggaaagggataaagtggtgtcagtgttctatactgtggtgataccattgttgaatcccttaatctatagcttaagaaataaggatgttaaagaggctctgaagaaaatgttagataaggcaccattttcttaa

SEQ ID NO: 832 - protein, 311 aa, Canis familiaris
MDEKNFTEVKEFILLGFTEDLWLQKVLFVIFLFIYVTSLSGNMTLISLICADSRLHTAMYFFIGNLSFLDLWYSSVYAPQILRTCMAEDKSISFAGCLAQFFFSAGLAYSECYLLAAMAYDRYVAISNPLLYSQTMSSRLCASLVAASYLGGFLNSTIITSETFTLSFCGSNVIDDYFCDLPPLVKLACDVKESYQAVLYFILASNVIAPTVLILASYLFIIAAILKIRSTQGRLKAVSTCGSHLTAVTLYYGSILFIYSRPSTSYALERDKVVSVFYTVVIPLLNPLIYSLRNKDVKEALKKMLDKAPFS

SEQ ID NO: 833 - DNA, 951 bp, Canis familiaris
atggaactagatgaaggaaatcagagctctgtgaccacattcattctcctgggtttctcagaatacccacacctccagatgcccctcttcctggtgttcttgactgtctacacggtcactctggtggggaatctgggcataatcatggtcgtaaggatcaatcccaaactccacacccccatgtactttttcctcagccacctatcctttttggatatttgttattccagtgtctttacaccgaaactattagaaaccttggtcacagaagacagaagtatctccttcaaaggatgcatggtgcaatttttcttcatttgtgcatttgtaattacggaaatgttcatgttggcagtaatggcctatgaccgatttgtggctgtctgtaaccctctgctctacacagttgctatgtctcagaaactctgtgccctcttggtagctggaacctacacgtggggtggcatatgttccttgacactcacatactctcttttggaactatcctactgtggttccaatatcataaatcactttggctgtgagtattctgccatcctctctttatcctgttctgacccctacttcagtcagatgacatgtttggtcatttctacattcaacgaggcttgcagcctcctgattatcctggcctcctatatattcatagttgtcaccatcatcaagatgccttctgctggtggactccagaaggccttctccacctgtgcctcccacctgaccgccatcaccatcttccatggaataatccttcttctctactgtgtgcccaactccaaaagctcgtggctcctggtcaaagtggccacggtgttttttactgtcatgatccccatgttgaacccccttatttacagcctgaggaacaaagacgtgaaagacacagccaggaagttaatccataccaaactgctttctcactcaatgtga

SEQ ID NO: 834 - protein, 316 aa, Canis familiaris
MELDEGNQSSVTTFILLGFSEYPHLQMPLFLVFLTVYTVTLVGNLGIIMVVRINPKLHTPMYFFLSHLSFLDICYSSVFTPKLLETLVTEDRSISFKGCMVQFFFICAFVITEMFMLAVMAYDRFVAVCNPLLYTVAMSQKLCALLVAGTYTWGGICSLTLTYSLLELSYCGSNIINHFGCEYSAILSLSCSDPYFSQMTCLVISTFNEACSLLIILASYIFIVVTIIKMPSAGGLQKAFSTCASHLTAITIFHGIILLLYCVPNSKSSWLLVKVATVFFTVMIPMLNPLIYSLRNKDVKDTARKLIHTKLLSHSM

SEQ ID NO: 835 - DNA, 873 bp, Canis familiaris
atgcccctgttccttttattctttaccatctacacagttattgttttgggaaatctgggcatggtcatgattatccagatcaatcccaaactccatacccccatgtacttcttcctcagccatctttcttttgttgatttctgttactctacagtagttacacccaaactattagaaaacttggttgtggaagacagaaccatctcctttataggatgcattatgcaattcttctttgcatgcatatttgtggtgacggaaacattcatgttggcagtgatggcctatgatcgatatgtggcagtttgtaacccactcctctacacagttgtcatgtctcagaagctttgctccttattggtgagtgcatcatactcctggggtatagcctgctccttaacatacacatactttttgttgaccttatccttttgtgggactaacttcataaataactttgtctgtgaacatgctgccattgtctctgtgtcctgctctaacccctacattagccagaagatcattttagtctctgccacgttcaatgaaataagcagcttgatgatcattcttacctcctatgtttttatctttatcactgtcatgaagatgccttcaactggaggtcgccacaaagtcttctcaacatgtgcctctcatctgactgctattacaatcttccatgggaccatcctattcctctactgtgtacctgactccagaagttcatggctcatggtcaaggtggcttctgtgttttacactgtggtcatccccatgctgaacccactgatctacagtctcaggaacaaagatgtgaaggagacagtaaagaagttaattaatgttaaattgttctgtgacaaaatataa

SEQ ID NO: 836 - protein, 290 aa, Canis familiaris
MPLFLLFFTIYTVIVLGNLGMVMIIQINPKLHTPMYFFLSHLSFVDFCYSTVVTPKLLENLVVEDRTISFIGCIMQFFFACIFVVTETFMLAVMAYDRYVAVCNPLLYTVVMSQKLCSLLVSASYSWGIACSLTYTYFLLTLSFCGTNFINNFVCEHAAIVSVSCSNPYISQKIILVSATFNEISSLMIILTSYVFIFITVMKMPSTGGRHKVFSTCASHLTAITIFHGTILFLYCVPDSRSSWLMVKVASVFYTVVIPMLNPLIYSLRNKDVKETVKKLINVKLFCDKI

SEQ ID NO: 837 - DNA, 933 bp, Canis familiaris
atggaaaataggaataacatcacagaatttattcttttaggactttctcagaaaaaggaaatagaagtcctctgctttttactgttcttactctgttacattgcaattttgattggaaacctacttgtcatgatttctatcatctgcagtcaacttattaaccacccaatgtatttcttcttgagtttcctatccctggcagacctttgttacacctccactgtgacccccaagttaatcattgacttgctgtctgaaaagaaggtcatttcctacaatggctgcatgacacagctctttaccatgcacttctttggaggaattgaggtcttcatcctcaccgggatggcctatgaccgttatgtggccatctgcaaacccctgcactacaccctcctcatgagccggtggaaatgtgatgccattcttgcagcttcctgtattggtggattccttcattccttcggtcagtttctccttgccatcgttttaccctactgtggccccaatgaaatagatcacttcttctgcgatgtgtaccctttgctgaagctggcttgcaaggatacaagcagaatcggtcttctggtcgttgccaattcgggactgatgggtctggtgacttttgtcgtcttgctggtatcttatgctgtgatcctatatactatcaggtcctactctgcagagaatcgtcacaaagctctttccacatgcagttcccacatcactgtggtggttctcttttttgctcctttactctttatttatattcgaccagcaactacattaccagaagacaaagtgtttgctcttttttacactgtctttgcccctatgctcaaccctctcatatacacactaagaaacatggagatgaagaatgccataaggaaattttggtgccacgtcatgggaagtaaggacataaactga

SEQ ID NO: 838 - protein, 310 aa, Canis familiaris
MENRNNITEFILLGLSQKKEIEVLCFLLFLLCYIAILIGNLLVMISIICSQLINHPMYFFLSFLSLADLCYTSTVTPKLIIDLLSEKKVISYNGCMTQLFTMHFFGGIEVFILTGMAYDRYVAICKPLHYTLLMSRWKCDAILAASCIGGFLHSFGQFLLAIVLPYCGPNEIDHFFCDVYPLLKLACKDTSRIGLLVVANSGLMGLVTFVVLLVSYAVILYTIRSYSAENRHKALSTCSSHITVVVLFFAPLLFIYIRPATTLPEDKVFALFYTVFAPMLNPLIYTLRNMEMKNAIRKFWCHVMGSKDIN

SEQ ID NO: 839 - DNA, 939 bp, Canis familiaris
atggaaaataggaacaatgttactgaatttattctcttgggactttctaagaataagaaagtccaaatcctctgctttttatttttcttactctgttatctagctatctggttggggaatttgattattatggcttccatcacatgcagtcagctaattaatcagcccatgtatttcttccttaattaccttgccctctcagacctcctctatacctccactgtgacacccaaactaatgacagacttactgacagagaataaggtcatttcctataaaaactgcatgacacagctatttactacacatttctttggaggggttgaggtcttcatcatcacaggaatggcctatgatcgctatgtggccatctgcaaaccactccactatgccatcctcatgaataggcaaagatgtaactcaattctcagagcatcatgtgcaggggggtttctgcattcccttggcctgtttcttcttacaatttttttacctttttgtggacccaatgaaatagatcactatttctgtgatgtgtatcctttgttgaaactggcatgcattgatacacacaaaattggtttcttagtcattgccaattctggcctgatgggactggtgatctttgtggttttgatggcctcctactttatgatattatataatgtgagagcatattctgcagagaaccgccacaaggcgctttccacttgcagctcccacatcacagttgtgatcctgttttttgcacctgtcatctttgtttacattaggcctgccacaactttaccagaggataaagtatttacactcttctacacaattatcgtccccatgctcaatcctcttatctatacacttagaaacacagagatgaaaaatgccataaggaaagtttggtgcactgaaaggttttggaaagggaaaccaatgatttga

SEQ ID NO: 840 - protein, 312 aa, Canis familiaris
MENRNNVTEFILLGLSKNKKVQILCFLFFLLCYLAIWLGNLIIMASITCSQLINQPMYFFLNYLALSDLLYTSTVTPKLMTDLLTENKVISYKNCMTQLFTTHFFGGVEVFIITGMAYDRYVAICKPLHYAILMNRQRCNSILRASCAGGFLHSLGLFLLTIFLPFCGPNEIDHYFCDVYPLLKLACIDTHKIGFLVIANSGLMGLVIFVVLMASYFMILYNVRAYSAENRHKALSTCSSHITVVILFFAPVIFVYIRPATTLPEDKVFTLFYTIIVPMLNPLIYTLRNTEMKNAIRKVWCTERFWKGKPMI

SEQ ID NO: 841 - DNA, 942 bp, Canis familiaris
atggaaaatattaataatgtcactgaatttgttctgttgggactttcccagaataagaaagttaaaaacttatgctttctattattcttattttgttacatagctatttggatgggaaacttgctcataatgatttctatcacatgcagtcagctaattgaccaacccatgtatttcttccttaataatcttgccctctcagatctgtgttatacctcaacagtgacacccaagctagtcactgacttgctggtagaaagtaacatgatttcttatactaactgtatggcacagctttttgtcatgcatttctttggggggattgaagtctttatcctcacggggatggcctatgaccgctacgtggccatctgcaagcccttgcactacaccgtcatcatgaacagaaagagatgttatggcatagtcattgctagctgtactggggcatttctgcattcttttgtccaatgtctccttaccatcactttacctttctgtggccccaatgagatagatcactacttttgtgatgtgtatcctttgctgaaactggcctgcacagatacctacagagttgggatcttagtggttgccaattccggcatgatgggcttggtgacctttgtagtcttggttctatcctacttattgatattatacaccatcaagtcttaccctgcagagagccgcaccaaagctctttccacctgcagctcccatatcacagttgtggttctgttctttgtgcctgttctcttcatttacattcgcccagccacaacttttccagaagacaaagtgtttgctcttttctacaccatcattgctcccatgttcaaccctctgatttacacattaagaaacatggagatgaaaaataccttgaggaaagtgtggtgccagaaaccatgtttgattggaaagcaaatcattatataa

SEQ ID NO: 842 - protein, 313 aa, Canis familiaris
MENINNVTEFVLLGLSQNKKVKNLCFLLFLFCYIAIWMGNLLIMISITCSQLIDQPMYFFLNNLALSDLCYTSTVTPKLVTDLLVESNMISYTNCMAQLFVMHFFGGIEVFILTGMAYDRYVAICKPLHYTVIMNRKRCYGIVIASCTGAFLHSFVQCLLTITLPFCGPNEIDHYFCDVYPLLKLACTDTYRVGILVVANSGMMGLVTFVVLVLSYLLILYTIKSYPAESRTKALSTCSSHITVVVLFFVPVLFIYIRPATTFPEDKVFALFYTIIAPMFNPLIYTLRNMEMKNTLRKVWCQKPCLIGKQIII

SEQ ID NO: 843 - DNA, 984 bp, Canis familiaris
atggaaaataggaacaacatcactatgtttattctcttgggactgtctcaaaacaagaacattgaaatcttctgctttgtattatttttattttgctaccttgctatttgggtgggaaatttgctcataatgatttctatcatgtgcagtcagctaattgagcaacccatgtatttcttccttaattacctctcactctctgacctttgctacacatcaacagtgacacctaaactactaactgatttactggcagaaaggaagatcatttcctacagtaactgcatgacacagctttttattctgcactttcttggaggtgttgagatcttcgtcctcacagggatggcctatgaccgctacgtggccatctgcaagcccctacactacaccatcatcatgagcagacagagatgcaatgcaatcatcacagcctgttgtacgggggcgtttatacactccgccagtcagttccttctcaccatcttcctcccgttctgtggccccaatgagatagatcactacttctgtgatgtgtatcctttactgaagctggcctgcactgacacacgtagaattggtctcttggtaattgttaattcaggtctgatcgctctgctgacttttgtgattttgatggtgtcctattttctgatattatacaccatcatggcctaccctgcagagagccgcaccaaagctctttccacttgcagttcccatatcacagttgtggttctgttctttgtgccagttctcttcatttacattcgcccagccacaacttttccagaagacaaagtgtttgctcttttctacaccatcattgctcctatgttcaatcctctaatctacaccctgagaaacatggagatgaagaatgccttgaggaaagtgtggtgtcatcgtttatttttggaagggagggaactcatattaaaagcattccagaatttcactttaggattctaccctgagccctaa

SEQ ID NO: 844 - protein, 327 aa, Canis familiaris
MENRNNITMFILLGLSQNKNIEIFCFVLFLFCYLAIWVGNLLIMISIMCSQLIEQPMYFFLNYLSLSDLCYTSTVTPKLLTDLLAERKIISYSNCMTQLFILHFLGGVEIFVLTGMAYDRYVAICKPLHYTIIMSRQRCNAIITACCTGAFIHSASQFLLTIFLPFCGPNEIDHYFCDVYPLLKLACTDTRRIGLLVIVNSGLIALLTFVILMVSYFLILYTIMAYPAESRTKALSTCSSHITVVVLFFVPVLFIYIRPATTFPEDKVFALFYTIIAPMFNPLIYTLRNMEMKNALRKVWCHRLFLEGRELILKAFQNFTLGFYPEP

SEQ ID NO: 845 - DNA, 957 bp, Canis familiaris
atggaaagtcagaggaacatctcagaattcattcttttgggcctttcctataaccagaacatacaaatattttgtttcattttcttcttattttgttatgtttccatcttggtgggaaatcttctaattcttgtctccattctatgcagtggccttttttaccaaccaatgtactattttctcaaccacttatcctttatggacatttgctacacctcctgtgtgatacccaaactgattggtgacctactactggttagaaaaaccatctcttatgataactgtatgtcacaggtcttttccttgcacttcttgggaatgattgaaatcttcatccttacagtcatggcctttgatcgctatgctgccatctgcaaacctctccactacatgattattatgaacaggacaagatgcaatctcctagtcatggctgcttgggttggtggagctgtccattctttttctcagttttctatgataatctgtttgcccttctgtggccccaatgaaatcaatcactactattgtgatatcttccctttgctgaaaattgcctgtactgatacctatgtcattggtgtcattgtggttgccaattcaggaatggttgctttagtaacctttgttctcttgtttgggtcttatgttgttatactattcactttaagaaattactcagctgagggaagacgcaaagctctctctacctgtgggtctcatatcacggtggtcatcttattttttgggccttcaatctttgcctacctcagacctcctaccactttccctgaggacaaaatatttgcactattttataccgtcattgttcctatgttcaatcctttaatctatactctgagaaatacagaaaaaagccatgagaagggtttggtgtcaaaggatattttcagaagacaaacacaattgatttgtcctactcaatatgctgaataa

SEQ ID NO: 846 - protein, 318 aa, Canis familiaris
MESQRNISEFILLGLSYNQNIQIFCFIFFLFCYVSILVGNLLILVSILCSGLFYQPMYYFLNHLSFMDICYTSCVIPKLIGDLLLVRKTISYDNCMSQVFSLHFLGMIEIFILTVMAFDRYAAICKPLHYMIIMNRTRCNLLVMAAWVGGAVHSFSQFSMIICLPFCGPNEINHYYCDIFPLLKIACTDTYVIGVIVVANSGMVALVTFVLLFGSYVVILFTLRNYSAEGRRKALSTCGSHITVVILFFGPSIFAYLRPPTTFPEDKIFALFYTVIVPMFNPLIYTLRNTEKSHEKGLVSKDIFRRQTQLICPTQYAE

SEQ ID NO: 847 - DNA, 930 bp, Canis familiaris
atggatcaaagcaataacgtcactgtattcattctcttgggactttccaaaaacaagaacattgaaatcctttgttttgtattatttttattctgctaccttgctatttggataggaaacctgcttataatgatttctatcatgtgcagtcagctaattgagcaacccatgtatttcttccttaattacctctccgtctccgacctttgttacacatccactgtgacacccaagctaatgactgacttattggcagaaaggaagaccatttcctacagtaactgcatgacacaactctttaccacacatttatttggaggcatcgagatcttcattctcacagggatggcctatgaccgctatgtggccatctgcaaacccctgcactacaccatcatcatgagcagacagagatgtaatgcaatcatcgcagcctgctgtacgggggcgtttatacattccaccagtcagttccttctcaccatcttcctgccgttctgtggccccaatgagatagatcactacttctgtgatgtgtatcctttactgaagctggcctgttctaatacacacgccataggtctcttagtcattgctaattcaggcctaattgctttggtgacctttgctgtgctgacgctgtcttattgttttatactgtgcagcatcagggcatattctgcacagagtcgcagcaaagctcttgccacctgcacttctcacctcacagtcgtggttctattttttgcacctgcactgttcatttaccttcgcccagccacaactttcccagaagacaaagtgttggctcttttctacaccatcattgcccccatgttcaatcctctgatctacacgctgagaaacacggagatgaagaatgccttgaggaaagtgtggtgtcatcatgcactcctagaaggaaagtaa

SEQ ID NO: 848 - protein, 309 aa, Canis familiaris
MDQSNNVTVFILLGLSKNKNIEILCFVLFLFCYLAIWIGNLLIMISIMCSQLIEQPMYFFLNYLSVSDLCYTSTVTPKLMTDLLAERKTISYSNCMTQLFTTHLFGGIEIFILTGMAYDRYVAICKPLHYTIIMSRQRCNAIIAACCTGAFIHSTSQFLLTIFLPFCGPNEIDHYFCDVYPLLKLACSNTHAIGLLVIANSGLIALVTFAVLTLSYCFILCSIRAYSAQSRSKALATCTSHLTVVVLFFAPALFIYLRPATTFPEDKVLALFYTIIAPMFNPLIYTLRNTEMKNALRKVWCHHALLEGK

SEQ ID NO: 849 - DNA, 846 bp, Canis familiaris
aataatatgaataaatttttctgcttaggttgatccaggaagaaagtagtgtttgtcacttttttgcttttcttcttggggatgtagttgggtaactttctgattattactactttcaagtccagccgggcactcgggagtctggtatacttcttccttttccatttatcctcatctgacacctgcttctgtactcccatagcccctagaatgattatggatgtccttttgaagaagaccactgtctctttcagtaagaacatgatacaaattttttcattccgtttctttggctccctggagatcttcatcctcatcctcatgactgctgaccactatgtggccatctgtaagaccttgcactacacaaccatcatacgttgacggatctgtgctgtgctggtggctatggcctgggtggggtcctgtgcacattctttagttcagacatttctggccttgagtttaccgctccatggtctcagtgtgattgattgctatctttgtgacttgcagcttttgttgaaacttgcctgtgcagacacctatgtgatcaatctacttctggtgtcccaaagtggggccatttgtacattgagttttgtcatgctgatgtgctcctatgttatatataaccttgcagtctctgaaaaccacagtgctgaggggaggagaaaagccctctcctacatcattgtggtcatcttgttctttggtccttgtacatttatatacatacatcctgcaaccaccttctctgtgattaagataatagctttgttttatataattggaatacctttgctcaaccctctgatttatactctaaggaatgcagaagtgaaa

SEQ ID NO: 850 - protein, 146 aa, Canis familiaris
MAWVGSCAHSLVQTFLALSLPLHGLSVIDCYLCDLQLLLKLACADTYVINLLLVSQSGAICTLSFVMLMCSYVIYNLAVSENHSAEGRRKALSYIIVVILFFGPCTFIYIHPATTFSVIKIIALFYIIGIPLLNPLIYTLRNAEVK

SEQ ID NO: 851 - DNA, 936 bp, Canis familiaris
atggagcggcagagaaacatctcagaattcattcttctaggactttcatatgaccagaacatgcaaatattttgctttgtactcttcttattctgttatattgccctgttggtaggaaaccttctaatccttgtctccattcgatgcagccctctttttcaccaaccaatgtactacttcctcagccatttatcctctatggacatctgctatacctctagcgttacacccaaattaattgctgacctactaggggggactaaaaccatctcttatggtaattgcatgttacaagtttttgccatgcacttctttgggagtattgaggtctttgtccttactgtcatggcctttgatcgctatgttgctatttgcaggcctctccactacatgcttatcatgaacagggcaaggtgccatctcctagtcttagctgcttgggctggtggggctcttcattcttttcctcaattatcaatgacaatccaattgccattttgtggtcctaatgaaatcgatcactacttttgtgatatcttccctttgctgaaagttgcctgcactgatacttacatcattggtgtccttgtggttgccaattcaggtatggttgccttagttacctttgttgtcttatttgtttcttatgtcattatattgtttagtctaagacatcactcagctgagggaagacacaaagccctttccacctgtgggtctcatatcactgttgtcatcttattctttgggccttcaatctttgcctacctacgacctccaactactttccctgaggacaaagtatttgctctattttataccatcatcgctcctatgttcaatcccttaatctatactctgagaaatgcagaaatgaaaaatgccatgacaaaagtttggtgtcaaacattattttcaaggaaagcacacaattaa

SEQ ID NO: 852 - protein, 311 aa, Canis familiaris
MERQRNISEFILLGLSYDQNMQIFCFVLFLFCYIALLVGNLLILVSIRCSPLFHQPMYYFLSHLSSMDICYTSSVTPKLIADLLGGTKTISYGNCMLQVFAMHFFGSIEVFVLTVMAFDRYVAICRPLHYMLIMNRARCHLLVLAAWAGGALHSFPQLSMTIQLPFCGPNEIDHYFCDIFPLLKVACTDTYIIGVLVVANSGMVALVTFVVLFVSYVIILFSLRHHSAEGRHKALSTCGSHITVVILFFGPSIFAYLRPPTTFPEDKVFALFYTIIAPMFNPLIYTLRNAEMKNAMTKVWCQTLFSRKAHN

SEQ ID NO: 853 - DNA, 927 bp, Canis familiaris
ctaatgatgggaaaccagacatcagtgatagaattcattcttcttggactgatgaatgacactgaacttcaagctgtgcttttcctttttctgctgctaacttatgtcttaaacatcatgggaaactttaccatcatcattctgacccttttggattatcgccttcagactcctatgtatttctttctccggaatttttttattttggaaatatcttttacttctgtctttgttcccaaaatgctagtcaatattgcaactggagacaagactatctccttcgctggttgtttcactaagtatttttttgccatccttctgggggcaactgaattttatcttttagctgccatgttctatgattgctatgttgccatttgtaaacccctgcattatacaactgtaatgagcaggaaactgtgcgttcagcttgttctgtgttcctggttctctggttttttggttgtcattgtgccacatacaatgactctccaactgcctttctgtgcctacaatgtcatcaatcactgttgctgtgagtataccatactgctgcatctgtcctgttcagacacacagttcatagaagtgatggagtttatctttgcagcagttaccctcatcttcaccttggtgctagtgattctttcctacacgtacataatcaggacaattctgagaatcccttctgttcaacaaagaaaaaaagccttttctacatgctcctgtcacatgattgtggtctcactttcttatggaagttgtatctttatgtacataaatccttctgttaaggatgcagaaacttttaataagagagtggctgttttaaatacctcagttgcccctctgttgaaccctttcatctataccctaaggaaaaagcaagtgaaaatagccttcaaagacatggtcagcaagataatg

SEQ ID NO: 854 - protein, 308 aa, Canis familiaris
MMGNQTSVIEFILLGLMNDTELQAVLFLFLLLTYVLNIMGNFTIIILTLLDYRLQTPMYFFLRNFFILEISFTSVFVPKMLVNIATGDKTISFAGCFTKYFFAILLGATEFYLLAAMFYDCYVAICKPLHYTTVMSRKLCVQLVLCSWFSGFLVVIVPHTMTLQLPFCAYNVINHCCCEYTILLHLSCSDTQFIEVMEFIFAAVTLIFTLVLVILSYTYIIRTILRIPSVQQRKKAFSTCSCHMIVVSLSYGSCIFMYINPSVKDAETFNKRVAVLNTSVAPLLNPFIYTLRKKQVKIAFKDMVSKIM

SEQ ID NO: 855 - DNA, 735 bp, Canis familiaris
cctatgtatttctttctttgaaatttttctttcttagaaatttcttatacgacagtctgcatccccaaattgcttgtaagcatggccactggtgacaaaaccatttcctttaactgttgtgcaactcagttgtttgccttccttcttggagcatctgaatgttacctcctggctgtcatgtcctacaatcgttatgtagccatctgcaagcccctgcattacacaaccattatgagcagcaaaatctgtatccagctagttcttagctcttggatcactggtttcctcatcatctttccaggactcattttaggcttaagcctggacttctgtgattccaatgtcattgatcatttctactgtgacactgctcccctcctgcagatctcctgcacagacagacacgtgttggaaatgatgagtttcatcttagctttggtgactctgctggtcactttggcattagtaattctatcatacacatatattgccctaacaattttaaaaattccttctgccaaccagagaaaaaagaaaaaagctttctccacctgttcttctcacatgattgtcatctccctctcatatggcagctgcatctttatgtaccttaaaccctcagtcaaacagaggatatccttgatgaagggagtggcagttctcaatacttctgttgctccacttttgaatccctttatttatactctaaggaaacagcaggtgaagcaagcattt

SEQ ID NO: 856 - protein, 218 aa, Canis familiaris
MATGDKTISFNCCATQLFAFLLGASECYLLAVMSYNRYVAICKPLHYTTIMSSKICIQLVLSSWITGFLIIFPGLILGLSLDFCDSNVIDHFYCDTAPLLQISCTDRHVLEMMSFILALVTLLVTLALVILSYTYIALTILKIPSANQRKKKKAFSTCSSHMIVISLSYGSCIFMYLKPSVKQRISLMKGVAVLNTSVAPLLNPFIYTLRKQQVKQAF

SEQ ID NO: 857 - DNA, 945 bp, Canis familiaris
atgaaaaaccattcaacagaaatagagtttattctcataagactgacagatgacccacaattgcaagttgtgatttttgtgtttttatttcttaattacacattgagcctgatgaggaacttaaccattatcctcctcactctgctggatcctcacctcaagatgccaatgtatttctttctccataatttctcatttttagaaatcatattcacaatggtatgtattcccagatacttgaaaaccatagtgactaaagaaaaaaacatttcatataataactgtgtgactcaattattttttattcttttactgggagttgcagagttttaccttctggctgctatgtcctatgaccgctatgttgccatctgtaaacccttgcattacccaatcattatgaacagcagagtgtgctattggcttgtactttcttcctggctgactggattcctaattatctttacccctttgctcatgggactcaagctggatttctctgcttccaaagcgattgatcactttatgtgtgaaacttcccccatcctgcagatatcctgcacagacacacatgtcctagaattgatgtctttcatcttcgctgtggtgacacttgtggtcacattggtgttagtggttctctcctacacttgcatcatgaagaccattatgaaattcccttctgcacagcaaaggaccaaagctttttccgcctgtacttcccatatgattgttgtctccatgacatatgggagctgcatctttatgtatattaagccatctgccaaagaaagggtgactgtatccaaagatgtagctttgctgtatacctcaattgcccctttactaaatcccttcatttataccctaaggaatcagcaggtgaaagaaatcttttgggatatgttacaaaaaaggttgtgtttttcaaaaaaactgttgtaa

SEQ ID NO: 858 - protein, 314 aa, Canis familiaris
MKNHSTEIEFILIRLTDDPQLQVVIFVFLFLNYTLSLMRNLTIILLTLLDPHLKMPMYFFLHNFSFLEIIFTMVCIPRYLKTIVTKEKNISYNNCVTQLFFILLLGVAEFYLLAAMSYDRYVAICKPLHYPIIMNSRVCYWLVLSSWLTGFLIIFTPLLMGLKLDFSASKAIDHFMCETSPILQISCTDTHVLELMSFIFAVVTLVVTLVLVVLSYTCIMKTIMKFPSAQQRTKAFSACTSHMIVVSMTYGSCIFMYIKPSAKERVTVSKDVALLYTSIAPLLNPFIYTLRNQQVKEIFWDMLQKRLCFSKKLL

SEQ ID NO: 859 - DNA, 939 bp, Canis familiaris
atggaaagtgcaaaccattcagtggtgtctgaattcattttgcttggactttccaaatctcagaatcttcagattttgttctttgtaggattctctgtggtctatgccgggattgtgttaggaaacctcctcatcttggtcactgtgacctttgactcacaccttcacacaccaatgtactttctgcttatcaatctgtcctgtatagatatgatcctagcttcttttgctacccctaagatgatcatagacttcctccgaaaacagaagaccatctcttggtggggatgttattctcagatgtttttcatgcacctcctaggtgggactgagatgatgttgcttgtagccatggcaatagacaggtatgttgccatatgcaaacccctccattacatgaccataatgagcccacgagtgctcgttgggctgctgttatcttcctacgcagttggctttgtgcactcgtctagtcaaatggctttcatgttgcatttgcccttctgtggtcccagtgtggtggacagctttttctgtgaccttccccttgtgatcaaacttgcttgcgaggacacctacctgctacaactgctggttattgctgacagcggcctcctgtctctgatctgcttcctcctcttgcttgtctcctacatggttatcatatactcagtcaggcaccgtgctgctggtggttcagccaaggccttctccactctgtcagcacacatcacagttgtcactctcttctttgccccatgtgtctttatctatgtatggccctttagcagatattctgtagataaaattctttccgtgttttatacaattttcacacctctcttaaatcctattatttatacattaaggaatcaagaagtaaaagcagccataaagaggataagaactcgacatataaattcaaaacacactttgtag

SEQ ID NO: 860 - protein, 312 aa, Canis familiaris
MESANHSVVSEFILLGLSKSQNLQILFFVGFSVVYAGIVLGNLLILVTVTFDSHLHTPMYFLLINLSCIDMILASFATPKMIIDFLRKQKTISWWGCYSQMFFMHLLGGTEMMLLVAMAIDRYVAICKPLHYMTIMSPRVLVGLLLSSYAVGFVHSSSQMAFMLHLPFCGPSVVDSFFCDLPLVIKLACEDTYLLQLLVIADSGLLSLICFLLLLVSYMVIIYSVRHRAAGGSAKAFSTLSAHITVVTLFFAPCVFIYVWPFSRYSVDKILSVFYTIFTPLLNPIIYTLRNQEVKAAIKRIRTRHINSKHTL

SEQ ID NO: 861 - DNA, 948 bp, Canis familiaris
atggccatggaagatgcaaatctcacgtcagtcactgagttcctgctcctgggcctttcagagaaccccaagcaacagcagctgctgttcataatcttcctgactatgtacctggtcacggggctgggaaacctgctcatcatcctggctatcgccactgacccccgactccacacgcccatgtacttcttcctggctaacttggcctttgtggacatttgcttcacctccaccaccattcccaagatgctagccaaccacgtatcaggacacaaagggatcccttatgcgggctgcctgacccagatgttcttcttcatctggtttgctggcatcgatagcttcctgctggctgccatggcctatgaccgctatgtggccatctgtcaccctctgcactacaccacatctgtaacgccacagctctgtggattcctggtggctgcatcctggactgcagccttcgggaatgccctaacccacactgtattactgactcgcctctcattctgcacccacaaccgggttccccatttcttttgtgacctcagccctctgctgaagttggcctgctctgacatctttctcaataatataatggtgtacactgtgggcgccctacccatcatcacaccctttgtgggcatcttggtctcctacatacgcatctttgccacggtgctaaggatcccttccaccagaggcaagcagaaagctttctccacctgtggctctcatctgtctgtggtgtccctattctacgggacactcattggggtttatttcagcccaatgtcctcccacacggcccagaaggacacagccgctgcggtgatgtacaccgtggtcactcccatgctgaaccccttcatctacagcctacgcaacagtgacatgaagggggctttgggggccctcatcaataggaagccagtttttagtcagtga

SEQ ID NO: 862 - protein, 315 aa, Canis familiaris
MAMEDANLTSVTEFLLLGLSENPKQQQLLFIIFLTMYLVTGLGNLLIILAIATDPRLHTPMYFFLANLAFVDICFTSTTIPKMLANHVSGHKGIPYAGCLTQMFFFIWFAGIDSFLLAAMAYDRYVAICHPLHYTTSVTPQLCGFLVAASWTAAFGNALTHTVLLTRLSFCTHNRVPHFFCDLSPLLKLACSDIFLNNIMVYTVGALPIITPFVGILVSYIRIFATVLRIPSTRGKQKAFSTCGSHLSVVSLFYGTLIGVYFSPMSSHTAQKDTAAAVMYTVVTPMLNPFIYSLRNSDMKGALGALINRKPVFSQ

SEQ ID NO: 863 - DNA, 930 bp, Canis familiaris
atggtgtctgaattcattctcgtgggcttctccaccttcccacagcatctcctgcctgtcttctttctgttctacttgctgatgtacctgttcacgctgctggggaacctgctcatcatggctactatttggagtgagcgcaacctgcacacgcccatgtacctcttcctgtgtgccctgtccacctctgagattctgttcactgttgccgtcaccccccgcatgctggttgacatgctctccagccaccgttccatcacctttgtggcctgtgccacccagatgttcttctccttcacgtttggcttcacccattccttcttgcttatgatcatgggttatgaccgctatgtggccatctgccaccccctacgctacaacgtgctcatgagcatccgcacctgtgcccgtttggtgtcctggacctgggctggtggctcagtcatggggatgatggtgaccctgatagtttttcacctcaccttctgtgggtctaatgtgattcatcattttctctgccatgtgttttccctcttaaagttggcttgtgggaatgagaattcctcagtcaccttgggtgtgatccttgtgtgtgtctcagctctgatgggctgtttattcctcatcatcctctcctatatcttcatcgtggcggccatattgaggatcccctctgttgagggaaggcacaagaccttctccacctgtgtgtcccacctcactattgttattgtgcactacagttttgcctccattatctacctcaagccgaagggcccccattctatggacagtaacaccctgatggccaccacctatacagtctttaccccgtttctcagcccaatcatttttagcctcaggaataaggagctcaagaatgccataaagaaaagcttccagagaaaattcagtcccttacgctcctga

SEQ ID NO: 864 - protein, 309 aa, Canis familiaris
MVSEFILVGFSTFPQHLLPVFFLFYLLMYLFTLLGNLLIMATIWSERNLHTPMYLFLCALSTSEILFTVAVTPRMLVDMLSSHRSITFVACATQMFFSFTFGFTHSFLLMIMGYDRYVAICHPLRYNVLMSIRTCARLVSWTWAGGSVMGMMVTLIVFHLTFCGSNVIHHFLCHVFSLLKLACGNENSSVTLGVILVCVSALMGCLFLIILSYIFIVAAILRIPSVEGRHKTFSTCVSHLTIVIVHYSFASIIYLKPKGPHSMDSNTLMATTYTVFTPFLSPIIFSLRNKELKNAIKKSFQRKFSPLRS

SEQ ID NO: 865 - DNA, 468 bp, Canis familiaris
tgggctggtggctcaatcatggggatgatggtgaccctgacaggttttcacctcaccttctgttggtctaatgtgatccaccatttttccagcttcatgctttccctcctaaagttggcctgtgggaaggagacatcatctgtcaccttgggagtggccctggtgtgtgtcacagccgtgatgggctgtttatgcctcattgtcctctcctgtgtcttcatcgtgcccatggtatttaggactccgtctgctgagggcaggcataagaccatctccacttgtgtctcccacctcactgtggtcattgtgcaatatgtttttgcctccactatctagctccagcccgtggacccatttctatggacagtaacactctgatggccaccacctacagtcttcaccccctttctcagcccaatgtttttcagccttcaatataaggagctctagtatgccttaaagaaatca

SEQ ID NO: 866 - protein, 111 aa, Canis familiaris
WAGGSIMGMMVTLTGFHLTFCWSNVIHHFSSFMLSLLKLACGKETSSVTLGVALVCVTAVMGCLCLIVLSCVFIVPMVFRTPSAEGRHKTISTCVSHLTVVIVQYVFASTI

SEQ ID NO: 867 - DNA, 924 bp, Canis familiaris
atggtgtctgaattcatcctcgtgggcttctccaccttcccacagcatctcctgcctgccttctttctgttctacttgctgatgtacctgttcacgctgctggggaacctgctcatcatggctactgtctggagtgagcgcagcctgcacacgcccatgtacctcttcctgtgtgccctgtccacctctgagattctgttcactgttgccgtcaccccccgcatgctggttgacatgctctccagccaccactccatcacctttgtggcctgtgccacccagatgttcttctccttcatgttcggcttcacccattccttcttgcttatgatcatgggttatgaccgctacgtggccatctgccaccccctacgctacaacgtgctcatgagcatccgcacctgtgcccgtttggtgtcctggacctgggctagtggctcagtcatggggatgatggtgaccctgatagtttttcacctcaccttctgtgggtctaatatgatctaccattttggctgccatgtgttttccctcttaaagttggcctgtgggaaggagacatcctcggttacattgggtgtgatcctcgtgtgtgtctcagctctgatgggctgtttattcctcatcgtcctctcttatgttttcatcgtggctgccatattaaggatcccctctgctgagggcagaaccaagaccttctccacgtgtgtctcccacctcactgtggtcattgtgcactatggttttgcctccattatctacctcaagcccaggagctctatggacagtaacaccctgatggccaccacctatacagtcttcaccccatttctcagcccaatcattttcagcctcaggaataaggagctcaagaatgccataaagaaaagcttccagagaaaattccgtcccctaggctcctga

SEQ ID NO: 868 - protein, 307 aa, Canis familiaris
MVSEFILVGFSTFPQHLLPAFFLFYLLMYLFTLLGNLLIMATVWSERSLHTPMYLFLCALSTSEILFTVAVTPRMLVDMLSSHHSITFVACATQMFFSFMFGFTHSFLLMIMGYDRYVAICHPLRYNVLMSIRTCARLVSWTWASGSVMGMMVTLIVFHLTFCGSNMIYHFGCHVFSLLKLACGKETSSVTLGVILVCVSALMGCLFLIVLSYVFIVAAILRIPSAEGRTKTFSTCVSHLTVVIVHYGFASIIYLKPRSSMDSNTLMATTYTVFTPFLSPIIFSLRNKELKNAIKKSFQRKFRPLGS

SEQ ID NO: 869 - DNA, 1023 bp, Canis familiaris
atgtattcattccctttcttcctcttttttttttttttcattccttttctagtctcagcagatgcagcatccgtggctggtcagaactatagcatggtgtctgaattcatccttgtgggcttctccacattctcaaggcatctcctgcctgtcttcttcctgatttacctgctgatgtacctgttcacgctgctggggaacctgctcatcatggctactgtctggagtgaccacagcctgcacacacccatgtacctcttcctgtgtgccctgtccacctctgagattctgttcactgttactgtcacccctcgcatgctggttgacatactctctagccaccactctatcacctttgtggcctgtgccacccagatgttcttctccttcacatttggcttcacccattccttcttgctaacgatcatgggctatgaccgctacgtggccatctgccaccctctgcgctacaacgtgctcatgagcaccgacacctgtgctcgtctggtgtcttggacctgggctggtggctcagtaatagggatgacggtaaccctgttagtttttcacctcaccttctgtgggtctaatgtgatccaccattttgtctgccatgtactttccctcctaaaattggcctgtgggaatgagacatcctctgtaaccttgagtgtgatcctggtgtgtctctcagccctgatgggctgcttattcctcatcatcctctcctatgtcttcatcatgtccaccatattgagaatcccctctgctgagggcaggcacaagaccttctccacgtgtgtctcccacctcactgtggtcgttgtgcactatggttttgcctccattatctacctcaagcccaagagcctccattccatggacagtaacaccctgatggccaccacctatacagtcttcaccccgtttctcagcccaatcattttcagcctcaggaataaggagctcaagaatgccataaagaaaagctttcagagaaaattcagtcccctaggctcttga

SEQ ID NO: 870 - protein, 340 aa, Canis familiaris
MYSFPFFLFFFFFIPFLVSADAASVAGQNYSMVSEFILVGFSTFSRHLLPVFFLIYLLMYLFTLLGNLLIMATVWSDHSLHTPMYLFLCALSTSEILFTVTVTPRMLVDILSSHHSITFVACATQMFFSFTFGFTHSFLLTIMGYDRYVAICHPLRYNVLMSTDTCARLVSWTWAGGSVIGMTVTLLVFHLTFCGSNVIHHFVCHVLSLLKLACGNETSSVTLSVILVCLSALMGCLFLIILSYVFIMSTILRIPSAEGRHKTFSTCVSHLTVVVVHYGFASIIYLKPKSLHSMDSNTLMATTYTVFTPFLSPIIFSLRNKELKNAIKKSFQRKFSPLGS

SEQ ID NO: 871 - DNA, 960 bp, Canis familiaris
atggctgccaccttgggcctaaaccacagctctgtgtctgaattcatcctcgtgggcttctccaccttcccgccccatctcttgcctgccttcttcctgctgtttctgctcatgtacctgttcacgctgctggggaacctgctcatcatggccactgtctggagcgagcgcgccctgcacacgcccatgtacctcttcctgtgcaccctgtccatctccgagatcctctacaccttggccatcaccccgcgcctgctggctgacctgctctccacccgccgcaccatcgcctttgcagcctgtaccagccagatgttcttctccttcacgttcggcttcacccactccttcctgctcacggtcatgggctacgaccgctatgtggctatctgccaccctctgcgctataacgtgctcatgagcccccgaggttgtacctgcctggtggcctggtcctgggctggtggctcagtcatggggctggtggtgaccacagctgttttccacctcactttctgtggacccaatgagatccaccatttcttctgccacgtgccccctctcttgaagctggcctgtggaactgatgtaccaatagtggccctgggtgtggggctggtgtgcatcactgccctgctgggctgctttctcctcatcctcctttcctacgccttcatcgtggctgccatcttgaggatcccctctgctgagggcaggcacaaagccttctccacctgtgcatcccacctcactgtggtggtcgtgcactatggctttgcctctgtcatctacctcaagcccaaggctccccagtctctggaaggagacactctgatgggcatcacctacacaatccttacacctttcctcagtcccatcatcttcagtctcaggaacaaggaactgaagaccgccatgaagaagaccttcctcagcaaactctatccccagagctcctga

SEQ ID NO: 872 - protein, 319 aa, Canis familiaris
MAATLGLNHSSVSEFILVGFSTFPPHLLPAFFLLFLLMYLFTLLGNLLIMATVWSERALHTPMYLFLCTLSISEILYTLAITPRLLADLLSTRRTIAFAACTSQMFFSFTFGFTHSFLLTVMGYDRYVAICHPLRYNVLMSPRGCTCLVAWSWAGGSVMGLVVTTAVFHLTFCGPNEIHHFFCHVPPLLKLACGTDVPIVALGVGLVCITALLGCFLLILLSYAFIVAAILRIPSAEGRHKAFSTCASHLTVVVVHYGFASVIYLKPKAPQSLEGDTLMGITYTILTPFLSPIIFSLRNKELKTAMKKTFLSKLYPQSS

SEQ ID NO: 873 - DNA, 948 bp, Canis familiaris
atgcagagaggcaatttctcagtggtgactgaattcatcctcgtgggcttctccaccttcccccaccttcagctgatgttcttcctgctgtttctgctcatgtacctgttcacgctgctggggaacctgctcatcatggccactgtcgggagcgagcgcggcctgcacacgcccatgtacctcttcctgtgcgccctgtccatctccgagatcctctacaccttggccatcaccccgcgcctgctggccgacctgctctccacccaccacaccatcacctctatggcctgtgccagccagatgttcttctctttcacgttcggcttcacccactccttcctgctcacggtcatgggctacgaccgctatgtggccatctgccaccctctgcgctataacgtgctcatgagtccccgaggttgtacctgcctggtggtctggtcctgggttggtggcttggtcatggggctggtggtgaccacagctgttttccacctcactttctgtggacccaatgagatccaccattttgcttgccatgtgccccctctcttgaagctggcctgtggaactgatgtaccaatagtggccctgggtgtggggctggtgtgcatcactgccctgctgggctgctttctcctcatcctcctttcctacgccttcatcgtggctgccatcttgaggatcccctctgctgagggcaggcacaaagccttctccacctgtgcatcccacctcactgtggtggtcgtgcactatggctttgcctctgtcatctacctcaagcccaaggctccccagtctctggaaggagacactctgatgggcatcacctacacaatccttacacctttcctcagtcccatcatcttcagtctcaggaacaaggaactgaagaccgccatgaagaagaccttcctcagcaaattgtatccagaaaaaatatga

SEQ ID NO: 874 - protein, 315 aa, Canis familiaris
MQRGNFSVVTEFILVGFSTFPHLQLMFFLLFLLMYLFTLLGNLLIMATVGSERGLHTPMYLFLCALSISEILYTLAITPRLLADLLSTHHTITSMACASQMFFSFTFGFTHSFLLTVMGYDRYVAICHPLRYNVLMSPRGCTCLVVWSWVGGLVMGLVVTTAVFHLTFCGPNEIHHFACHVPPLLKLACGTDVPIVALGVGLVCITALLGCFLLILLSYAFIVAAILRIPSAEGRHKAFSTCASHLTVVVVHYGFASVIYLKPKAPQSLEGDTLMGITYTILTPFLSPIIFSLRNKELKTAMKKTFLSKLYPEKI

SEQ ID NO: 875 - DNA, 936 bp, Canis familiaris
atggacaatcagacccggaactttgaatttatcctccttggcctctctgagcagccattgcagcagcaggtgttctttggtctgtctttcagcctgtatctgattgggtgcatggggaatctgctcagcattctggccatcctcttggaccctcacctccatagccccatgtacttcttcctcagcaacctgtctcttcttgacatctgctttgcctccaccaccatccccaagatgttggtgaaccacctatgtgggcacagcaccatctcctccaaggcttgcctgacccagatgtatttcttcattacctttggggcagctgacagcatccttctttccaccatggcctatgaccgctatctagccatctgttgcccactacgctacatcacaatcatgagtgtccttcgttgtgccttgctggtggcagtcccctggatctcagcaaacctcatctccatggtccatactatcctgatgacccgcttgtccttttgcaccaataggatcccacactttttctgtgacctcaatgccttgatcaagctctcctgctctaatacccaagtcaatgagatgctggtgttggtctttgggggctcagttgttctgatcccttttgtgtgcatcatggcctcttatacacctattgctatggctgtgtggaaggtgccctcagcacaggggaagtggaaagcattctccacctgtagctctcacctttgtgttgttgctctcttctatgggaccattattggggtctacttcaaccctgcatccacacacaccacccagaaggacatagcaaccacagtgatgtacaccatggtcacccccatgctgaaccccttcatatatagccttcggaaccgagatctgaaggaagccctctggaaacttctcaaaggaaaccacttggctacgcctctttga

SEQ ID NO: 876 - protein, 311 aa, Canis familiaris
MDNQTRNFEFILLGLSEQPLQQQVFFGLSFSLYLIGCMGNLLSILAILLDPHLHSPMYFFLSNLSLLDICFASTTIPKMLVNHLCGHSTISSKACLTQMYFFITFGAADSILLSTMAYDRYLAICCPLRYITIMSVLRCALLVAVPWISANLISMVHTILMTRLSFCTNRIPHFFCDLNALIKLSCSNTQVNEMLVLVFGGSVVLIPFVCIMASYTPIAMAVWKVPSAQGKWKAFSTCSSHLCVVALFYGTIIGVYFNPASTHTTQKDIATTVMYTMVTPMLNPFIYSLRNRDLKEALWKLLKGNHLATPL

SEQ ID NO: 877 - DNA, 957 bp, Canis familiaris
atgttcatggaaccaaaaaaccaaaaaaaccaaacagtagtctcagaattcctccttctgggactcacagaaaaaccagagcatcagactctcctctttggacttttcctctctgtgtacctggtcaccgtctttgggaacctgctcatcgtcctggccatcatcacagactcccacctccacactcccatgtacttcttcctctccaacctgtccctcgtcgataccttcttctcttccaccactgtgcccaagatgctggtgaatctttggacccagaaccgggctatatcttttgtgggctgccttgctcagatgtacagcttccacctgttcgggaccacggatagcttcctcctggctgtgatggccattgaccggtttgtggccattgtccaccctctacgctactcagtcatcatgagcccttgtgtctgtgggttgctggtgggggtgccatggctgatcaccaatctccagtcactcgtgcacacctgcctcatggctcaactgaccttctgtgctggctctgaaatccctcatttcttctgtgatctcatgcccttgttgaagctctcctgctctgacacgcacaccaatgagctggtgatttttgcttttggaatcatcatgggcatcagtcctctctcatgcatcctcctctcttacacctgcattttctgggcagtcttcaagatcccttctgctcagggcaagtggaaagctttctccacttgtggctcacacctcactgtggtgtcactgttctatggcaccatctttgctgtgtacttgcagcccacatcacctgcctcctcccagaaggacaagtcagctgccctgatgtgtggggtggtcatccccatgttgaacccctttatatacagcctaaggaacaaggacatgaaggcagccctgaagaagcttgtcggcaaagcagtctcctctcagtcctag

SEQ ID NO: 878 - protein, 318 aa, Canis familiaris
MFMEPKNQKNQTVVSEFLLLGLTEKPEHQTLLFGLFLSVYLVTVFGNLLIVLAIITDSHLHTPMYFFLSNLSLVDTFFSSTTVPKMLVNLWTQNRAISFVGCLAQMYSFHLFGTTDSFLLAVMAIDRFVAIVHPLRYSVIMSPCVCGLLVGVPWLITNLQSLVHTCLMAQLTFCAGSEIPHFFCDLMPLLKLSCSDTHTNELVIFAFGIIMGISPLSCILLSYTCIFWAVFKIPSAQGKWKAFSTCGSHLTVVSLFYGTIFAVYLQPTSPASSQKDKSAALMCGVVIPMLNPFIYSLRNKDMKAALKKLVGKAVSSQS

SEQ ID NO: 879 - DNA, 990 bp, Canis familiaris
atggaaagaggaaaccaaacaggagttggaaactttctcctcctgggattcacagaggaactggacctacagcctttcttctttgggttgttcctgtccatgtatctggtcacattcactgggaatctgctcatcatcctggccatctgcttagactcccatctccacacacccatgtatttcttccttgccaacctgtcctctgctgacatctgtttcacctctaccaccgtccctaagatgctgctgaacatccagactcagagcaaaaccataacatatgaaggatgcctcagccagattttttttttcattgtatttggatgcctggacaatttactcctgaccgtaatggcctatgaccgctttgtggctatctgtcaccccctgcattacacagtcatcatgaacccccagctctgtgaactgctcgtcttggggtcctggtgcatcagtgtaacaggctcccttcttgagaccttgacccttttgaggctgtccttctgcacaaacatggaaatcccacactttttttgtgatcttcctgaagtcctgaagctcgcctgttctgacatcctcatcaataacatagtggtgtattttgtgactattgtcctaggtgtttttcctctctctggaaccctcttttcttattctgagattttttcctccatcctgagaatttcatcagccaggggcaaatataaagccttttccacgtgtgggtctcacctcttggtggtctccctgttctatggcacaggccttggggtctacctcagttctgcagtgacttcattctctaagatgagtttgatggcctcggtgatgtacaccattgtcacccctatgctgaaccccttcatctacagcttgaagaacagggacatgaagggggccctgggcaggctcctcagcagggtagtacctgtcagcatcaggactctcatgagtagctggggacacaataatgaagatgagaaatcttag

SEQ ID NO: 880 - protein, 329 aa, Canis familiaris
MERGNQTGVGNFLLLGFTEELDLQPFFFGLFLSMYLVTFTGNLLIILAICLDSHLHTPMYFFLANLSSADICFTSTTVPKMLLNIQTQSKTITYEGCLSQIFFFIVFGCLDNLLLTVMAYDRFVAICHPLHYTVIMNPQLCELLVLGSWCISVTGSLLETLTLLRLSFCTNMEIPHFFCDLPEVLKLACSDILINNIVVYFVTIVLGVFPLSGTLFSYSEIFSSILRISSARGKYKAFSTCGSHLLVVSLFYGTGLGVYLSSAVTSFSKMSLMASVMYTIVTPMLNPFIYSLKNRDMKGALGRLLSRVVPVSIRTLMSSWGHNNEDEKS

SEQ ID NO: 881 - DNA, 939 bp, Canis familiaris
atggaattgagaaaccactcagggcttccagtgtttctcctcctgggattttctgagaagccagaaattcagtctgttctctttgggctgttcctgtctttgtacctggtcactgtctttgggaacctgctcatcatcctggccatcagctcagactcccacctccacacccctatgtacttcttcctctccaacctgtccttttcagatatctgtttcacctcaaccaccatcccaaaaatgttgctgagcatccagactcagaacaaagtcattacctatgcaggctgcatcacacagatgtattttttcacagtttttggacttttggacaatttacttctgactgcaatggcctatgaccgttttgtggctgtctgtcatcccctgcactacacagtcatcatgaatcctcagctctgcgcccagttactcaccctgacctggctcatcagtgttctgggggcccttcctgagagtttaaccatgttgcgactctccttctgtgcagtcgttgaaatcccacactatttctgtgaactccctgaagtcctaaagcttgcctgctctaataccttcaccaataatgtcgtattatatattgtgacaggcgttatgggcttttttcctctcgctgggatccttttctcttattctcgaattgtctcttctgtattgaatatctcaacagtgggaggaaagtataaagcattctccacctgtgggtctcacctctccgtggtctccttattctacggaacctgtctgggggtctacctcagttccacctggacacatgcctctgagacagggatgttcgcctcagtcctgtataccgtggtcactcccatgatgaaccccttcatctacagcctgaggaacagagacatgaagagggctctgagaaagcttctctgtagcatgtcatcctcccaatga

SEQ ID NO: 882 - protein, 312 aa, Canis familiaris
MELRNHSGLPVFLLLGFSEKPEIQSVLFGLFLSLYLVTVFGNLLIILAISSDSHLHTPMYFFLSNLSFSDICFTSTTIPKMLLSIQTQNKVITYAGCITQMYFFTVFGLLDNLLLTAMAYDRFVAVCHPLHYTVIMNPQLCAQLLTLTWLISVLGALPESLTMLRLSFCAVVEIPHYFCELPEVLKLACSNTFTNNVVLYIVTGVMGFFPLAGILFSYSRIVSSVLNISTVGGKYKAFSTCGSHLSVVSLFYGTCLGVYLSSTWTHASETGMFASVLYTVVTPMMNPFIYSLRNRDMKRALRKLLCSMSSSQ

SEQ ID NO: 883 - DNA, 930 bp, Canis familiaris
atggaaccaaagaatgatacacgaatttcagaatttcttcttctgggattttcagaggaaccagaattgcaacccttcctctttgggtttttcctgtgcatgtacctggtcaccatacttgggaatctgctcatcatcctggctgtcagctctgattcccacctccacacacccatgtatttcttccttgccaacctttcctttgtagaaatctgtttcatctccaccactgtccccaagatgctgatgaatatacacgcaaagaaaaaagtcataacatataaaagctgcatcatgcagatgtactttttcctactttttgtaggtttggacaacttccttctgactgtgatggcctatgacagattcatggccatctgtaatcccctgcactacatggttatcatgaaccctgggctctgtggactgctggttctggtgtcctgggtcgtgagtgtcttgcattccctgttacaaaccttaatggtgttgcggctgtccttctgtacagaggtggaaatcccccactttttctgtgaactcaatcaggtgatccaacttgcctgttctgacacctttctcaacaacatggtgatgtatcttgcaactgtgcttctggctggtggtcccctggctggggtcctttactcttactctaagatcgtttcctccatacgtaaaatacaatcagctaagggcaagtataaagcattttccacctgtgcatctcacctctcggttgtctccttattttactgtacgggcctaggagtgtaccttagctctgctgctacccagagctcccactcaagtgcagaagcctcggtaatgtacacggttgtcacgcccatgctgaaccccttcatctacagcctgcggaacagagacataaagagggttctaaatgtatttttcagaaggaagccataa

SEQ ID NO: 884 - protein, 309 aa, Canis familiaris
MEPKNDTRISEFLLLGFSEEPELQPFLFGFFLCMYLVTILGNLLIILAVSSDSHLHTPMYFFLANLSFVEICFISTTVPKMLMNIHAKKKVITYKSCIMQMYFFLLFVGLDNFLLTVMAYDRFMAICNPLHYMVIMNPGLCGLLVLVSWVVSVLHSLLQTLMVLRLSFCTEVEIPHFFCELNQVIQLACSDTFLNNMVMYLATVLLAGGPLAGVLYSYSKIVSSIRKIQSAKGKYKAFSTCASHLSVVSLFYCTGLGVYLSSAATQSSHSSAEASVMYTVVTPMLNPFIYSLRNRDIKRVLNVFFRRKP

SEQ ID NO: 885 - DNA, 969 bp, Canis familiaris
atggacccaggaaattatacaggaatttcagaattctaccttatgggattttcagaagaactagaactacagccccttgtatttgggcttttcctctccatgtacctggtcactgtgtttggaaacctgctcatcatcctggccgtcagctctgacccccacctccacacccctatgtacttcttcctcaccaacctgtcctttgtagacatctgtttcacctccaccaccgttcccaagatgctgcagaacatccagacccaaagcaaagtcatcacctatgcaaggtgcctcacacagatgtactttttcatactgtttacaggattagacatctttcttctaactgtgatggcttatgaccggtttgtagccatctgtcaccccctgcgctacacggtgatcatgaacccctggctttgtgcactgctggttctggtgtcctgggtcgtgagtgtcctgtattccttgttacaaacctccatggtgttgcagctctccttctgtacagaggtggaaatcccccactttttctgtgaactgaatcagatgatacaacttgcctgctctgacacctttctcaacaacatggtgatgtatcttgcaactgtgcttctggctggtggtcccttctttgggatcctttactcttactctcagattgtttcctccatacatagaatctcatcagctcagggcaagtataaagcattttccacctgtgcatctcacctctcggttgtctccttattttactgtacgggcctaggagtgtaccttagctctgctgctacccagagctcccactcaagtgcagtggcctcagtgatatacacagtggtcacgcccatgctgaatcccttcatctacagcctgcggaacagagacataaaggaggctctgatgagattctctgggatgccagctctaaagggaccaatcgtcctggggctgaagaagtgcccatga

SEQ ID NO: 886 - protein, 322 aa, Canis familiaris
MDPGNYTGISEFYLMGFSEELELQPLVFGLFLSMYLVTVFGNLLIILAVSSDPHLHTPMYFFLTNLSFVDICFTSTTVPKMLQNIQTQSKVITYARCLTQMYFFILFTGLDIFLLTVMAYDRFVAICHPLRYTVIMNPWLCALLVLVSWVVSVLYSLLQTSMVLQLSFCTEVEIPHFFCELNQMIQLACSDTFLNNMVMYLATVLLAGGPFFGILYSYSQIVSSIHRISSAQGKYKAFSTCASHLSVVSLFYCTGLGVYLSSAATQSSHSSAVASVIYTVVTPMLNPFIYSLRNRDIKEALMRFSGMPALKGPIVLGLKKCP

SEQ ID NO: 887 - DNA, 969 bp, Canis familiaris
atggacccaagaaatgatacaggaatttcagaattctaccttatgggattttcagaggaactagaactacagccccttgtatttgggcttttcctctccatgtacctgatcactgtgtttggaaacctgctcatcatcctggccgtcagttctgacccccacctccacacccccatgtacttcttcctcaccaacctgtcctttgtagacatctgtttcacctccaccaccgttcccaagatgctgcagaacatccagacccaaagcaaagtcatcacctatgcaaggtgcctcacacagatgtacttttttatactgtttacaggattagacatctttcttctaactgtgatggcttatgaccggtttgtagccatctgtcaccccctgcgctacacggtgatcatgaacccctggctttgtgcactgctggtcctagtgtcctgggtcctgagtgtcctgcattccttgttacaaacctccatggtgttgcagctctccttctgtacagaggtggaaatcccccactttttctgtgaactgaatcagatgatacaacttgcctgctctgacacctttctcaacaacatggtaatgtattttgcagctatgttgctggctggtggtaccttccttgggatcctttactcttactctaggattgtttcctccatacatagaatctcatcagctcagggcaagtataaagcattttccacctgtgcatctcacctctcggttgtctccttattttactgtacgggcctaggagtataccttagctctgctgctacacagagttctcactcaagtgcagtggcctcagtgatgtacacagtggtcatacccatgctgaatcccttcatctacagcctgcggaacagagacataaaggaggctctgatgagattctctgggatgccagctctaaaagagccaatcatcctggggctgaagaggtgcccatga

SEQ ID NO: 888 - protein, 322 aa, Canis familiaris
MDPRNDTGISEFYLMGFSEELELQPLVFGLFLSMYLITVFGNLLIILAVSSDPHLHTPMYFFLTNLSFVDICFTSTTVPKMLQNIQTQSKVITYARCLTQMYFFILFTGLDIFLLTVMAYDRFVAICHPLRYTVIMNPWLCALLVLVSWVLSVLHSLLQTSMVLQLSFCTEVEIPHFFCELNQMIQLACSDTFLNNMVMYFAAMLLAGGTFLGILYSYSRIVSSIHRISSAQGKYKAFSTCASHLSVVSLFYCTGLGVYLSSAATQSSHSSAVASVMYTVVIPMLNPFIYSLRNRDIKEALMRFSGMPALKEPIILGLKRCP

SEQ ID NO: 889 - DNA, 234 bp, Canis familiaris
cccactttttcctgtgaactcaatcagatgatccaacttgcttgttctgatacctttcttaatgacacagtgctatatgtttcaactatgttgctggctggtggtccccttgctgggatcctttattcaaactctaagattatctcctccatacttagaatcttatcagctcagggcaagtataaagcattttccacctctgcatctcacctctcaggtgtcctcttctttttt

SEQ ID NO: 890 - protein, 78 aa, Canis familiaris
PTFSCELNQMIQLACSDTFLNDTVLYVSTMLLAGGPLAGILYSNSKIISSILRILSAQGKYKAFSTSASHLSGVLFFF

SEQ ID NO: 891 - DNA, 399 bp, Canis familiaris
atgggatcaggcaatacccaaatttcaggatttcttcttctgggattatcaaacaaaccagaactgcatcccctcatatttgggcttttcctctccatgtacctgatcactgtgattggaaattggctcatcatcctggctgtcagctctgacccccacctccacacccccctcaccaacctgtcctttgtagacatctgtatcacctccaccactatccccaagatgttccataacattcagactaggattaaagtcataacctatgaaggctgcatcacacagatatactttttcctactctttgctggactgggttactttctcctgtccgaaatggcctatgaccactacgtggccatctgccaccccctgcactacatggtcatcacaaacccc

SEQ ID NO: 892 - protein, 133 aa, Canis familiaris
MGSGNTQISGFLLLGLSNKPELHPLIFGLFLSMYLITVIGNWLIILAVSSDPHLHTPLTNLSFVDICITSTTIPKMFHNIQTRIKVITYEGCITQIYFFLLFAGLGYFLLSEMAYDHYVAICHPLHYMVITNP

SEQ ID NO: 893 - DNA, 933 bp, Canis familiaris
atggaaccaggaaatgatacacgaatttcagagtttcttcttctgggattaacagaggaaccagaattgcaaaccctcatatttgggcttttcctcaccatgtacctgatcactgtgtttggaaatctactcatcatcctggccattggctctgactcccacctccacacccccatgtacttctttcttgacaacctgtcctttgtagacatctgtttcacctccaccaccatccccaagatgctgctgaatatccagactcagagcaaagtgatcacttatgaaggctgcatctcacagatttattttctcatactctttgccgtgtcagacatctttcttctgagtgtgatggcctatgaccggtatgtggccatctgccaccccctacactacatggtcatcatgaaccctcatctctgtaaactgctagttctggtgtcctggatcatgtctatcctgaattccttgttacatagtttaatgatgttgcggctgtccttctgtacacacttccaaatcccccactttttttgtgaactcaaccagatgatccaacttgcctgttctgacacctttcttaataacttggtgatgtattttgcagctgtcctgctggctggtggtcctttcgctgggatcctttactcttactctaagattgtttcctccatacacagaatctcatcagctcagggcaagtataaagcattttctacctgtgcatctcacctctcagttgtctccttattttattgtacgatgcttggtgtgtaccttagctctgctgctacccagagctcccacacaagtgcagtggtctctgtaatgtacactttggttgcacccatgctgaaccccttcatctacagcctgaggaacaaagacataaagagggctctgaaaagaatcattggggttccagagatgtaa

SEQ ID NO: 894 - protein, 310 aa, Canis familiaris
MEPGNDTRISEFLLLGLTEEPELQTLIFGLFLTMYLITVFGNLLIILAIGSDSHLHTPMYFFLDNLSFVDICFTSTTIPKMLLNIQTQSKVITYEGCISQIYFLILFAVSDIFLLSVMAYDRYVAICHPLHYMVIMNPHLCKLLVLVSWIMSILNSLLHSLMMLRLSFCTHFQIPHFFCELNQMIQLACSDTFLNNLVMYFAAVLLAGGPFAGILYSYSKIVSSIHRISSAQGKYKAFSTCASHLSVVSLFYCTMLGVYLSSAATQSSHTSAVVSVMYTLVAPMLNPFIYSLRNKDIKRALKRIIGVPEM

SEQ ID NO: 895 - DNA, 975 bp, Canis familiaris
gaaccaggaaatgttacacgaatttcagagtttcttcttctgggattatccgaggaaccagaactgcagcccctcatatttgggtttttcctctccatgtacctgatcactgtgtctggaaatctgctcatcattgtggccggcagctctgactcccacctccacacccccatgtacttcttccttgccaacctgtcctttgtagacatggtttcacctccaccgccgtccccaagatgctgtggaacatccagactcagaacaaaatcattaactatgcaggctgcatcagccagatgtatttttttcctactatgtgcagagttggacgactttatcctgtccacaatagcctaagaccacttcatggccatctgtcaccccctgcactacatggttatcatgaacccctggctctgtggactgctggttctagtgtcctggatcatcggtgtcctgaattccttattacagagcttaatggtgttgtgggtgtccttctgtacaggcacggaaatccctcattttttaactcaatcaagtaatcaggaatactgttctgacatttttcttaatgacatggtgatgtattttatgactgtgctgctggcaggtggtcctttcactgggttcctttactcttactctaagattgtttcccccatacatagaatctcatcagcttagagcaagtataaagcattttctacctgtgcatctcttggttgtctccttattttactctaaagcctagaagtgtactttagctctgctgctccccagagctcccacgcaagtgcagtggcctcggtgatgtacacatagtcatacccatgctgaacccctatagtcatacccatgctgaaccccttcatctatagtctgaagaacagagacataaagagggctctgaaaagaatcttcggggttccagtgatgcagtggccagtcatcctggggctgaagatgtgccca

SEQ ID NO: 896 - protein, 118 aa, Canis familiaris
EPGNVTRISEFLLLGLSEEPELQPLIFGFFLSMYLITVSGNLLIIVAGSSDSHLHTPMYFFLANLSFVDMVSPPPPSPRCCGTSRLRTKSLTMQAASARCIFFLLCAELDDFILSTIA

SEQ ID NO: 897 - DNA, 954 bp, Canis familiaris
atggagccaggaaaccttacaggagtttcagagtttcttcttctggggttttcagaaggaccagaactgcagcccttcatatttgggcttttcctctccatgtacctgatcactgtgtttggaaacctgctcctcatcctggctgtcagctctgactcccacctccatacacccatgtactttttcctcgccaacctgtcctttgtagacatctgtttcacctccaccactgtccccaagatgctgataaacatccagactcagagcaaagtgatcacttatgaaggatgcctcagccagatgtattttttcatactctttgcaggattagacatctttctcctgactgtgatggcttatgaccgctttgtagccatctgccaccccctgcactacttggtcatcatgaaccctcgggtatgtggactgctggttctggtgccctggatcatgagcatcttgaattccttgttagaaagcataatggtgttgcgcttgtccttctgtacagtcttggaaatcccccactttttctgtgaactcaatcagatgatacaacttgcatgttctgacacctttctcagtaacatggtgatgtattttgcagctgtgcttctgggtggtgttccttttgctggaatcctttactcttattccaagatagtttcctctatacgtgggatctcatcagctcagggaaagtataaagcattttccacctgtgcatctcacctctcagttgtctccttattttattgtacagtcctgggagtgtaccttagctctgctgctccccagagctccaactcaagtgcggtggcctcagtgatgtacacggtggtcacacccatgctgaaccccttcatctacagcctgaggaacagagacattaagaggactcttatgagattttctagaatgtcagctctaaaatggccaactgttctgggctga

SEQ ID NO: 898 - protein, 317 aa, Canis familiaris
MEPGNLTGVSEFLLLGFSEGPELQPFIFGLFLSMYLITVFGNLLLILAVSSDSHLHTPMYFFLANLSFVDICFTSTTVPKMLINIQTQSKVITYEGCLSQMYFFILFAGLDIFLLTVMAYDRFVAICHPLHYLVIMNPRVCGLLVLVPWIMSILNSLLESIMVLRLSFCTVLEIPHFFCELNQMIQLACSDTFLSNMVMYFAAVLLGGVPFAGILYSYSKIVSSIRGISSAQGKYKAFSTCASHLSVVSLFYCTVLGVYLSSAAPQSSNSSAVASVMYTVVTPMLNPFIYSLRNRDIKRTLMRFSRMSALKWPTVLG

SEQ ID NO: 899 - DNA, 933 bp, Canis familiaris
atggaaccaggaaatgattcacaaatttcagagtttcttcttttgggattatctgaggaaccagaactgcagcccctcctatttgggcttttcctctccatgtacctgatcactatctttggaaacctgctcataatcctggctgtcaggtcagaccctcacctccataccccgatgtacttcttccttgccaacctgtcctttgtagacatctgtttcacctccaccaccgtccccaagatgctcctgaacattcagactcagattaaagtcatcacctataaaggctgcatcactcagatatactttttcctcctcttcactgcactggatgactttctcctggctgtgatggcctatgaccgcctcgtggccatctgtcaccccctgcactacagggtcatcatgaaacctacctgctgtgcactgctggttctgatgtcctggatgataagtgcgctgaattccttattacaaagcttaatggtattgtggctgtccttctgttcagaggtggaaatctcccacttcttttgtgaactcaatcaagtggtccaacttgcctgttctgacacctttcttaatgacctggtgatgtattttgcagctgtttttctggctggtggtcccctcactgggatactttactcttactctaagatagtttcctccatacagagaatctcatctgctcagggcaagtataaagcattttccacctgtgcatctcacctcttggttgtctctttattttattgtacactcataggagtgtaccttagctctgctgctacccagagctctcattcaagtgcagtggcctcagtaatatacacagtggtcacgcccatgctgaaccccttcatctacagcctgaggaacaaagacataaagagggctctgaaaagaatcattggagttccagtgatgtaa

SEQ ID NO: 900 - protein, 310 aa, Canis familiaris
MEPGNDSQISEFLLLGLSEEPELQPLLFGLFLSMYLITIFGNLLIILAVRSDPHLHTPMYFFLANLSFVDICFTSTTVPKMLLNIQTQIKVITYKGCITQIYFFLLFTALDDFLLAVMAYDRLVAICHPLHYRVIMKPTCCALLVLMSWMISALNSLLQSLMVLWLSFCSEVEISHFFCELNQVVQLACSDTFLNDLVMYFAAVFLAGGPLTGILYSYSKIVSSIQRISSAQGKYKAFSTCASHLLVVSLFYCTLIGVYLSSAATQSSHSSAVASVIYTVVTPMLNPFIYSLRNKDIKRALKRIIGVPVM

SEQ ID NO: 901 - DNA, 930 bp, Canis familiaris
atggaactagagaatgatacacaaatttcagaatttcttcttctgggattttcagaggaaccagaattgcagcccttcctctttggactgttcctgttcatgtacttggtcaccatacttgggaacctgctcatcattctggctgtcagctatgacacccacctccacacccccatgtacttcttccttgccaacctgtcctttgtagacatctgtttcacctccactacagtccccaggatgctggtaaatatacaaacacagagaaaagtcataatttatgaaagctgcatcatgcagatgtactttttcttactttttgctggtttggacaactttcttctgagtgttatggcctatgaccgatttgtggccatctgtcaccccctgcactacatggtcaccatgaacccccagctctgtggactgctggttctggtgtcctggatcatgagtgccctgcattctttgttacaaacattaatggtgttgcggttgtccttccatacagaggtggaaatcccccactttttctgtgaactcaatcagatgatccagcttgcctgttctgacacctttcttaataacatggtgttgtactttgcagctatgctgctggctggtatccccatggctggggtcctctactcttattgtaagatagtttcctctatacgtagaatctcatcagctcagggcaagcataaagcattttccacctgtgcatcacatctttcagttgtctctttattttattgtacgagcctaggtgtgtaccttagctctgcagctacccagagctcccactcaagtgcagtagcctcagtgatgtacacggtggtcacacccatgctgaatccctttatttacagcctgaggaacaaagatataaaggaggcactaagtgtgtttttcagagggaagacataa

SEQ ID NO: 902 - protein, 309 aa, Canis familiaris
MELENDTQISEFLLLGFSEEPELQPFLFGLFLFMYLVTILGNLLIILAVSYDTHLHTPMYFFLANLSFVDICFTSTTVPRMLVNIQTQRKVIIYESCIMQMYFFLLFAGLDNFLLSVMAYDRFVAICHPLHYMVTMNPQLCGLLVLVSWIMSALHSLLQTLMVLRLSFHTEVEIPHFFCELNQMIQLACSDTFLNNMVLYFAAMLLAGIPMAGVLYSYCKIVSSIRRISSAQGKHKAFSTCASHLSVVSLFYCTSLGVYLSSAATQSSHSSAVASVMYTVVTPMLNPFIYSLRNKDIKEALSVFFRGKT

SEQ ID NO: 903 - DNA, 369 bp, Canis familiaris
aagatggcagctgacttcctgcagggagagggctccatctcctttgaaggttgtgcagctcagatgttcttcctgatgctactgggtgtctctgagggtgtcctactatccctcatgtcctatgactgctatgttgctgtgtgtcaccccctgcattatcctgtgctcatgaggtgtcaagtctgtctgctcatggtgggcacctcctggttgtcaggtgtgcttgtggcctccacccagacctccatcaccctgcacttcccctactgtgcctcacacactgtggatcacttcttctgtgagtttcttagaatcacaattttaagatgcatatctgttggggcacctgagtggctcactcagtcaagt

SEQ ID NO: 904 - protein, 123 aa, Canis familiaris
KMAADFLQGEGSISFEGCAAQMFFLMLLGVSEGVLLSLMSYDCYVAVCHPLHYPVLMRCQVCLLMVGTSWLSGVLVASTQTSITLHFPYCASHTVDHFFCEFLRITILRCISVGAPEWLTQSS

SEQ ID NO: 905 - DNA, 948 bp, Canis familiaris
atggccatggaagacgcaaatctcacgtcagtcactgagttcctgctcctgggcctttcagagaaccccaagcaacagcagctgctgttcataatcttcctgactatgtacctggtcacggggctgggaaacctgctcatcatcctggctattgccactgacccccgactccacacgcccatgtacttcttcctggctaacttggcctttgtggacatttgcttcacctccaccaccattcccaagatgctagccaaccacgtatcaggacacaaagggatcccttatgcgggctgcctgacccagatgtttttcttcatctggtttgctggcatcgatagcttcctgctggctgccatggcctatgaccgctatgtggccatctgtcaccctctgcactacaccacatctgtaacgccacagctctgtggattcctggtggctgcatcctggactgcagccttcgggaatgccctaacccacactgtattactgactcgcctctcattctgcacccacaaccgggttccccatttcttttgtgacctcagccctctgctgaagttggcctgctctgacatctttctcaataatgcaatggtatataccttgggcgccctaccgaccatcataccctttgtgggcatcttggtctcttacacatgcatctttgctacggtgctgaggatcccttccaccagaggcaagcagaaagctttctccacctgtggctctcatctgtctgtggtgtccctattctacgggacactcattggggtttatttcagcccaatgtcctcccacacggcccagaaggacacagccgctgcggtgatgtacaccgtggtcactcccatgctgaaccccttcatctacagcctacgcaacagtgacatgaagggggctttgggggccctcatcaataggaagccagtttttagtcagtga

SEQ ID NO: 906 - protein, 315 aa, Canis familiaris
MAMEDANLTSVTEFLLLGLSENPKQQQLLFIIFLTMYLVTGLGNLLIILAIATDPRLHTPMYFFLANLAFVDICFTSTTIPKMLANHVSGHKGIPYAGCLTQMFFFIWFAGIDSFLLAAMAYDRYVAICHPLHYTTSVTPQLCGFLVAASWTAAFGNALTHTVLLTRLSFCTHNRVPHFFCDLSPLLKLACSDIFLNNAMVYTLGALPTIIPFVGILVSYTCIFATVLRIPSTRGKQKAFSTCGSHLSVVSLFYGTLIGVYFSPMSSHTAQKDTAAAVMYTVVTPMLNPFIYSLRNSDMKGALGALINRKPVFSQ

SEQ ID NO: 907 - DNA, 969 bp, Canis familiaris
atggagccagggaaccttacagaagtttcagagtttcttcttctgggattttcagagggaccagaactgcagcctctcatctttgggtttttcctctccatgtacctgatcactgtgtttggaaacctgcttctcatcctggctgtcagctctgactcccacctccacacacccatgtatttcttcctcgccaacctgtcctttgtagacatttgtttcacctccaccaccatccccaagatgctgatgaatatacagacagagagaaaagtcattacctatgcagactgcatcacccaaatgtattttttcctactctttgcaggattggacaactacatcttgaccgtgatggcctatgaccgatttttggccatctgtcaccccctgcactacacagtcatcatgaatccccagatctgtggactgctggttttggtatcttggatcatgagtgccctgcattctttgttacaaacctcagtggtgttgcggctgtccttctgtacagaggtggaaattccccactttttctgtgaaattaaacagttggtccaacttgcctgttctgacacctttcttaatgacatggtgatgtattttggagctgggctgctgggtggtggtccccttgctgggatcctttactcttattctaagatcatttcctccatatttgggatctcatcagctcagggcaagtataaagcattttccacttgcgcatctcacctctcagttgtctccttattttactgtacaagcctaggagtgtaccttagttctgctgctccccagacatcacacttgagtgcaacagcctcagtgatgtacacagtggtcacacccatgctgaaccccttcatctacagcctgagaaataaaggcataaagagggctctgaaaagattctttggaaaacaaagtataaaagggcccttttttctggggctgaagaaatacacgtaa

SEQ ID NO: 908 - protein, 322 aa, Canis familiaris
MEPGNLTEVSEFLLLGFSEGPELQPLIFGFFLSMYLITVFGNLLLILAVSSDSHLHTPMYFFLANLSFVDICFTSTTIPKMLMNIQTERKVITYADCITQMYFFLLFAGLDNYILTVMAYDRFLAICHPLHYTVIMNPQICGLLVLVSWIMSALHSLLQTSVVLRLSFCTEVEIPHFFCEIKQLVQLACSDTFLNDMVMYFGAGLLGGGPLAGILYSYSKIISSIFGISSAQGKYKAFSTCASHLSVVSLFYCTSLGVYLSSAAPQTSHLSATASVMYTVVTPMLNPFIYSLRNKGIKRALKRFFGKQSIKGPFFLGLKKYT

SEQ ID NO: 909 - DNA, 969 bp, Canis familiaris
atgaaaccagccaatgctacacgaatgtcagaattccttcttctagggttttcagaggaaccagaacttcagcccctcatatttgggcttttcctatccatgtacctgatcactgtgtttggaaacctgctcatcatcctggccatcagctctgaatcccatctccacacccccatgtacttcttccttgccaacctgtccttggtggacatctgtttcacctccaccactgtcccaaagatgctgtggaacatccagactcagagcaaagtcatcacctatgcaggctgcatcacacagatgtattttttcataatcttttcaggtttggacatctatctcctggctgtgatggcttatgacaggtttgtggccatttgtcaacctctacactacatggccatcatgaacaccaggctctgtggactgctggttctggtatcctggaccacgagtgtcttgcattccttgttacaaacctcaatggtgttgcggctgtccttctgtacagaggtggaaatcccccactttttctgtgaactcaatcaaatgatccaacttgcctgttctgacacctttcttaataatgtggtaatgtattttgcagctatgttgctggctggtggtcccctcactgggatcctttactcgtattctaagattgtttcctccatttgtagaatctcatcagctcagggcaagtataaagctttttccacctgtgcatctcatctctcagttgtctccttatttttttgtactagcctaggagtgtaccttagctctgctgctacccagagctcccacgcaagtgcagtggcctcagtgatgtacacagtgttcacacccatgctgaacccgttcatctatagcttgaggaacaatgacataaagacagctctgaaaagaatcattggggctccagtgatactggggctgaagttgtgcccaagattgcagggctcatag

SEQ ID NO: 910 - protein, 322 aa, Canis familiaris
MKPANATRMSEFLLLGFSEEPELQPLIFGLFLSMYLITVFGNLLIILAISSESHLHTPMYFFLANLSLVDICFTSTTVPKMLWNIQTQSKVITYAGCITQMYFFIIFSGLDIYLLAVMAYDRFVAICQPLHYMAIMNTRLCGLLVLVSWTTSVLHSLLQTSMVLRLSFCTEVEIPHFFCELNQMIQLACSDTFLNNVVMYFAAMLLAGGPLTGILYSYSKIVSSICRISSAQGKYKAFSTCASHLSVVSLFFCTSLGVYLSSAATQSSHASAVASVMYTVFTPMLNPFIYSLRNNDIKTALKRIIGAPVILGLKLCPRLQGS

SEQ ID NO: 911 - DNA, 474 bp, Canis familiaris
ttgttacaaagtttaatgatgttgtggctttccttctgtacacaggtggaaatccctcactttttctgtgaactcaatgagatagtccaacttgcctgtactgacacctttcttaataacttggtgatgtattttgcagctgtcctgctgggtggaagtccttttgctgggatcattcactcttattctaagactgtttcctccatacatggaatttcatcagctcggggcaagtataaagcattttccacctgtgcgtctcacctctcagttgtctccttattttattgtacaatgcttggtgtataccttagctctgctgctacccagagctcccacgcaagtgcagtagcctcggtgatgtacaccgtggtcacacccatgctgaaccccttcatctacagcctgagaaacaaagacataaagagagttctgaaagcattctttgcgaaggaaactctatatggccaattg

SEQ ID NO: 912 - protein, 158 aa, Canis familiaris
LLQSLMMLWLSFCTQVEIPHFFCELNEIVQLACTDTFLNNLVMYFAAVLLGGSPFAGIIHSYSKTVSSIHGISSARGKYKAFSTCASHLSVVSLFYCTMLGVYLSSAATQSSHASAVASVMYTVVTPMLNPFIYSLRNKDIKRVLKAFFAKETLYGQL

SEQ ID NO: 913 - DNA, 963 bp, Canis familiaris
atggaatcaggaaatcaaacacacacttcagaatttctcctcctcgggttttcagggaagctagagattcagttcatgctctttgggatgttcctatctgtatacttggtcaccttcgctgggaatctgctcatcatcctggccatctgctcagactcccatctccacacacccatgtatttcttcctcgccaacctgtcctttgctgacatctgtttcacctccaccaccatccccaagatgctgttgaacattcagactcagagcaaaaccataacatatgaaggatgtctcagtcagatattttttttcattgtgtttggatgcctggacaatttactcctgaccgtgatggcctatgaccgctttgtggccatctgtcaccccctgcactacttggtcatcatgaacccccagctctgtggactgctagccttggggtcttggtgcgtcagtgtcatgggctcccttctcgagaccttgacccttttgaggctatctttctgcacaaacatgaaaatcccacactttttttgtgatcttcctgaagtcctgaagcttgcctgttctgacaccctcatcaataacatagtggtgtattctacaactgggcttctggctgtgattcctttccatggaatacttttctcgtactatcaaattgtttcctctgtactcagcatttcctcagctgcaggcaagtacaaagccttttccacgtgtttgtctcacctcttggtggtctccttgttctatggcacaggcctgggggtctacctcagttctgcagtcacttcatcctctagaatgagtctggtggcttcagttatgtacaccattgtcactcccatgctgaaccccttcatctatagcttgaagaacagggacatgaagggggctctgagaagtgtcctgggcagtgtggtacctgtcagcattgggaccattataggattctcctga

SEQ ID NO: 914 - protein, 320 aa, Canis familiaris
MESGNQTHTSEFLLLGFSGKLEIQFMLFGMFLSVYLVTFAGNLLIILAICSDSHLHTPMYFFLANLSFADICFTSTTIPKMLLNIQTQSKTITYEGCLSQIFFFIVFGCLDNLLLTVMAYDRFVAICHPLHYLVIMNPQLCGLLALGSWCVSVMGSLLETLTLLRLSFCTNMKIPHFFCDLPEVLKLACSDTLINNIVVYSTTGLLAVIPFHGILFSYYQIVSSVLSISSAAGKYKAFSTCLSHLLVVSLFYGTGLGVYLSSAVTSSSRMSLVASVMYTIVTPMLNPFIYSLKNRDMKGALRSVLGSVVPVSIGTIIGFS

SEQ ID NO: 915 - DNA, 930 bp, Canis familiaris
atggaatcaggaaatgatacacaaatttctgaattttttcttctgggattttcagaggaacaagaacagcagcccctcgttttcgggcttttcctctccatgtacctcatcactgtgtttggaaacctgctcctcatcctggccgtcagctctgactcccatctccacacccccatgtacttcttccttgccaatctgtcctttgtagacatttgtttcacctccaccaccatccccaagatgctgtggaacatccagactcagagcaaagtcatcacctatgcaggctgcatcactcagatgtactttttcaccctctttgctgtgttggatgtctttctcctgagtgtgatggcctatgactggtatgtggccatctgtcaccccctgaactacatggtcttcatgaaccccctgctctgtggactgctggttatggcatcctggatcatgtgtatcctgaactccttgttacaaagtctaatgatgttgcggctttccttctgtacacacctgcatatcccccactttttctgtgaactcaacgaaatggtccaacttgcctgttctgatacatttcttaataacttggtgatgtattttgcagctgtcctgctgggaggtggtgcttttgctgggatcctttactcttactctaagatcgtttcctccatacgtggaatctcatcagctcagggcaagtataaagcattttccacctgtgcatctcacctctaagttgtctgtttattttattgtacaatgcttggtgtgtaccttagctctgctgctccccagagctcccacgcaagcgcaatagcctcagtgatgtacacggtggtcacgcccatgctgaaccccttcatctacagcttgaggaacagagacataaagagggctctgaaaagaattgttagggttccagtgata

SEQ ID NO: 916 - protein, 245 aa, Canis familiaris
MESGNDTQISEFFLLGFSEEQEQQPLVFGLFLSMYLITVFGNLLLILAVSSDSHLHTPMYFFLANLSFVDICFTSTTIPKMLWNIQTQSKVITYAGCITQMYFFTLFAVLDVFLLSVMAYDWYVAICHPLNYMVFMNPLLCGLLVMASWIMCILNSLLQSLMMLRLSFCTHLHIPHFFCELNEMVQLACSDTFLNNLVMYFAAVLLGGGAFAGILYSYSKIVSSIRGISSAQGKYKAFSTCASHL

SEQ ID NO: 917 - DNA, 933 bp, Canis familiaris
atggaatcaggaaatgatacacaaatttctgaattttatcttctgggattttcagagaaaccagaactacagcccctcatatttggacttttcctctccatgtacctgatcactgtgtttggaaatctgctcatcatcctgtccatcagcacagaccccaatctgcacacgcccatgtacttcttccttgccaacctgtcctttgtagacatttgtttcacctccaccaccatccccaagatgctgtggaacatccagactcagagcaaagtcataagctatgcaggttgcattacacagatttatttcctcatactctttgctgtgttggatgtctttcttctgagtgtgatggcttatgaccggtatgtggccatctgccaccccctgcactacatggtcatcatgaaccccctgctctgtggactgctggttctggtatcctggataatatgtatcctgaattccttgctacagagtttaatgatgttgcggctttccttctgtacacacttgaatatccctcactttttctgtgaactcaatgaaatggtccaacttgcctgttctgacacctttcttaataacttggtgatgtattttgcagctctcctgctgggtgggggtccttttgctgggatcctttactcttattctaagatcgtatcctccatacgtggaatatcatcagctcagggcaagtataaagcattttccacctgtgcatctcacctctcggttgtctgtttattttattgtacgatgcttggtgtgtaccttagctctgctgctacccagagctcccacgcaagtgcagtggcctcggtgatgtacacggtggtcacacccatgctgaaccccttcatctatagtctgaggaacagagacataaaaatggctctgagaagaatcattggggttccagtgatgtaa

SEQ ID NO: 918 - protein, 310 aa, Canis familiaris
MESGNDTQISEFYLLGFSEKPELQPLIFGLFLSMYLITVFGNLLIILSISTDPNLHTPMYFFLANLSFVDICFTSTTIPKMLWNIQTQSKVISYAGCITQIYFLILFAVLDVFLLSVMAYDRYVAICHPLHYMVIMNPLLCGLLVLVSWIICILNSLLQSLMMLRLSFCTHLNIPHFFCELNEMVQLACSDTFLNNLVMYFAALLLGGGPFAGILYSYSKIVSSIRGISSAQGKYKAFSTCASHLSVVCLFYCTMLGVYLSSAATQSSHASAVASVMYTVVTPMLNPFIYSLRNRDIKMALRRIIGVPVM

SEQ ID NO: 919 - DNA, 861 bp, Canis familiaris
cagtttcttcttctgggattatcagaggaaccagaattacagcccctcctatttgggatgctcctctccatgtacctgatcactgtgcttggaaacctgctcatcatcctggtcatcagcacagatcccagcctcctcacccccgtgtacttcttcctcaccaacctctcctttgtcaacatctgtttcacctccaccactgtcctgaagatgctgcagaatatcaagactcagagcaaggtaatcacctatgtagcctgcatcacacagatgtactttatagtaatctttacagtgttggacatggatcttctggccgtgatgacttatgaccgacatgtggccatctgtcacccccccctgcactacatggtcatcatgaacccctggttctgtgtgtggctggttcttgtgccctgggtcataggtgtcttgtatttcttgttataaacctcaatggtgttgcaactgtccttctatagagaggtggaaatccctccctttttctgtgaactcagtcagatgacccaacttgccttttctgacatctttcttagtaaaatggtaacgtattttgtagctacgtttctggggttggtcccctcactgggaggtcccctcactgggataatttacttttattctaagataatctccatatgtggaatctcatcagctcagggcaagtataaagcattttccacctgtgcttctcacctctttgttgtctccttattttattctatggacctaggagtgtaccttagttctgctgctccccagagctcccactcaagtgcagtagcctcagtgatgtatgtggtggtcaaccccatgctgaaccccttcatcttcagcctg

SEQ ID NO: 920 - protein, 149 aa, Canis familiaris
QFLLLGLSEEPELQPLLFGMLLSMYLITVLGNLLIILVISTDPSLLTPVYFFLTNLSFVNICFTSTTVLKMLQNIKTQSKVITYVACITQMYFIVIFTVLDMDLLAVMTYDRHVAICHPPLHYMVIMNPWFCVWLVLVPWVIGVLYFLL

SEQ ID NO: 921 - DNA, 951 bp, Canis familiaris
atgaaatcaggaaatcaaacacatgcttcagaatttctcctcctgggattttcagagaagtcagagattcagttcatgctctttgggttgttcctgtccatatacttggtctcgttcactgggaatctgctcatcatcctggccatctgctcagactcccgtctccacacacccatgtatttcttccttgccaacttgtcctttgctgacatctgtttcacctccaccacagtccccaagatgctggtgaacatccagactcagagcaaaaccataacatatgaaggatgtctcagccagatattttttttctttgtgtttggatgcctggacaatttactcctgaccgtgatggcctatgaccgctttgtggccatctgtcaccccccgcactactcactcatcatgaacccgcagctctgtgggttgctggccctggggtcctggtgcatcagtgtaatgggctcccttttcgagaccttgacccttttgaggctacccttctgcacaaacatggaaatatcacactttttttgtgatcttcctgaagtcttgaagcttgcctgttctgacacccttatcaataacatagtggtgtattttgtgactattgtcctaggtgtttttcctctctctgggatccttttttcttattctcagattttctcctccatcttgagaatttcctcaactgcagataagtacaaagccttttccacatgtgggtctcatctctcagtggtctgcttgttctatggcacaagcctaggggactacctcagttctgcagcaactacatcctccaggacaagtctggtggcctcagtgatgtacgccattgtcacccctatgctgaaccccttcatctacagcttgaggaatggggacatgaagggggccctgggtaggttggtgcctctcagcatcaggaccattacaggactctcctga

SEQ ID NO: 922 - protein, 316 aa, Canis familiaris
MKSGNQTHASEFLLLGFSEKSEIQFMLFGLFLSIYLVSFTGNLLIILAICSDSRLHTPMYFFLANLSFADICFTSTTVPKMLVNIQTQSKTITYEGCLSQIFFFFVFGCLDNLLLTVMAYDRFVAICHPPHYSLIMNPQLCGLLALGSWCISVMGSLFETLTLLRLPFCTNMEISHFFCDLPEVLKLACSDTLINNIVVYFVTIVLGVFPLSGILFSYSQIFSSILRISSTADKYKAFSTCGSHLSVVCLFYGTSLGDYLSSAATTSSRTSLVASVMYAIVTPMLNPFIYSLRNGDMKGALGRLVPLSIRTITGLS

SEQ ID NO: 923 - DNA, 933 bp, Canis familiaris
atggaatcagacaacgatacacgaatttcagagttccttcttctgggattctcaggggaatcagaactgcagcccctcatatttgggcttttcctctccatgtacctcatcactgtgtttggaaacttgctaatcatcctggctgtcagctctgactcccacctccacacccccatgtacttcttcctcaccaacctgtcctttgtagacatctgtttcatctccactactgtccccaagatgctccagaacattcagactggaagtaaagtcataacctacccaggctgcatcacacagatatactttttcctactctttgcaggatgtgatgattttctcctgagtatgatggcctatgaccgctttgtggccatctgccatcccctgcactacacagtcatcatgaacccctggttctgtgtactgcttgttctggtggcctggatcaccagtgttctcaattccttgttacagagcttaatggtgttacagctgtccttctgtgcaggcatggaaatcccccattttttctgtgacctcaatcaggtaattgggcacgcctgttctgacagatttcttaatgaggtggtgatgtattttgcaactgtgctgctgggtgtggctcccttgcctgggatccttttctcttactctaagatagtttcctccatatgtggaatatcatcgattcagggtaagtataaagcattttccacctgtgcatctcacctctcagttgtctccttattttactgtacaggcttaggagtataccttagctctgctgtgccccaaggctcccatgcaagtgtagtggcctcggtgatgtacacagtggtcacgcccatgctgaaccccttcatctacagcctgaggaacagagatataaagagggctctgaaaagaatcattggggttcctgtgatgtaa

SEQ ID NO: 924 - protein, 310 aa, Canis familiaris
MESDNDTRISEFLLLGFSGESELQPLIFGLFLSMYLITVFGNLLIILAVSSDSHLHTPMYFFLTNLSFVDICFISTTVPKMLQNIQTGSKVITYPGCITQIYFFLLFAGCDDFLLSMMAYDRFVAICHPLHYTVIMNPWFCVLLVLVAWITSVLNSLLQSLMVLQLSFCAGMEIPHFFCDLNQVIGHACSDRFLNEVVMYFATVLLGVAPLPGILFSYSKIVSSICGISSIQGKYKAFSTCASHLSVVSLFYCTGLGVYLSSAVPQGSHASVVASVMYTVVTPMLNPFIYSLRNRDIKRALKRIIGVPVM

SEQ ID NO: 925 - DNA, 915 bp, Canis familiaris
atgggaccaggaaatgatacacaaatttcaagatttcttcttttaggattgtcaaataaaccaggacttcagctccccatatttggacttttcctcttcatgtacctcatcactgtgtttggaaacttgctcattatcctggctgttggctctgactctcacctccacactcccatgtacttctttctggccaacttgtcctttgtagacatctgtttcacctcaaccaccatcccaagacccaagatgctgataaatatacagacacagagcaaatttatatcatatacaggatgcatcagccagatctgctttttcttactctttgcaggctgggatgactttctcttggctgtgatggcctatgatcgttttgtggccatctgtcacccattgcactacatggtcatcatgaatccccgggtctgtggactgctggttctggtgtcctggatcatcagtgttctgaattccttattacagagcttaatggttttgcagctttccttctgttcagaggtggaaatccctcactttttctgtgaactccatcagatgatccaacttgcctgttctgatacctttcttaatgacacaataatatatgtttcagctgtgctgttggctggcggtccccttgctgggatcctttgctcatattccaagattatttcctccatacatagaatatcatcagctcagggcaagtataaagcattttccacctgtgtatctcatctcttggttgtttccttattttattgcactgtcctgggagtgtaccttagctctgctgttacccagagctcccatgcaagtgcagtagcctcagtaatgtacatggtcatcacgcccatgctgaaccccttcatctacagtctgaggaacaaagatataaaggaggctctgatgaga

SEQ ID NO: 926 - protein, 305 aa, Canis familiaris
MGPGNDTQISRFLLLGLSNKPGLQLPIFGLFLFMYLITVFGNLLIILAVGSDSHLHTPMYFFLANLSFVDICFTSTTIPRPKMLINIQTQSKFISYTGCISQICFFLLFAGWDDFLLAVMAYDRFVAICHPLHYMVIMNPRVCGLLVLVSWIISVLNSLLQSLMVLQLSFCSEVEIPHFFCELHQMIQLACSDTFLNDTIIYVSAVLLAGGPLAGILCSYSKIISSIHRISSAQGKYKAFSTCVSHLLVVSLFYCTVLGVYLSSAVTQSSHASAVASVMYMVITPMLNPFIYSLRNKDIKEALMR

SEQ ID NO: 927 - DNA, 930 bp, Canis familiaris
atggaactagagaatgatacacgaattccagaatttctccttctgggattttcagaggaaccaaaattgcagcccttcctctttgggctgttcctgtccatgtacctggtcaccatacttgggaacctgctcctcatcctggctgtcagctctgactctcacctccacacccccatgtacttcttccttgccaatctgtcctttgtagacatctgtttcacctgtaccaccatcccaaagatgctggtaaatatacaaacacaaagaaaagtcataacttatgagagctgcatcatacagatgtactttttcatactttttgcaggtatagacaatttcctcctgactgtgatggcctatgatcgctacatggccatctgctaccccctgcactacatggtcatcatgaaccctcagctctgttcactactactactggtatcctggatcatgagtgccttgcattctttgttacaaaccttaatggtgttgcgactgtccttctgtacacatttccaaatcccccactttttctgtgaactcaatcagatgatccaacttgcctgttctgacacctttcttaataacatgatgttgtattttgcagctatattgctgggggttgctcccctggttggagtcctttactcttatttcaagatagtttcctctatacgtgggatctcatcagctcacagcaagtataaagcattttccacctgtgcttctcacctctcggttgtctccttattttattgtacaagcctaggagtgtaccttagctccgctgctccccagagcacccacacaagttcagtggcctcagtgatgtacacagtggtcacccccatgctgaaccccttcatctacagcctcaggaacaaagacataaagggagctctaaatgtatttttcagagggaagccataa

SEQ ID NO: 928 - protein, 309 aa, Canis familiaris
MELENDTRIPEFLLLGFSEEPKLQPFLFGLFLSMYLVTILGNLLLILAVSSDSHLHTPMYFFLANLSFVDICFTCTTIPKMLVNIQTQRKVITYESCIIQMYFFILFAGIDNFLLTVMAYDRYMAICYPLHYMVIMNPQLCSLLLLVSWIMSALHSLLQTLMVLRLSFCTHFQIPHFFCELNQMIQLACSDTFLNNMMLYFAAILLGVAPLVGVLYSYFKIVSSIRGISSAHSKYKAFSTCASHLSVVSLFYCTSLGVYLSSAAPQSTHTSSVASVMYTVVTPMLNPFIYSLRNKDIKGALNVFFRGKP

SEQ ID NO: 929 - DNA, 933 bp, Canis familiaris
atggaacctggaaatgatacacaaattccagagtttcttcttctgggattatcagaggaatcagaactacagcccctcctatttgggcttttcctctccatgtacctgatcactgtgtttggaaacctgctcatcatcctggctgtcacctctgaccctcacctccacacccccatgtacttcttcctcgccaacctgtcttttgtagacatctgttccatctccaccaccgtccccaaaatgctccaaaacatccagactcagagcaaagttattacctatgcaggttgtgttactcaaatatactttttcttactctttgcagggtgggatgactttctcctggctgtgatggcctatgacaggtttgtggccatctgtcaccccctgcactacacagtcatcataaattcccagctctgtgtgctgttggttctggtgtcctggatcatcagtgtcctgcattccttattagaaagcttaatggtgttgcagctgtccttctgcagagaggtggaaatctcccactttttctgtgaaattaatcaggtggtccgacttgcctgttcaaacacctttcttaatgacatgctgatgtatttggcagctgtgctgctggctggtggtccccttgctgggatcatttactcatattttaagatagtttcctccatacttcggatctcatcagctcagggcaagtataaggcattttccacctgtacgtctcacctctcagttgtgttcttattttattgtacaatcctaggagtgtaccttagctctgctgttccccagagctcccactcaagtgcactggcctcagtgatgtacacagtggtcacacccatgctgaaccccttcatttatagtctgaggaacagagacataaaaagggctctgaaaagaatctttggggttccagtgatgtaa

SEQ ID NO: 930 - protein, 310 aa, Canis familiaris
MEPGNDTQIPEFLLLGLSEESELQPLLFGLFLSMYLITVFGNLLIILAVTSDPHLHTPMYFFLANLSFVDICSISTTVPKMLQNIQTQSKVITYAGCVTQIYFFLLFAGWDDFLLAVMAYDRFVAICHPLHYTVIINSQLCVLLVLVSWIISVLHSLLESLMVLQLSFCREVEISHFFCEINQVVRLACSNTFLNDMLMYLAAVLLAGGPLAGIIYSYFKIVSSILRISSAQGKYKAFSTCTSHLSVVFLFYCTILGVYLSSAVPQSSHSSALASVMYTVVTPMLNPFIYSLRNRDIKRALKRIFGVPVM

SEQ ID NO: 931 - DNA, 495 bp, Canis familiaris
gtcatcatgaaacccacctactgtgtactgttggttctggtggtctggatgataagtatcctgaattccttattacaaagcttaatggtgttgtgactgtccttctgtagagaggtggaaatttccaactttttctgtgatgtcaaacaagtggttcaacttgcctattctgacctttcttaatgacatggtgatgtatttaacagctgtgctgctgggtggtgtcccctcactgggatcatttatttttactctaagatagtttcctccatacttgggatctcatcatctcagggcaagtataaagcattttccacctgtgcatctcacctctccattgtgttcttattgtattgtacaatcctgtaccttagctctgctgctcccaaaagctccctttcaagtgctgtagcctcggtgatgtacacagtggtcatacccatgctgaaccccttcatctatagcctgaggaacagagatataaagagagatctg

SEQ ID NO: 932 - protein, 35 aa, Canis familiaris
HHETHLLCTVGSGGLDDKYPEFLITKLNGVVTVLL

SEQ ID NO: 933 - DNA, 948 bp, Canis familiaris
atggggcaaggcaatgatacagaaatttcagagtttcttcttctgggattgtcagaggaaccagaactgcagcccctcctatttgggctcttcctctccatgtacctgatcactatctttggaaacctgctcatcatcctggctgtcagctgtgacccccacctccacacccccatgtacttcttcctcaccaacctgtcctttgtagacatctgtttcacctccaccactgtccccaagatgcttcagaatatccagactcagagcaaagtcatcacctatgcaggttgtgtcacacagatttatttttttatactctttgctgtctcagacttctttgtcctcagtgtgatggcctatgaccggtttgtggccatctgttatcccctgcactacacagtcatcatgaactcccgactttgtggacttctggttctggtgtcttggatcatgtgtatcctgaactccttgttacagagtttaatgatgttgcggctttccttctgtacacacttccaaatcccccactttttttgtgaactcaatcagatgatccaactagcctgttctgacacctttcttaataacatggtgatgtattttgcagctgtcttactgggtgggggtccttttgctgggatcctttactcttattctaagattgtttccaccatatgtggaatatcatcagccctgggcaagtataaagcattttccacctgtgcatctcacctctcagttgtctccttattttattgtacaatcctaggtgtgtaccttagctctgctgctcctcagagctctcactcaagtgcagtggcctcggtgatgtacacagtggtcacacccatgttgaaccccttcatctatagcctgaggaacagagacataaagaaggctttaagagcattcttagtaaaggagacactacatggccaattgtcatag

SEQ ID NO: 934 - protein, 315 aa, Canis familiaris
MGQGNDTEISEFLLLGLSEEPELQPLLFGLFLSMYLITIFGNLLIILAVSCDPHLHTPMYFFLTNLSFVDICFTSTTVPKMLQNIQTQSKVITYAGCVTQIYFFILFAVSDFFVLSVMAYDRFVAICYPLHYTVIMNSRLCGLLVLVSWIMCILNSLLQSLMMLRLSFCTHFQIPHFFCELNQMIQLACSDTFLNNMVMYFAAVLLGGGPFAGILYSYSKIVSTICGISSALGKYKAFSTCASHLSVVSLFYCTILGVYLSSAAPQSSHSSAVASVMYTVVTPMLNPFIYSLRNRDIKKALRAFLVKETLHGQLS

SEQ ID NO: 935 - DNA, 930 bp, Canis familiaris
atggaactagagaatgatacacgaatttcagaatttcttcttctgggattttcggagaaaccagaattgcagcccttcctctttgggcttttcctgtccctgtacctggtcaccatatttgggaacctgctcatcatcctggtcttcagttctgactcccacctccacacgcccatgtacttctttctggccaacctgtcctttgtagacatctgtttcacctccacaaccatccctaagctgctggtgaatatacaaacacagagaaaagtcataacttacaaaagctgcatcatgcagatgtactttttcatactttttataggtttagacaactttctcctgactgtaatggcttatgaccgattcatggccatctgtcaccccctgcactacacagtcatcatgaaccctcggctctgtgcactgttggttttggtgtcctggatcataagtgccctgcactccttgttagaaagcttaatggtgttgcagctgtccttctgtacagccttggaaatcccccactttttttgtgaactcaatcagatgatccaacttgcctgttctgacacctttcttaatgatttggtgatgtattgtgcaactgtgctgctggttggtgctcccctggctggggtcctttactcttattctaagatcctttcttccatacgtggaatatcatcagctcagggaaagcataaagcattttccacctgtgcatctcacctctcagttgtctccttattttactgtacaggcctaggagtgtaccttagctctgatgctccccagagctcccactcaagtgcagcagcctccatgatgtacacggtagtcacacccatgctgaaccccttcatctacagcctcaggaacaaagacataaaggaggctctaactgtatttttcagagggaagccataa

SEQ ID NO: 936 - protein, 309 aa, Canis familiaris
MELENDTRISEFLLLGFSEKPELQPFLFGLFLSLYLVTIFGNLLIILVFSSDSHLHTPMYFFLANLSFVDICFTSTTIPKLLVNIQTQRKVITYKSCIMQMYFFILFIGLDNFLLTVMAYDRFMAICHPLHYTVIMNPRLCALLVLVSWIISALHSLLESLMVLQLSFCTALEIPHFFCELNQMIQLACSDTFLNDLVMYCATVLLVGAPLAGVLYSYSKILSSIRGISSAQGKHKAFSTCASHLSVVSLFYCTGLGVYLSSDAPQSSHSSAAASMMYTVVTPMLNPFIYSLRNKDIKEALTVFFRGKP

SEQ ID NO: 937 - DNA, 954 bp, Canis familiaris
atggaacgaggaaatgatacacaaatttcagaattccttcttctgggattattagaagaaccagaactgcagcccctcctatttgggcttttcctctccatgtacctcatcactgtctttggaaacttgctcatcatcttggctgttggttctgactctcacctccacacccctatgtacttcttccttgccaacctgtcttttgtagacatctgtttcacttccaccaccatccccaagatgcttcagaacacccagactcagagcaaagtcatcacctataagggttgcattacgcagatttattttctcatagtctttgccgtgttggatgtccttctcttgagtgtgatggcctatgaccgctatgtggccatctgttaccctctgcactacacggtcatcatgaatccccggctctgtggtctgcttgttctggtgtcctggatcatgtgtatcttgaactccttgttacaaagtttaatgatgttgcggctttccttctgtacacacttccaaatcccccactttttctgtgaactcaatcagatgatccaacttgcctgttctgacacctttcttaataacatggtgatgtattttgcagctgtcttgctggctggtggtcccttcattgggatcctttactcttactctaagatagtttcctccatacttgggatctcatcagctcagggaaagtataaagcattttccacctgtgcatctcacctctcggttgtctgtttattttattgtacgatgcttggtgtgtaccttagctctgctgctacccacagctctcactcaagtgcagtggcctcggtgatgtacacagtgatcacacccatgctgaatcccttcatctacagcctgaggaacagagacataaagagggctctgaaaacattctttgtgaaggagactccacgtggccaattgtcaaaagactga

SEQ ID NO: 938 - protein, 317 aa, Canis familiaris
MERGNDTQISEFLLLGLLEEPELQPLLFGLFLSMYLITVFGNLLIILAVGSDSHLHTPMYFFLANLSFVDICFTSTTIPKMLQNTQTQSKVITYKGCITQIYFLIVFAVLDVLLLSVMAYDRYVAICYPLHYTVIMNPRLCGLLVLVSWIMCILNSLLQSLMMLRLSFCTHFQIPHFFCELNQMIQLACSDTFLNNMVMYFAAVLLAGGPFIGILYSYSKIVSSILGISSAQGKYKAFSTCASHLSVVCLFYCTMLGVYLSSAATHSSHSSAVASVMYTVITPMLNPFIYSLRNRDIKRALKTFFVKETPRGQLSKD

SEQ ID NO: 939 - DNA, 933 bp, Canis familiaris
atgcaaccagaaaatgatacatgggtatcagaattctttcttctgggattatcagaggaaccagaacttcagtccatcatatttgggcttttcctctccatgtacctgatcacagtctttggaaacctgctcatcatcctggccatcagctctgactcccatctccacactcccatgtacttctttcttgccaacctgtcctttgctgacatctgtgtcacctccaccaccgtcccaaagatgctgctgaacgtccagactcagagccaagtcatcacctatgcaggttgcatcacacagatgcactttttcataatcttctcagggttggacatctatctcctggctgtgatggcctatgaccgttttgtggccatctgtcatcccctgcagtacatggtcatcatgaacccccggctctgtggactgttgcttttggtgtcctggattacaaatgtcttgcattccttgttacagacctcaattgtgttgcagctgtccttctgtagaaaggcagaaatctcccactttttttgtgaactcaatcagatgatccaacttgcctgttctgacagctttctctataacatggtgatgtattttgtagctgtcctgctgggtgggggccccctccctggtatcctttactcttattccaggatagtttcctccatagttgggatctcatcagctcagggcaagtataaagcattttccacctgtgcatctcacctgtcagttgtctccttatttttttgttctggtcttggagtgtacctcagctctgctgctccccagaactcccacacgagtgcagtggcctcagtgatgtacacagtggtcacacccatgctgaaccccttcatctacagcctgaggaacagagacataaagagggctctgaaaagagtcactggggttccagtgatgtaa

SEQ ID NO: 940 - protein, 310 aa, Canis familiaris
MQPENDTWVSEFFLLGLSEEPELQSIIFGLFLSMYLITVFGNLLIILAISSDSHLHTPMYFFLANLSFADICVTSTTVPKMLLNVQTQSQVITYAGCITQMHFFIIFSGLDIYLLAVMAYDRFVAICHPLQYMVIMNPRLCGLLLLVSWITNVLHSLLQTSIVLQLSFCRKAEISHFFCELNQMIQLACSDSFLYNMVMYFVAVLLGGGPLPGILYSYSRIVSSIVGISSAQGKYKAFSTCASHLSVVSLFFCSGLGVYLSSAAPQNSHTSAVASVMYTVVTPMLNPFIYSLRNRDIKRALKRVTGVPVM

SEQ ID NO: 941 - DNA, 969 bp, Canis familiaris
atggaaccagggaaccttacaggagattcagagtttcttcttttgggattttcagaggaactagaactacagccactcgtatttgggctttttctctccatgtacctgatcactgtgtttggaaacctgctcctcatcctggctgtcagctctgactcccaccttcacactcccatgtacttcttcctcaccaacctgtcctttgtggacatctgtttcacctccaccaccgtccccaagatgctatggaacatccagactcagagcaaagtcatcacttatgaaggctgtatcagccagatatacttttttatactctttgcaggattagatgtccttctactgactgtgatggcctatgacaggtttgtggccatctgtcaccctctgcactacatggtcatcatgaatccacagctgtgtgggcaattggttctgatgtcatggattataagcatcctccattccttgttagaaagcttaatggtcttgcggctgtccttctgtacaaagttggaaatccctcattttttctgtgaactcaatcagatgatccaacttgcctgttctgacacctttctcaataacatggtgatgtattttgcagctgtcttgttggctggtggtccctttgttgggattcttttctcttactctaagatagtttcctccatacatagaatctcatcagctcagggcaagtacaaagcattttccacctgtgcatctcacctctcagttgtctccttattttattgtacaatcctaggagtgtaccttagctctgctgctacccagagctcccactcaagtgcagtggcctcagtgatgtacacagtggtcacaccgctgatgaaccctttcatctacagcctgaggaacagagacataaaggaggctttgatgagattttctgggatgccagctctaaaaaggccaatcgttctggggctgaagaagtgcccatga

SEQ ID NO: 942 - protein, 322 aa, Canis familiaris
MEPGNLTGDSEFLLLGFSEELELQPLVFGLFLSMYLITVFGNLLLILAVSSDSHLHTPMYFFLTNLSFVDICFTSTTVPKMLWNIQTQSKVITYEGCISQIYFFILFAGLDVLLLTVMAYDRFVAICHPLHYMVIMNPQLCGQLVLMSWIISILHSLLESLMVLRLSFCTKLEIPHFFCELNQMIQLACSDTFLNNMVMYFAAVLLAGGPFVGILFSYSKIVSSIHRISSAQGKYKAFSTCASHLSVVSLFYCTILGVYLSSAATQSSHSSAVASVMYTVVTPLMNPFIYSLRNRDIKEALMRFSGMPALKRPIVLGLKKCP

SEQ ID NO: 943 - DNA, 306 bp, Canis familiaris
atgggaccaggaaatgatacacaaatttcacgatttcttcttctgggattaacaaacaaaccagaactacagcccctcatatttgggattttcctctccatttacctgattactgtgtttggaaacctactcatcatcttggctgtcagctctgactcccacctccacacccccatgtacttcttcctctccaacctctcctttgtagacatctgtgtcacctccaccatcgtcccaaagatgctggtgaatatacagacacggaacaaaattataacttatgcaggctgcatcagccagatcttt

SEQ ID NO: 944 - protein, 102 aa, Canis familiaris
MGPGNDTQISRFLLLGLTNKPELQPLIFGIFLSIYLITVFGNLLIILAVSSDSHLHTPMYFFLSNLSFVDICVTSTIVPKMLVNIQTRNKIITYAGCISQIF

SEQ ID NO: 945 - DNA, 651 bp, Canis familiaris
ttatttgcaggctgggatgactttctcttggctgtgatggcctatgaccgctacgtggccatctgtcaccccctgcactacacggtcatcatgaacccccagctctgtggactgcttgttctggtgtcctggatcatgagtgtcctgaattccttattacaaagcttaatgatattgaggctgtccttctgtagagaagtggaaataccccactttttctgtgaacttcatcagatgatccaacttgcctgttctgatacatttcttaatgacatggtgctgtattttgcagctgtgctgctggctggtggtccccttgctgggatcctttattcatattctaagattattttctccatacatagaatctcatcagctcagggcaaatataaagcattttctacctgtgcatctcacctctcagttgtctccttattttattgcacggtcctgggagtgtatcttagctctgctgctacccagaactaccagacaagtgcagtggcctcggtgatgtacacagtggtcacacccatgctgaaccccttcatctacagcctgaggaacagagatataaagagggctctgatgaggtttttcagaaggacagctctaaaagggacaattgtcctggtatcaaagaaatgccct

SEQ ID NO: 946 - protein, 217 aa, Canis familiaris
LFAGWDDFLLAVMAYDRYVAICHPLHYTVIMNPQLCGLLVLVSWIMSVLNSLLQSLMILRLSFCREVEIPHFFCELHQMIQLACSDTFLNDMVLYFAAVLLAGGPLAGILYSYSKIIFSIHRISSAQGKYKAFSTCASHLSVVSLFYCTVLGVYLSSAATQNYQTSAVASVMYTVVTPMLNPFIYSLRNRDIKRALMRFFRRTALKGTIVLVSKKCP

SEQ ID NO: 947 - DNA, 807 bp, Canis familiaris
atgagggaatcaaatcagtcagtgacctcagacttcaccctcatggtgctcttcagccactcagggccacatgtggttctattcttccttgtgactgtcatattcactatgggccttctgggcaatgccatcctgctcttcctgatccatacagactccaggctccacacacccatgtacttcctgctcagtcaactctccctattggatgttggctttcccttggtcaccatccccaagatggcagctgacttcctgcagggagagggctccatctcctttggagattgtgcagctcagatgttcttcctgatgctactgggtgtctctgagggtgtcctactatcccttatgtcttacgaccgctatgttgctgtgtgtcaccccctgcattatcttgtgttcatgaggcgtcaggtctgtctgctcatggtgggcacctcctggttgtcaggtgtgcttgtggcctccatccagacctccatcaccctgcacttcccctactgtgcctcacacactgtggatcacttcttctgtgagttgcctgctctgttgaagctctcttgtgcagacacctctgcttatgagctgtcgctatccatctcaggggtgctgatcctgctactgcccctgtcactcatcaccacctcttacagccatgtgttgagggctgttctccgcatgcagtctgctgaggcccgacacaaggccttcaccacctgctcctcgcacatcactgtggtggggctcttttatggggcagcctattcatgtacatggttccaggtacctaccacagcccacaac

SEQ ID NO: 948 - protein, 269 aa, Canis familiaris
MRESNQSVTSDFTLMVLFSHSGPHVVLFFLVTVIFTMGLLGNAILLFLIHTDSRLHTPMYFLLSQLSLLDVGFPLVTIPKMAADFLQGEGSISFGDCAAQMFFLMLLGVSEGVLLSLMSYDRYVAVCHPLHYLVFMRRQVCLLMVGTSWLSGVLVASIQTSITLHFPYCASHTVDHFFCELPALLKLSCADTSAYELSLSISGVLILLLPLSLITTSYSHVLRAVLRMQSAEARHKAFTTCSSHITVVGLFYGAAYSCTWFQVPTTAHN

SEQ ID NO: 949 - DNA, 960 bp, Canis familiaris
atggctgccaccttgggcctaaaccacagctctgtgtctgaattcatcctcgtgggcttctccaccttcccgccccatctcctgcctgccttcttcctgctgttcctgctcatgtacctgttcacgctgctggggaacctgctcatcatggccactgtctggagcgagcgcggcctgcacacgcccatgtacctcttcctgtgcgccctgtccatctccgagatcctctacaccttggccatcaccccgcgcctgctggctgacctgctctccacccgccgcaccatcgcctttgcagcctgtaccagccagatgttcttctctttcacgttcggcttcacccactccttcctgctcacggtcatgggctacgaccgctatgtggccatctgccaccctctgcgctacaatgtgctcatgagcccccgtggctgcacctacctggtggcctggtcctgggctggtggctcgatcatagggctggtggtggccacagctgttttccacctcactttctgtggacccaatgagatccaccattttttatgtcatgtgccccctctcttgaagctggcctgtggaactgatgtaccaatagtggccctgggcgtggggctggtgtgcatcaccgccctgctgggctgctttctcctcatcctcctctcctatgcctttatcgtggctgccatcttgaggatcccctctgctgagggaaggcacaaagccttctccacctgtgcgtcccaccttatagtggtcattgtgcactatggctttgcctctgttatctacctcaagcccaagggtctgcactcccaggaaggcaacaccttgatggccatcacctatacggtcctcacgcccttcctcagccccatcatcttcagtctcaggaataaggagctgaagatcgccatgaagaagaccttcctcagtaaactctatccctccagcatctaa

SEQ ID NO: 950 - protein, 319 aa, Canis familiaris
MAATLGLNHSSVSEFILVGFSTFPPHLLPAFFLLFLLMYLFTLLGNLLIMATVWSERGLHTPMYLFLCALSISEILYTLAITPRLLADLLSTRRTIAFAACTSQMFFSFTFGFTHSFLLTVMGYDRYVAICHPLRYNVLMSPRGCTYLVAWSWAGGSIIGLVVATAVFHLTFCGPNEIHHFLCHVPPLLKLACGTDVPIVALGVGLVCITALLGCFLLILLSYAFIVAAILRIPSAEGRHKAFSTCASHLIVVIVHYGFASVIYLKPKGLHSQEGNTLMAITYTVLTPFLSPIIFSLRNKELKIAMKKTFLSKLYPSSI

SEQ ID NO: 951 - DNA, 969 bp, Canis familiaris
atggaaaaaggaaatgatacacaaatttcagcatttcttcttctgggattatcagaggaaccagaaatacagccccttctatttgggcttttcctctccatgtacctcatcactgtgtttggaaacctgctcctcatcctggccatcagctctgactctcatctccacactcctatgtacttcttccttgccaacctgtcctttgtagacatctgtttcacctccaccactgtccccaagatgcttcagaacatccagactcacagcaaagtcattacctatgcaggctgcatcacacagatgtactttttcatactctttgttgtattggatgcctttctcctgactgtgatggcctatgaccggcatgtggccatctgtcaaccactgcactacatggtcattatgaaaacccagctgtgtgcactgctggttctgctgtcctggattgtgagtgtcttgtattccttgttacaaacctccatggtgttgcggctgtccttctgtacagagatggcaatccctcactttttctgtgaactcaatcaagtgatccaacttgcctgttctgatacctttctcagtaacatggtgatgtattttgcagctatgtttatggctactggtaccttctttgggatcctttactcttactctaagattgcttcctccatacatagaatatcatcagccctgggcaaatccaaagcattttccacctgtgcatctcacctctcagttgtctccttatttttttgtacaagtttaggagtgtaccttagctctgctgctccccagagctctcactcaactgcagtggcctctgtgatgtacacagttgtcacacccatgctgaaccccttcatctatagtctgaggaacaaagacataaaaaaggctctgatgagattctctgggatggcaggtctaaaagtgacaacaatcctggagttgaagaaccacccatga

SEQ ID NO: 952 - protein, 322 aa, Canis familiaris
MEKGNDTQISAFLLLGLSEEPEIQPLLFGLFLSMYLITVFGNLLLILAISSDSHLHTPMYFFLANLSFVDICFTSTTVPKMLQNIQTHSKVITYAGCITQMYFFILFVVLDAFLLTVMAYDRHVAICQPLHYMVIMKTQLCALLVLLSWIVSVLYSLLQTSMVLRLSFCTEMAIPHFFCELNQVIQLACSDTFLSNMVMYFAAMFMATGTFFGILYSYSKIASSIHRISSALGKSKAFSTCASHLSVVSLFFCTSLGVYLSSAAPQSSHSTAVASVMYTVVTPMLNPFIYSLRNKDIKKALMRFSGMAGLKVTTILELKNHP

SEQ ID NO: 953 - DNA, 933 bp, Canis familiaris
atggaacaaggaaattatacacaaatttcagcatttcttcttctgggattatcagaggaaccagacctgcagcccctcctatttgggcttttcctctccatgtacctcatcactgtgtttggaaacctgttcatcatcctggctgtcagttctgactctcacctccacacacccatgtacttcttcttggccaacctgtcctttgtagacatctgtttcacctctaccactgtccccaagatgcttcagaacatccagactcagagcaaagtcatcacctatgaaggttgcatcactcagatatactttttcctactcttggctggattggacaactttctcctggctgtgatggcttatgacaggtttctggccatctgtcaccccttgcactatacagtcatcatgaaaccccagctatgtgtactactggttctggtggcctggatgatgagtgccttgaattccttattacaaagcctaatggtgttgtggctgtccttctgtagagaggtgaaagtctcccactttttctgtgagatcaatcaggtggtccaacttgcttgttctgacaactttcttaatgacaaggtgatgcattttgcagctggattgttgggtggttcttccttagctgggatcctttactcttactctaagatagtctcttcgatacatagaatctcatctgctcagggaaagtataaagcattttccacttgtgcatctcacctttctgttgtctccttattttattgtacaattctgggagtgtaccttagctctgctgctccccagagctcccactcaagtgcagtggcctcggtgatgtacacagtggtcacacctatgctaaaccccttcatctacagcctgaggaacagagacataaagagggctctgaaaagaatcattggggctccagtgatataa

SEQ ID NO: 954 - protein, 310 aa, Canis familiaris
MEQGNYTQISAFLLLGLSEEPDLQPLLFGLFLSMYLITVFGNLFIILAVSSDSHLHTPMYFFLANLSFVDICFTSTTVPKMLQNIQTQSKVITYEGCITQIYFFLLLAGLDNFLLAVMAYDRFLAICHPLHYTVIMKPQLCVLLVLVAWMMSALNSLLQSLMVLWLSFCREVKVSHFFCEINQVVQLACSDNFLNDKVMHFAAGLLGGSSLAGILYSYSKIVSSIHRISSAQGKYKAFSTCASHLSVVSLFYCTILGVYLSSAAPQSSHSSAVASVMYTVVTPMLNPFIYSLRNRDIKRALKRIIGAPVI

SEQ ID NO: 955 - DNA, 933 bp, Canis familiaris
atggaactgagcaatgatacaaaaatttcagagtttcttcttcttggattttcagaggaaccagaactgcagcccctcatatttgggtttttcctttccatgtacctgatcactgtgtttggaaacttgctcatcatcctggctgtcagctcagactcccaccttcacacccccatgtacttcttcctaaccaatctgtcctttgtagacatctgtttcacctccaccaccatgcccaagatgctccagaacatgaggacccagagcaaggtcattagctttgcaggttgcatcagtcagatgtattttttcctactctgtgccttgttggatgattttgtcttgtctgtaatggcttatgaccgcttcgtggccatctgtcaccccttgcgctacacagtcatcatgaacccccagatctgtggactgctggttctggtgtcctggatcatcagtgttctcaattccatgacacagagcttaatggtgttgcagctgtccttctgtacagacatggaaatccaccattttttctgtgaactcaatcagatagttgggaatgcctgttctgacacctttcttaatgacatggtgatgtatcttgcaattgtgctgctggggggtgtccccctggctggtataatgtactcttactctaagatagtttccaccatatgtagaatatcgtcagctcagggcaagtataaagcattttccacttgtgcatctcacctctcagttgtctccttattttatggtacaagcctaggagtgtaccttagctctgctgctcccctaaactctcactctagtgcagtagcctctgtgatgtacacagtggtcacacccatgctgaaccctttcatctacagtctgaggaacagagacataaagagggctctgaaaagaatcattgggattccagtgatgtaa

SEQ ID NO: 956 - protein, 310 aa, Canis familiaris
MELSNDTKISEFLLLGFSEEPELQPLIFGFFLSMYLITVFGNLLIILAVSSDSHLHTPMYFFLTNLSFVDICFTSTTMPKMLQNMRTQSKVISFAGCISQMYFFLLCALLDDFVLSVMAYDRFVAICHPLRYTVIMNPQICGLLVLVSWIISVLNSMTQSLMVLQLSFCTDMEIHHFFCELNQIVGNACSDTFLNDMVMYLAIVLLGGVPLAGIMYSYSKIVSTICRISSAQGKYKAFSTCASHLSVVSLFYGTSLGVYLSSAAPLNSHSSAVASVMYTVVTPMLNPFIYSLRNRDIKRALKRIIGIPVM

SEQ ID NO: 957 - DNA, 933 bp, Canis familiaris
atggaagcagacaatgatacaggaatttcagagtttcttcttctgggattatcagaggagccagaactacagcccctcctatttgggatgttcctctccatgtacctgatcactgtctttggaaacctgctcatcattctggctgtcaggtcagacccccacctccacacccccatgtacttcttcctcgccaacctgtcctttgtagacatctgtttcacctccaccactgtcccgaagatgctgctgaacatacagactcagggcaaagtcatcacctatgcaggctgcatcacacagatatacttttttctactttttgcagactgggatgactttctcctggctgtgatggcctatgaccgttttttggctatctgtcaccccttgcgctatacagtcatcatggatccgtggctctgtggactgctggttctggtgtcgtggatcatgagtaccctgaattccttattacagagcttaatggtgttgcggctgtccttctgtgcagaggtggaaatcccccattttttctgtgaactcaatcaggtggttgggcatgcctgttctgacacctttttaaataacatagtgatatattttgcagccgtgctgctgggtggggctcccctgactggtatcatatactcttactctaagatagtttcctcaatacttaggatctcagcagctcagggcaaatataaagcattttccacctgtgcatctcacctctcagttgtctccttattttatggtacaagcctaggagtgtacctgagttctgctgctaatcacagctcttacaaaagtgcagtagcctcggtgatgtacacggtggtcacacccatgctgaatcccttcatctacagcctaaggaacagagacataaagagggctctgagaagaattactggggttccagtgatataa

SEQ ID NO: 958 - protein, 310 aa, Canis familiaris
MEADNDTGISEFLLLGLSEEPELQPLLFGMFLSMYLITVFGNLLIILAVRSDPHLHTPMYFFLANLSFVDICFTSTTVPKMLLNIQTQGKVITYAGCITQIYFFLLFADWDDFLLAVMAYDRFLAICHPLRYTVIMDPWLCGLLVLVSWIMSTLNSLLQSLMVLRLSFCAEVEIPHFFCELNQVVGHACSDTFLNNIVIYFAAVLLGGAPLTGIIYSYSKIVSSILRISAAQGKYKAFSTCASHLSVVSLFYGTSLGVYLSSAANHSSYKSAVASVMYTVVTPMLNPFIYSLRNRDIKRALRRITGVPVI

SEQ ID NO: 959 - DNA, 933 bp, Canis familiaris
atgaaaccaggaaatgatacgcaaatttcagaatttcttcttctgggattatcagaggaaccagaactgcagcccctcatctttggctttttcctctccatgtacctcatcactgtgtttggaaacctgctcatcatcctggctgtcagctctgattcccacctccacaccccaatgtacttcttcctggccaacctttcctttgtggacatctgtttcacctccaccaccgtccccaagatgctatggaacatccagactcagagcaaagttatcacctatgcaggctgcatcacacagatttactttctcatagtctttgctgtgttggatgtctttctcctgagcatgatggcctatgaccggtatgtggccatctgtcaccccctgcaatacacagtcatcatgaaccctcgggtctgtggacttctggttctggtgtcctggatcatctgtgtcctgcagtccttgttacaaacctcgatggtgttgcggctgtccttctgtgcagtggtcgaaatcccccacttttcctgtgaacttaatcagatgatccaagttgcctgttctgacaccttccttaataacttgatggtgtattttgcagctgtcctgctggttggtggttcccttgctgggatactttactcttactctaggatagtttcctccatacttgggatctcatcagctcggggcaagtataaagcattctccacctgtgcatctcacctctcagttgtctgcttatttttttgtacaagcctaggagtataccttagctctgctgtttcccagagctcccactcaactgcagtggcctcagtgatgtacacagtggtcacacctatgctaaaccccttcatctacagcctgaggaacaaagacataaagagggctctgaaaagaaccgttgggattccagtgatgtaa

SEQ ID NO: 960 - protein, 310 aa, Canis familiaris
MKPGNDTQISEFLLLGLSEEPELQPLIFGFFLSMYLITVFGNLLIILAVSSDSHLHTPMYFFLANLSFVDICFTSTTVPKMLWNIQTQSKVITYAGCITQIYFLIVFAVLDVFLLSMMAYDRYVAICHPLQYTVIMNPRVCGLLVLVSWIICVLQSLLQTSMVLRLSFCAVVEIPHFSCELNQMIQVACSDTFLNNLMVYFAAVLLVGGSLAGILYSYSRIVSSILGISSARGKYKAFSTCASHLSVVCLFFCTSLGVYLSSAVSQSSHSTAVASVMYTVVTPMLNPFIYSLRNKDIKRALKRTVGIPVM

SEQ ID NO: 961 - DNA, 969 bp, Canis familiaris
atgcaaccaaacaatgatacatggatatcagaattctttcttctgggattttcagagggaccagactggcagccactcgtatttgggcttttcctctccatgtacctgatcactgtgtttggaaacctgctcatcatcctggccatcagctctgactcccacctccacacccccatgtacttcttcctcgccaacctgtcctttgtagacatctgtttcacctctaccactgtccccaagatgctgctgaacatccagactcagagcaaagtcatcacctatgcaggctgcatcacacagatgtactttttcataatcttttcagggttggacatctatctcctggctgtgatggcttatgaccgttttgtggccatctgccatcccctgcactacatggtcatcatgaacccccggctctgtggactgctagttctggtgtcctggatcataagtgtcttgcactcctttttacagacctcaatggtgttgcagctgtccttctgtacagaggtggaaatcccgcactttttctgtgaactcaatcacatgatccaacttgcctgttctgacatatttcttaataacatgatgatatactttgcagctgtgctcctggggggtgttcccctggctggggtcctttactcctactctaagatagtttcctgcatacatagaatatcatcagctcagggtaagcataaagcattttccacctgtgcatctcacctctcagttgtctctttattttattgtacagccctaggagtgtaccttagctctgctgctccccagagctcctacacaagtgcagtggcctcagtgatgtacacagtggtcacacctatgctgaaccccttcatctacagcctgaggaacagaaacataaagagggctctgatgaaattctctgggctggaagctatcaaaaggccagttgtcctattgctgaagaatttcccataa

SEQ ID NO: 962 - protein, 322 aa, Canis familiaris
MQPNNDTWISEFFLLGFSEGPDWQPLVFGLFLSMYLITVFGNLLIILAISSDSHLHTPMYFFLANLSFVDICFTSTTVPKMLLNIQTQSKVITYAGCITQMYFFIIFSGLDIYLLAVMAYDRFVAICHPLHYMVIMNPRLCGLLVLVSWIISVLHSFLQTSMVLQLSFCTEVEIPHFFCELNHMIQLACSDIFLNNMMIYFAAVLLGGVPLAGVLYSYSKIVSCIHRISSAQGKHKAFSTCASHLSVVSLFYCTALGVYLSSAAPQSSYTSAVASVMYTVVTPMLNPFIYSLRNRNIKRALMKFSGLEAIKRPVVLLLKNFP

SEQ ID NO: 963 - DNA, 846 bp, Canis familiaris
ccctcctttttggatttttttctgtccatgtacctggtaactttcattgggaacctactcatcatcctggcaattatcactgactcctgcctccacacgcccatgtacctcttcctctctaatctctcttttgcagacatctgtttcacctccaccacagtccccaaaatgctgttgaatatccagacacagagaaaattcattacctatgcagaatatatcacccaggtatatttcttcatgctttttggagatctggataacttccttctgacggtgatggcttatgaccggtttgtggccatctgtcaccccctacaatatatggtcatgatgaacccttgggtctgtgggctcctgcttatggcatgctgaattatgactgccctgcagtcattgtcacagagcttaatggttttacggctctctttttgtaatgatttggaaatccctcactttttctgtgaacttaatcaattggtccaacttgcttgttctgacacctttctcaatgatatagttatgtattttgctactggacttgttggtgttgttcctcttactggaattctcttctcttactctaagattgtaacctccattttgagaatttcatcagctggaggcaagtatagagcattttccacatgtgggtctcacctttcagttgtctccttgttctactgcacaggccttggggtctacctcagttctactggttcacaaaactccaggacaagtgccatagcctcagtgatgtatacagtggtcacacccatgctgaacccctttatttacagtcttaaaaacaaagacataaagcaatcacttaaaaaactcttcagc

SEQ ID NO: 964 - protein, 156 aa, Canis familiaris
MTALQSLSQSLMVLRLSFCNDLEIPHFFCELNQLVQLACSDTFLNDIVMYFATGLVGVVPLTGILFSYSKIVTSILRISSAGGKYRAFSTCGSHLSVVSLFYCTGLGVYLSSTGSQNSRTSAIASVMYTVVTPMLNPFIYSLKNKDIKQSLKKLFS

SEQ ID NO: 965 - DNA, 933 bp, Canis familiaris
atgcaaccaaacaatgatacatggatatcagaattctttcttctgggactttcagaggaaccagaactgcagcccctcatatttgggcttttcttctccatgtacctgatcactgtctttggaaacctgctcatcatcttggctgtcagctctgactcccatctccacacccccatgtacttcttcctcaccaatctgtcctttatagacatctgcgttacctccaccaccatcccaaatatagtgataaatatccagactcagagcaaagttatcacctatgcaggctgcatcacacagatgtactttttcataatcttctcaggattggacatctatctcctgtctgtgatggcctatgaccgttttgtggccatctgtcaccctctgcagtacatggtaatcatgaacccccagctctgtggactgttgcttctggtctcctgcatcgcaaatatcttacactccttgttacagacctcaattatgttacagttgtccttttgtagagaggtagaaatctcccactttttctgtgaactcaatcacatgattcaacttgcatgttctgacacctttctcaataacatggtaatgtattctgcagctctcctgatgggtgggggtccttttgctgggattctatactcttattctaagatagtttcctccatacttgggatctcatcagctcagggcaagtataaagcattttccacctgtgcatcccacctctcagttgtctccttatttttttgttctggtcttggagtgtacctcagctccgctgctccccagagctcccactcgagtgcagttgcctcagtgatgtatacagtggtcacacccatgctaaaccccttcatctacagcctgaggaacagagacataaagagagctctgaaaagattctttggggttccagtgatgtaa

SEQ ID NO: 966 - protein, 310 aa, Canis familiaris
MQPNNDTWISEFFLLGLSEEPELQPLIFGLFFSMYLITVFGNLLIILAVSSDSHLHTPMYFFLTNLSFIDICVTSTTIPNIVINIQTQSKVITYAGCITQMYFFIIFSGLDIYLLSVMAYDRFVAICHPLQYMVIMNPQLCGLLLLVSCIANILHSLLQTSIMLQLSFCREVEISHFFCELNHMIQLACSDTFLNNMVMYSAALLMGGGPFAGILYSYSKIVSSILGISSAQGKYKAFSTCASHLSVVSLFFCSGLGVYLSSAAPQSSHSSAVASVMYTVVTPMLNPFIYSLRNRDIKRALKRFFGVPVM

SEQ ID NO: 967 - DNA, 849 bp, Canis familiaris
ctgctcctgtccttgtacctggtcaccttcagtggaaacctgatcatcatcctggctgttgtaatggactcccacctccacactcccatgtacttctttcttaccaacctgtcctttgtagatgtctgtttcacctccactaccatccccaagatgcttcagaacacccagactcagagcaaagtcatcatctatgcaggctgcattgcacagatttattttcccatagtctttgccatgttgaatgtctttttcctgagtgtgatggtctttggcagatggccatctgctgcccccagcactacatggtcatcatgaatcatctgctctgtggactgctggttctggtgttctggatcatgtgtatcctgaactccttgttacagtttaatgatattgtggctttctttctgtacatacttccaaatcccccactttttctgtgaacgcaatcagaaatttgcttgttctgacccccttcttaataacttggtgatatattttgcaactgtcttgttagctgctggtccctttattgggatcctttactcttattctaagatcgtttcctccatatgtggaatattgtcagctcagggcaagtataaagcattttccacctgtgcatctcacctctcagttgtctccttatttaattgtatgatacttgtgtaccttagctctgctgctacccacagctcacagtcaagtgcaatggccttggtgatgtatacggtggtcacactcatgccaaaccccttcatttatagcctgaagaacagagatataaagagggttctgaaagcattctttgtgagggaaactccacctggccaactgttaaaagac

SEQ ID NO: 968 - protein, 153 aa, Canis familiaris
MILWLSFCTYFQIPHFFCERNQKFACSDPLLNNLVIYFATVLLAAGPFIGILYSYSKIVSSICGILSAQGKYKAFSTCASHLSVVSLFNCMILVYLSSAATHSSQSSAMALVMYTVVTLMPNPFIYSLKNRDIKRVLKAFFVRETPPGQLLKD

SEQ ID NO: 969 - DNA, 921 bp, Canis familiaris
atggaacaaagaaatcaaagccgcgtttcacaatttatcctcctgggactttcagaggtgggagaactacagccactgctcttttggctgttcttttccatgtacctgatcaccttcagtgggaacctgctcatcatcctggccattgtcatggactcccacctccacacacccatgtacttcttcctctccaacctgtcctttgtagacatctgtttcacctctaccaccgtccccaagatgctgctgaacatccagacacagagcaaagtgatcacctatgaaggctgcctcagccagatgtattttttcatgctgtttggaggattagacaactttctcttgacagtgatggcctatgaccggtttgtggccatctgtcaccccctgtactacatggtcatcatgaatcccaagttctgtggcatcctgcttctggcatgctggttattgagtgttatggactctctattacatgacttaatggttttccaattgtctttctgtacacagttagaaatctctcactttttctgtgaacttaaacagatgatccaacttgcttgctctgataccttcctcaataacctggcaatttatcttgcaagtggacttctgggggttcttccactcattggtatccttttctcttattctagaattgtagcttccattttgaaaatttcatcttctgggggccagtataaagcattttccacatgtgggtctcacctttcagtcgtttccttattctatggtacaggatttggagtgtatcttagttctactgctttgcgaaactccagagcaagtgccatagcctcggtgatgtacacagtggtcactcccatgctgaacccctttatctatggtctgaggaacagagacttaaagcaggccttaagaaaactctttagctga

SEQ ID NO: 970 - protein, 306 aa, Canis familiaris
MEQRNQSRVSQFILLGLSEVGELQPLLFWLFFSMYLITFSGNLLIILAIVMDSHLHTPMYFFLSNLSFVDICFTSTTVPKMLLNIQTQSKVITYEGCLSQMYFFMLFGGLDNFLLTVMAYDRFVAICHPLYYMVIMNPKFCGILLLACWLLSVMDSLLHDLMVFQLSFCTQLEISHFFCELKQMIQLACSDTFLNNLAIYLASGLLGVLPLIGILFSYSRIVASILKISSSGGQYKAFSTCGSHLSVVSLFYGTGFGVYLSSTALRNSRASAIASVMYTVVTPMLNPFIYGLRNRDLKQALRKLFS

SEQ ID NO: 971 - DNA, 855 bp, Canis familiaris
atggaacaaggaaaccaaacccaaatttctgaatttatcctcctgggcctctcagaagaggcaaagctgcagcctctcttcttttggctgtttctgtacatgtacctggtcaccttcagtgggaacctgctcatcatcctggccatctgctcagactcctgcctccacaccctcatgtacttcttcctccacaatatgtcctttgctgacatctgtttcacttctaccaccatctcctagatgccgctgaacatctagtctcagagcaaagtgatcacctactaaggctgcctcagccagatgtattttttcatgctgtttggagtattagacaatttcctcttgacagtgatggcctataataggtttgtggccatctgtcacccccccctgcactacatggtcatcatgaaccccgagttttgtggcgtcctgcttctggcatgctggttattgagtgtcatggactctctattacatgtcttaattattttatgactttctttttgcacagagttgaaaacccttcactttttctgtgaacctaagcaggtgatccaacttgtttgttctgacagcttcctcattgaccccatgatatatcttgcaagtggacttctgggggttcttctactcattggtaccctcttctcttactctagaatcataacttacattatgaaaatttcaggcaactataaagcattctccacgtgtgggtctcactgctcagttgtttccttattgtatggtacaggctttggggtatatcttagttctgctgctttgcaaaactccagggcaaatgccatagccttggtgatgtacacgtggtcacacccatgctgaacccct

SEQ ID NO: 972 - protein, 82 aa, Canis familiaris
WNKETKPKFLNLSSWASQKRQSCSLSSFGCFCTCTWSPSVGTCSSSWPSAQTPASTPSCTSSSTICPLLTSVSLLPPSPRCR

SEQ ID NO: 973 - DNA, 546 bp, Canis familiaris
cactcctttctgttcataaccatgggcaatgatcagcatgtggccatctgccacccagagcaccacaacatgctcatgagtccctatggctgtgccattgtgtgttctgatgttgggctggtggctcaatcatggggaagatggtgaccgtgacaggttttcacctcaccttctgtgggtctaatgtgatccaccatttttccagcctcatgcttggcctgtgggaaggagacatcatctgtcaccttgagaggggtcctggtgtgtgtcacagctctgatgggctgtttatgcctcattgcctccatggtattgaggatctcgtctgctgagggcaggcataagaccatctccacttgtgtctcccacctcactgtggtcattgtgcaatatgtttttgcctccactatctagtttcagcccgtggacccatttctatggacagtaacactctgatggccaccacctacagtcttcaccccctttctcagcccaatcattttcagccttcagtataaggagctcaaaaatgtcataaagaaatca

SEQ ID NO: 974 - protein, 48 aa, Canis familiaris
HSFLFITMGNDQHVAICHPEHHNMLMSPYGCAIVCSDVGLVAQSWGRW

SEQ ID NO: 975 - DNA, 927 bp, Canis familiaris
atcgtgtctgaattcatcctcgtgggcttctccaccttcccacagcatctcctgcctgccttctttctgttctacttgctgatgtacctgttcatgctgttggggaacctgctcatcatggctactatctggagtgagcacagcctgcacacacccatgtacctcttcctgtgtgccctgtccacctctgagattctgttcactgttgccgtcaccccccgcatgctggttgacatgctttccagccaccgttccatcacctttgtggcctgtgccacccagatgttcttttccttcacatttggcttcacccattccttcttgctcatgatcatgggttatgaccgctatgtggccatctgccaccccctgcgatactacatgctcatgagcatccgcacctgtgcccgtttggtgtcctggacctgggctggtggctcagtcatggggatgatggtgactctgatagtttttcacctcaccttctgtggatctaatgtgattcaccattttgtctgccatgtgttttccctcttaaagttggcttgcgggaatgagaattcgtctgtcaccttgggtgtgatcctcatgtgtgtctcagctctgatgggctgtttattcctcatcatcctctcctacatcttcattgtggccgccatattgaggatcccctctgttgagggaaggcacaagaccttttcaacctgtgtgtctcacctcactattgttattgtgcactacagttttgcctccattatctacctcaagcccaagggctctcattctatggacagtaacactctgatggccaccacctatacagtctttaccccgtttctcagcccaatcatttttagcctcaggaataaggagctcaaaaatgccataaagaaaagcttccagagaaaattcagtcccctaaactcc

SEQ ID NO: 976 - protein, 309 aa, Canis familiaris
IVSEFILVGFSTFPQHLLPAFFLFYLLMYLFMLLGNLLIMATIWSEHSLHTPMYLFLCALSTSEILFTVAVTPRMLVDMLSSHRSITFVACATQMFFSFTFGFTHSFLLMIMGYDRYVAICHPLRYYMLMSIRTCARLVSWTWAGGSVMGMMVTLIVFHLTFCGSNVIHHFVCHVFSLLKLACGNENSSVTLGVILMCVSALMGCLFLIILSYIFIVAAILRIPSVEGRHKTFSTCVSHLTIVIVHYSFASIIYLKPKGSHSMDSNTLMATTYTVFTPFLSPIIFSLRNKELKNAIKKSFQRKFSPLNS

SEQ ID NO: 977 - DNA, 930 bp, Canis familiaris
atggtgtctgaattcatcctcgtgggcttctccaccttcccacagcatctcttgcctgcctttttcctgttctacttgctgatgtacctgttcacgctgctggggaacctgctcatcatggctactgtctggagtgagcgcagcctgcacacacccatgtacctcttcctgtgtgccctgtccacctctgagattctcttcactgttgccatcaccccccgcatgctggttgacatgctctccagccaccgctccatcacttttatggactgtgccacccagatgttcttctccttcacgtttggcttcacccattccttcttgctcatgatcatgggctatgaccgctatgtagccatctgccaccccctgcgctacaacatgctcatgagcacccgcacctgtgcccgtttggtgtcctggacctgggctggtggctcagtcatggggatgatggtgaccctgatagtttttcatctcaccttctgtaagtctaatgtgattcatcattttttctgccatgtgctttccctcctaaagttgtcttgtgggaatgagaattcctctgtcaccttgagagtgattctggtgtgtgtctcagctctgatgggctgcttattcctcatcgtcctctcctacatcttcattgtggccgccatattgaggatcccctctgctgagggcagacacaagacattctctacctgtgtgtcccacctcactattgttattgtgcactatggttttgcctccattatctacctcaagcccaagggcccccattctatggacagtaacaccctgatggccaccacatatacagtcttcaccccgtttctcagcccaatcattttcagcctcaggaataaggagctcaagaatgccataaagaaaagcttccagagaaaattcagtcccctaagttcctga

SEQ ID NO: 978 - protein, 309 aa, Canis familiaris
MVSEFILVGFSTFPQHLLPAFFLFYLLMYLFTLLGNLLIMATVWSERSLHTPMYLFLCALSTSEILFTVAITPRMLVDMLSSHRSITFMDCATQMFFSFTFGFTHSFLLMIMGYDRYVAICHPLRYNMLMSTRTCARLVSWTWAGGSVMGMMVTLIVFHLTFCKSNVIHHFFCHVLSLLKLSCGNENSSVTLRVILVCVSALMGCLFLIVLSYIFIVAAILRIPSAEGRHKTFSTCVSHLTIVIVHYGFASIIYLKPKGPHSMDSNTLMATTYTVFTPFLSPIIFSLRNKELKNAIKKSFQRKFSPLSS

SEQ ID NO: 979 - DNA, 1032 bp, Canis familiaris
atgacactgtctcatccttgtccttcatggaataaatcatgtatcttcatatcctttctggcctcagcagatgcagcttccgtggctggtcagaactatagcatggtgtctgaattcatcctcgtgggcttctccaccttcccacagcatctcctgcctgtcttctttctgttctacttgctgatgtacctgttcacgctgctggggaacctgctcatcatggctactgtctggagtgagcgcagcctgcacacgcccatgtacctcttcctgtgtgccctgtccatctctgagattctgttcactgttaccctcaccccccgcatgctggttgacatgctctccagccaccgctccatcacctttgtggcctgtgccacccagatgttcttctccttcacgtttggcttcacccattccttcttgctcatgatcatgggctatgaccgctacgtggccatctgccaccccctgcgctacaacgtgctcatgagcccccgtggatgtgcccgcctcgtgtcctggacctgggctggtggctcagtcatggggatgatggtgaccctgatagtttttcatctcaccttctgtgggtctaacgtgatccaccattttgcttgccatgtgctttccctcctacagttggcctgtgggaaggagacattctctgtcaccttgggagtgattctggtgtgtgtctcagctctgatgggctgcttatccctcatcgtcctctcttatgtcttcatcgtggctgccatcttgaggatcccgtctgctgagggcagacacaagaccttctccacctgtgtgtcccacctcactgtggtcattgtgcactatggttttgcctccattatctacctcaagcccaagggcccccattctacggacagtaacactctaatggccaccacctatatagtcttcaccccgtttctcagcccaatcattttcagcctcaggaataaggagctcaagaatgccataaagaaaagcttccagagaaaattcagtccccttagctcctga

SEQ ID NO: 980 - protein, 343 aa, Canis familiaris
MTLSHPCPSWNKSCIFISFLASADAASVAGQNYSMVSEFILVGFSTFPQHLLPVFFLFYLLMYLFTLLGNLLIMATVWSERSLHTPMYLFLCALSISEILFTVTLTPRMLVDMLSSHRSITFVACATQMFFSFTFGFTHSFLLMIMGYDRYVAICHPLRYNVLMSPRGCARLVSWTWAGGSVMGMMVTLIVFHLTFCGSNVIHHFACHVLSLLQLACGKETFSVTLGVILVCVSALMGCLSLIVLSYVFIVAAILRIPSAEGRHKTFSTCVSHLTVVIVHYGFASIIYLKPKGPHSTDSNTLMATTYIVFTPFLSPIIFSLRNKELKNAIKKSFQRKFSPLSS

SEQ ID NO: 981 - DNA, 936 bp, Canis familiaris
atggaagcaggaaaccataccagagtgtcagaatttttcctccagggcctctcagatgatccagaactgcagcccttcctctttggcttatttctcttcatgtacctggtcaccatgctgggaaatctgctcatcatcctggctatcctctctgactcccatctccacactcccatgtacttcttcctctccaatctatcttctgttgatatctgtttcatctctaccactgtcccaaagatgctggtaaacatccagacacacagcaaagacatctcctacactggatgcctcattcaggtgtatttttttatgatttttgccgggatggatggtttcctcctgaccgtgatggcctatgaccggtttgtggctatctgccaccccctgcgctacacaatcatcatgaacccacggctgtgtggcttgctggttctgatgtgttggtttatcattttctgggtctccctgattcatgtcctactggtgaggcagctgaccttctgtccaggcacagaaattccacatttcttctgtgaagtggttcagatcctcaaggtggcctgctctgataccctcatcaataacatcttcttgtatgtgtccactgtcatattgggtgtgtttcctctcagtgggatcttcttttcatactctctgattgtctcctctttaatgaaaatgtcctctgcagcaggaaaatataaagcattttccacttgtgggtctcacctctctgtggtctccttgtactatgggacaagcctggggctctatttcagtccttctgcaactcattcttcccagagctccattggctcagtgatgtatactgtggtcacccccatgctgaatcccttcatctatagcctgagaaataaggatgtgaagggcgccctggcaagactccacagtcgaggaaccctttgtatgtga

SEQ ID NO: 982 - protein, 311 aa, Canis familiaris
MEAGNHTRVSEFFLQGLSDDPELQPFLFGLFLFMYLVTMLGNLLIILAILSDSHLHTPMYFFLSNLSSVDICFISTTVPKMLVNIQTHSKDISYTGCLIQVYFFMIFAGMDGFLLTVMAYDRFVAICHPLRYTIIMNPRLCGLLVLMCWFIIFWVSLIHVLLVRQLTFCPGTEIPHFFCEVVQILKVACSDTLINNIFLYVSTVILGVFPLSGIFFSYSLIVSSLMKMSSAAGKYKAFSTCGSHLSVVSLYYGTSLGLYFSPSATHSSQSSIGSVMYTVVTPMLNPFIYSLRNKDVKGALARLHSRGTLCM

SEQ ID NO: 983 - DNA, 939 bp, Canis familiaris
atggaagcagggaaccaaacagctgttttaaaattcatccttctggggctttcagaagatgtggacttgcagcccctcctctttgggctgttcctctacatgtacctagtctgtgttatagggaacctgctcatcatcctggccatcagcttgcactccaacctccacacccctatgtacttcttcctctccaatctgtccctcagtgacatcggtttcacctccaccaccgtcctcacgatgttagtgaacatccagacacggaccaacaccatcacgtatgaaggctgccttacccagatgtattttttcatgatttttgctggactagataatttgctactgacagtgatggcctatgatcggtttgtggccatctgtcaccccctgcactacacagtcattatgaaccctcgcctttgtgtcctcctgcttctgctttcttggttaatctgccttacgtattctttgttgcaaagtttgatggttttgagggtgtccttctgcaaagagacagaaatcccccacttcttctgtgaacttactcagatcctcaagcttgcctgctctgacaccctcatcaatgacatcctgctgtattttgtaagtggcctgctgggtgttattcccctgactgggatccttttttcttattcgaaaattatctcctgcataatgggcatttcctcggttgcagggaagtataaagccttttccacctgtgggtctcacctcttggttgtctccttgttctatggtgtaggccttggggtctacctcacttctggaacaacccatccctccagaaagggctcaatagcctcggtgatgtatacggtggtcacccccatgctgaatcccttcatctatagtctgaggaacagggacatgaaaggggctctgaggagacttttcaggagtggagcttactctccgtga

SEQ ID NO: 984 - protein, 312 aa, Canis familiaris
MEAGNQTAVLKFILLGLSEDVDLQPLLFGLFLYMYLVCVIGNLLIILAISLHSNLHTPMYFFLSNLSLSDIGFTSTTVLTMLVNIQTRTNTITYEGCLTQMYFFMIFAGLDNLLLTVMAYDRFVAICHPLHYTVIMNPRLCVLLLLLSWLICLTYSLLQSLMVLRVSFCKETEIPHFFCELTQILKLACSDTLINDILLYFVSGLLGVIPLTGILFSYSKIISCIMGISSVAGKYKAFSTCGSHLLVVSLFYGVGLGVYLTSGTTHPSRKGSIASVMYTVVTPMLNPFIYSLRNRDMKGALRRLFRSGAYSP

SEQ ID NO: 985 - DNA, 939 bp, Canis familiaris
atggaatcagaaaacagaacagaagtatcagaattcatcctcctgggtctctcagaggatccagaactgctgccccttctctttgggctgttcctgaccatgtacctggtcaccatgctggggaacctgctcatcatcctggcggttggatctgactcccacctccacacccccatgtacttcttcctcgccaacctgtcttttgttgacatctctttcacctccactatagtcccaaagatgctggtgaacatccaaacgcagaacaaagccatcacctatgccggctgcctcactcagctatattttttcatggtgtttatatgcatggacaatttactgctaactgtgatggcttacgaccgctatgtggccatctgccatcctctatattacgtggtcatcatgaaccctcgcctctgtagcctgctgattcttgtctctctgtttattagcattatgagcgccctgctccatagtctgatggtgttgcaactgtccttctgcacagacttgaaaatcccccacttcttctgtgagcttgctcagatcctcaaacttgcctgttctgatactcttatcaataacatcctggtgtatttaatgaccagcttgttgggtgttggccctctctcaggaataattttctcttacactcgtattgtctcctccatcctgagagtcccatcaactaatggaaaggtcaaagctttttccacctgtgggtctcacctgtctgttgttttcttattctatgggacatgtgttggagtgtaccttagttctgcagcttccctctcccccagaaggagagcagcggcctcagtgatgtacacggtggtcactcccatgatgaatcccttcatctacagcctcaggaatagagacatgaagggagccttgcgaaaactcacctctggaacgtcttccttttcatga

SEQ ID NO: 986 - protein, 312 aa, Canis familiaris
MESENRTEVSEFILLGLSEDPELLPLLFGLFLTMYLVTMLGNLLIILAVGSDSHLHTPMYFFLANLSFVDISFTSTIVPKMLVNIQTQNKAITYAGCLTQLYFFMVFICMDNLLLTVMAYDRYVAICHPLYYVVIMNPRLCSLLILVSLFISIMSALLHSLMVLQLSFCTDLKIPHFFCELAQILKLACSDTLINNILVYLMTSLLGVGPLSGIIFSYTRIVSSILRVPSTNGKVKAFSTCGSHLSVVFLFYGTCVGVYLSSAASLSPRRRAAASVMYTVVTPMMNPFIYSLRNRDMKGALRKLTSGTSSFS

SEQ ID NO: 987 - DNA, 939 bp, Canis familiaris
atgacatcaggaaacctctcagatcctacagaattcctcctcctgggactgtcagaggatccagaactgcagccccttctatttttcctgttcctgtctatgtacctggtgtcagtgcttgggaacctgctcatcatcctggccattctgtatgacttccacctccacactcccatgtacttcttcctctccaatttgtcttttgttgacatctgtttcaccaccacaacaatcccaaagatgcttgtaaacatccggacacacagcaaatccatcacttacacaggctgcctcacacaaatctgctttgtcctgacttttgctggattagaaaatggaatactggtaatgatggcctttgatcgatttgtggccatctgtcacccattgaggtacaatgtcatcatgaatcccaaactctgtaggctgctggttctactgtccttccttattagtgttttggatgcccttctccacactttgatggcgttgcggctgtccttctgcacagacctggaaattccccactttttctgtgaattagctcatattctcaagcttgcctgttccgatatcctcatcaataatattcttgtgtatttagtgaccagcttgttgggtgttattcctctctctgggataattatctcttacactcaaattgtttcctctgtcctgaaaatcccatcagctggtggaaagtataaggcattttccatctgtgggtcacacttaatagttgtttctttgttctatgggacaggttttagggtgtaccttagttccgcagctacacactcctccaggaagagcgcaatagtatcagtgatgtacactgtggtcacccccatgatgaatccctttatctatagtctgagaaacaaggatatgatgggggctttgaggaaattgatttctagaatatcatatttccattaa

SEQ ID NO: 988 - protein, 312 aa, Canis familiaris
MTSGNLSDPTEFLLLGLSEDPELQPLLFFLFLSMYLVSVLGNLLIILAILYDFHLHTPMYFFLSNLSFVDICFTTTTIPKMLVNIRTHSKSITYTGCLTQICFVLTFAGLENGILVMMAFDRFVAICHPLRYNVIMNPKLCRLLVLLSFLISVLDALLHTLMALRLSFCTDLEIPHFFCELAHILKLACSDILINNILVYLVTSLLGVIPLSGIIISYTQIVSSVLKIPSAGGKYKAFSICGSHLIVVSLFYGTGFRVYLSSAATHSSRKSAIVSVMYTVVTPMMNPFIYSLRNKDMMGALRKLISRISYFH

SEQ ID NO: 989 - DNA, 939 bp, Canis familiaris
atggaacctagaaatgaaacagtcattatagaatttcttctcatggaagtgacagataatccagaactgcagtccctcatcttcatcctgttcctattcatgtacctggtcactgtcctgggaaacctgctcatcatcctggctgtcatctctgactcccatcttcatatccccatgtacttctttctttttattctgtcatttactgacatctgtttaagtacaaccacaatcccaaagatactggtgaatatccatacacagaaccagagcatcacttatgcaggctgcctcacacagatctgctttgtcatggtttttgcaagtttggatagttgtattctttcagtaatggcctatgatcgctatgtggccatctgtcatccactgaggtacacagtcatcatgaactcccacctctgtggcctcttgattcttctctccctgtttattagcattgtggatgccttgatacacaatctgatggtgttgcatctgtccttctgcacagaactcgaaatccctctcttcttctgtgaagttattcaggttatcaagatcgcatgttctgacaccctcatcaataacatcctgatatattttgcaaccagcatatttggtggtattcctctgtgtggaatcattttctcttacactcaggtagtgtcttcagttttgagaatgtcatcagcaggtacaaagtataaagctttttctacctgtgggtctcacctgtcagttgtgtctttgttctatgggacagcttttggggtgtacattagttctgctctcactagctcttccagaaacactgcagtggtttcaatgatgtacactgttgtccctcaaatgatgaaccccttcatctacagcctgaggaacagggacatgaagggagccttgaggaaactcataagtagaatgccttctcttctgtga

SEQ ID NO: 990 - protein, 312 aa, Canis familiaris
MEPRNETVIIEFLLMEVTDNPELQSLIFILFLFMYLVTVLGNLLIILAVISDSHLHIPMYFFLFILSFTDICLSTTTIPKILVNIHTQNQSITYAGCLTQICFVMVFASLDSCILSVMAYDRYVAICHPLRYTVIMNSHLCGLLILLSLFISIVDALIHNLMVLHLSFCTELEIPLFFCEVIQVIKIACSDTLINNILIYFATSIFGGIPLCGIIFSYTQVVSSVLRMSSAGTKYKAFSTCGSHLSVVSLFYGTAFGVYISSALTSSSRNTAVVSMMYTVVPQMMNPFIYSLRNRDMKGALRKLISRMPSLL

SEQ ID NO: 991 - DNA, 939 bp, Canis familiaris
atggaacccagaaatgatacacatgtttcagatttccttctcatgagagtgacagagaatccagaactgcagttccccctattcattctgttcgtgtccatgtacctggtcaccatcctgggaaacctgctcatcatcctggctgtcatctatgactcccatctccacacccccatgtacttctttctctccaatctgtctattaatgacatctgtttaagcacaaccaccatcccaaagatgctggtgaacatccaaacacagaatcaaagcatcacttacacaggctgcctcgcacagatctgctttgtcctgatttttgcaagtttagaaagtagtcttcttgcagtaatggcttatgaccgctatgtggccatctgtcatccactgaggtacacagtcatcatgaactcccacctctgtggcctcttgattctactgcctctgtttattatcattgtggatgccctgatgcacagtctgatggtgttgcatctgtccttctgcacagaacttgaaatccctctcttcttctgtgaagttgttcaggttatcaagattgcatgttctgacaccctcatcaataacatcctgatatattttgcaaccagcgtatttggtggtattccgctgtgtggaatcattttctcctacactaagatagtgtcttctgttttgagaatgccatcagcaggtacgaagtataaagctttttctacctgtgggtctcacctgtcagttgtgtctttgttctatgggaccggtttgggggtgtacattagttctgctctcactagttcttccagaaacactgcagtggtttcaatgatgtacactgttgtccctcaaatgatgaaccccttcatctacagcctgaggaacagggacatgaagggagccttgaggaaactcataagtagaatgccttctcttctgtga

SEQ ID NO: 992 - protein, 312 aa, Canis familiaris
MEPRNDTHVSDFLLMRVTENPELQFPLFILFVSMYLVTILGNLLIILAVIYDSHLHTPMYFFLSNLSINDICLSTTTIPKMLVNIQTQNQSITYTGCLAQICFVLIFASLESSLLAVMAYDRYVAICHPLRYTVIMNSHLCGLLILLPLFIIIVDALMHSLMVLHLSFCTELEIPLFFCEVVQVIKIACSDTLINNILIYFATSVFGGIPLCGIIFSYTKIVSSVLRMPSAGTKYKAFSTCGSHLSVVSLFYGTGLGVYISSALTSSSRNTAVVSMMYTVVPQMMNPFIYSLRNRDMKGALRKLISRMPSLL

SEQ ID NO: 993 - DNA, 954 bp, Canis familiaris
atgggactcagaaacaacacaggggtttcagaattccttctaatggaagtgacagaggatccagaactgaagcccctcctctttgttctgttcctgtccatatacctggtcaccatcctgggaaacctgctcatcatcctggctgtcatctgtgactcccacctccacacccccatgtacttcttcctgtccaacttgtcctttactgacatctgtttaagcacaaccaccatcccaaagatgctggtgaacatccaagcagaggatcagagcatcacttacacaggctgcctcacacagatctactttatcctggtttttgctagtttggaaagttttcttctttcagtaatggcctatgaccgctatgtggccatctgtcatccactgaggtacacggtcatcatgaactcccacctttgtggcctcttaattctactctctttgtgcattaacattgtggatgccctgatgcacagtctgatggtgttgcaactgtccttctgcacagaccttgaaatccctctcttcttctgtgaagttgttcaggtcatcaagattgcatgttctgacaccctcatcaataacatcctgatatattttgcaactagcgtatttggtggtatccctgtgtgtggaatcattttctcctatactcagatagtgtcttctgttttgagaatgccatcaacaggtggaaagtataaagttttttccacctgtgggtctcacctctctgttgtgtccttgttctatggaaatggtttgggggtgtacattagttctgctcttactagctcttccagaaacactgcggtggtttcagtgatgtacactattgtcccccaaatgatgaaccccttcatctacagcctgaggaacagggacatgaaaggagccttgaggaaactcatgagtaagataccattgttttttcaggaacgtgctgtttaa

SEQ ID NO: 994 - protein, 317 aa, Canis familiaris
MGLRNNTGVSEFLLMEVTEDPELKPLLFVLFLSIYLVTILGNLLIILAVICDSHLHTPMYFFLSNLSFTDICLSTTTIPKMLVNIQAEDQSITYTGCLTQIYFILVFASLESFLLSVMAYDRYVAICHPLRYTVIMNSHLCGLLILLSLCINIVDALMHSLMVLQLSFCTDLEIPLFFCEVVQVIKIACSDTLINNILIYFATSVFGGIPVCGIIFSYTQIVSSVLRMPSTGGKYKVFSTCGSHLSVVSLFYGNGLGVYISSALTSSSRNTAVVSVMYTIVPQMMNPFIYSLRNRDMKGALRKLMSKIPLFFQERAV

SEQ ID NO: 995 - DNA, 939 bp, Canis familiaris
atgggactcaggaacaacacaggggtttcagaattccttctaatggaagtgacagaggatccaaaactgaagcccctcctctttgttctgttcctgtccatatacctggtcaccatcctgggaaacctgctcatcatcctggctgtcatctgtgactcccacctccacacccccatgtacttcttcctgtccaacttgtcctttactgacatctgtttaagcacaaccaccatcccaaagatgctggtgaacatccaagcagaggatcagagcatcacttacacaggctgcctcacacagatctactttatcctggcttttggtggtttggaaagttttcttctttcagtaatggcctatgaccgctatgtggccatctgtcatccactgaggtacacggtcatcatgaactcccacttctgtggcctcttaattctactctctttatgcattaacattggggatgctctgatgcacagtctgatggtgttgcaactgtccttctgcacagaccttgaaatccctctcttcttctgtgaagttgttcaggtcatcaagctcgcatgttctgacaccctcatcaataacatcctgatatattttgcaactagcgtatttggtggtatccctgtgtgtggaatcattttctcctacactcagatagtgtcttctgttttgagaataccatcaacaggtggaaagtataaagccttttccacctgtgggtctcacctctctgttgtgtccttgttctatgggactggtttgggggtgtacattagttctgctcttactagctcttccagaaacactgcagtggtttcagtgatgtacactgttgtccctcaaatgatgaaccccttcatctacagcctgaggaacagggacatgaaaggagccttgaggaaactcataagtagaatgccttctcttctgtga

SEQ ID NO: 996 - protein, 312 aa, Canis familiaris
MGLRNNTGVSEFLLMEVTEDPKLKPLLFVLFLSIYLVTILGNLLIILAVICDSHLHTPMYFFLSNLSFTDICLSTTTIPKMLVNIQAEDQSITYTGCLTQIYFILAFGGLESFLLSVMAYDRYVAICHPLRYTVIMNSHFCGLLILLSLCINIGDALMHSLMVLQLSFCTDLEIPLFFCEVVQVIKLACSDTLINNILIYFATSVFGGIPVCGIIFSYTQIVSSVLRIPSTGGKYKAFSTCGSHLSVVSLFYGTGLGVYISSALTSSSRNTAVVSVMYTVVPQMMNPFIYSLRNRDMKGALRKLISRMPSLL

SEQ ID NO: 997 - DNA, 939 bp, Canis familiaris
atgggacccaaaaaccaaacagtattttcagaattctttctcttgggactgacagaggatccagaactgcagtccctactcttcagcctgttcctgtccatatacctggccaccatcctgggaaacgggctcatcatcctggctgtcatctgtgactcccacctccacactcccatgtacttcttcctctccaacctgtcctttactgacatctgtttaagtacaaccaccatcccaaagatgctggtgaacatccaagcacagagtcacagcatcagttacacaggctgcctcacccaggtctgctttgtcttgacttttgttggtttagaaaattttctccttgcagcaatggcctatgaccgctatgtggccatctgccatcccctgaggtacactgttatcatgaacccccaactctatggcttgctgatggtactctcactgctcattagcattgtcaatgccctgctccacagtctgatggtgctacagttatccttctgtaaggacgtggacatcccccacttcttctgtgagcttggtcagattgtcaagcttgcctgctctgatactctcatcaatgatattctggcatattttgcagctggcttatttgggggtgttcctctctccggaattattttctcttatactcaaattttctcctctgttttgagaatgccatcagcgggcaggaaatataaagctttctccacctgtggctctcacttgtccgttgtgtccttcttctatgggacagcttttggagtatacattagttctgcacttagtgactcttccaggaagactgccatggcttcagtgatgtacatcgtgattcctcaaatgatgaacccctttatctacagtctgagaaatagtgacatgcagggtgccttgaagaaacttttcagtaggataccttcctttctgtga

SEQ ID NO: 998 - protein, 312 aa, Canis familiaris
MGPKNQTVFSEFFLLGLTEDPELQSLLFSLFLSIYLATILGNGLIILAVICDSHLHTPMYFFLSNLSFTDICLSTTTIPKMLVNIQAQSHSISYTGCLTQVCFVLTFVGLENFLLAAMAYDRYVAICHPLRYTVIMNPQLYGLLMVLSLLISIVNALLHSLMVLQLSFCKDVDIPHFFCELGQIVKLACSDTLINDILAYFAAGLFGGVPLSGIIFSYTQIFSSVLRMPSAGRKYKAFSTCGSHLSVVSFFYGTAFGVYISSALSDSSRKTAMASVMYIVIPQMMNPFIYSLRNSDMQGALKKLFSRIPSFL

SEQ ID NO: 999 - DNA, 957 bp, Canis familiaris
atggaaccagaaaaccaaacaggtgtagcagaattcttccttctgggtctctcagaagatccagaatggcagccccttctctttggactgttcctgaccatatacctggtcactgtgctaggaaacctgctcatcatcctggctatcagctctgactcccaccttcaaacacccatgtacttcttcctctcccacctggcgttcactgacatctgtttcagcaccaccaccatccccaagatgctggtgaacatccaaagacagagcaaatccatcagttacacaggctgcctcacccaggtctgctttgtcctgttttttgcaggcttagaaaactttctccttgcagcaatggcctatgaccgctatgtggccatctgccatccactgaggtacacagtcatcatgaacccccacctctgtggcctgctgattctactcaccctgatcatcagcattgcagatgccctactccacagtctgatggtgttgcgactctccttctgcacagatctggaaattccccattttttctgtgaacttgctcaggtcatcaagctcgcctgttctgataccctcatcaataatatcctgatgtatttagtgaccagtgtattgggtggtgttcctctccttgggattattttctcttacattcaaattgtctcttctactctgagaatgtcatcagctggggggaaatataaagccttttccacctgtggggctcatctctcagttgtttctttgttctatgggacagcttttggggtgtacattagttctgcagtttctcattcttccaaggatactgcaagagcctcagtgatgtacaccgtggtccctccaatgttgaaccccttcatctacagcctgaggaacaaggacatgaagggagccttgaagaaactcatcttgtttgctactgtgtcatctgccttggtcttgggcttctag

SEQ ID NO: 1000 - protein, 318 aa, Canis familiaris
MEPENQTGVAEFFLLGLSEDPEWQPLLFGLFLTIYLVTVLGNLLIILAISSDSHLQTPMYFFLSHLAFTDICFSTTTIPKMLVNIQRQSKSISYTGCLTQVCFVLFFAGLENFLLAAMAYDRYVAICHPLRYTVIMNPHLCGLLILLTLIISIADALLHSLMVLRLSFCTDLEIPHFFCELAQVIKLACSDTLINNILMYLVTSVLGGVPLLGIIFSYIQIVSSTLRMSSAGGKYKAFSTCGAHLSVVSLFYGTAFGVYISSAVSHSSKDTARASVMYTVVPPMLNPFIYSLRNKDMKGALKKLILFATVSSALVLGF

SEQ ID NO: 1001 - DNA, 939 bp, Canis familiaris
atggaacccagaaatcacacagatgtttcagaatttcttcttctgggattgacagatgatccagaactgcagcgtttcctattctgcctgtttctgtccatgtacctggtcactatcctgggaaatctgctcatcatcttggtcatcaattctgactctcacctccacacccccatgtacttcttcctctccaatctgtcttttactgacatctgtttaagcacaaccaccatcccaaagatgctggtgaacatccaagcacaggatcagagcatcacttacacaggctgccttacccaggttggatttgtcctggcttttggtggttttgaaatttttctccttgcagcaatggcttatgaccgctatgtggccatttgtcaccccttgagatacactgttatcatgaacccccaactctgtgttctgctgattctgctctcactgttctttagctttgtggttgccctgctccacagtctaatggtgctacgactctccttctgcaaggacttggaaattcctcatttcttctgtgaacttgctcaggtcatcaagctcgcctgttctgacaccctcgtcaataacatactgatttattttgtggctagcctatttggtggtattcctctctctgggatcattttctcttatactcaaatcgtttcctctgttttgagaatgccatcagcagggggaaagctcaaagctttttccacctgtgggtctcacctgtcagttgtgtccttgttctatgggacagttgttggagtgtacattagttctgtagttagtgactcttccaagaagactgcagtggcttcagtgatgtatgttgtggttcctcaaatgatgaacccctttatctatagcctacggaatagggacatgaaaggagccttgagaaagctcatcagtgggatgccttctttgctgtga

SEQ ID NO: 1002 - protein, 312 aa, Canis familiaris
MEPRNHTDVSEFLLLGLTDDPELQRFLFCLFLSMYLVTILGNLLIILVINSDSHLHTPMYFFLSNLSFTDICLSTTTIPKMLVNIQAQDQSITYTGCLTQVGFVLAFGGFEIFLLAAMAYDRYVAICHPLRYTVIMNPQLCVLLILLSLFFSFVVALLHSLMVLRLSFCKDLEIPHFFCELAQVIKLACSDTLVNNILIYFVASLFGGIPLSGIIFSYTQIVSSVLRMPSAGGKLKAFSTCGSHLSVVSLFYGTVVGVYISSVVSDSSKKTAVASVMYVVVPQMMNPFIYSLRNRDMKGALRKLISGMPSLL

SEQ ID NO: 1003 - DNA, 942 bp, Canis familiaris
atggaatcaaggaatcaatccagcgcatccgaatttatcctcctaggactttcagaaaatccagagcaggagactcttctttttgctttgttcccctgcatgtatgtggtcatggctatgggaaacctttcaatcatcctggccatcagctcagactcccaccttcatactcccatgtacttcttcctggccaatctctccttggttgattttggtctggctaccaacacagtccccaagatgctggtgaacatccaaatgaaaagcaagtcaatctcctatccctgctgcctgacccagatgtactttttccatttctttggcattgttgatagtgtcttaattgctgtgatggcttatgaccggtttgtggctatatgtcaccccttacactacaccaccatcatgagcccacacctctgtggcctgctggccggtagcccatgggtgttttcctattttatttccctcactcatatcctcttgatggtgcgcttggttttctgtgggaacaacaagattcctcactacttctgtgacctcactcctcttctcaggctttcttgcactgatacatctgtgaacaagatctttgtgctcattgtggctgggatggtgatagccacaccattcatctgcatcctggcctcctatgctcgcatcattgtggccatcatgaaggtcccttctgcagggggcaggaagaaagccttttccacctgcagctcccatctgtctgtggttgctctcctttatgggaccaccattggggtctatttgtgtccttcctctgtgcgcacagctgtgaaggagaaagcctctgctgtgatgtacactgcggtcacccccatgctgaacccctttatctatagcctgaggaacagagatcttaagggggccctgaggaagctttttagtaaaaagataatttcatcttcctga

SEQ ID NO: 1004 - protein, 313 aa, Canis familiaris
MESRNQSSASEFILLGLSENPEQETLLFALFPCMYVVMAMGNLSIILAISSDSHLHTPMYFFLANLSLVDFGLATNTVPKMLVNIQMKSKSISYPCCLTQMYFFHFFGIVDSVLIAVMAYDRFVAICHPLHYTTIMSPHLCGLLAGSPWVFSYFISLTHILLMVRLVFCGNNKIPHYFCDLTPLLRLSCTDTSVNKIFVLIVAGMVIATPFICILASYARIIVAIMKVPSAGGRKKAFSTCSSHLSVVALLYGTTIGVYLCPSSVRTAVKEKASAVMYTAVTPMLNPFIYSLRNRDLKGALRKLFSKKIISSS

SEQ ID NO: 1005 - DNA, 942 bp, Canis familiaris
atggaaccaaggaaccaaactagtgcatccgaattcatcctcctggggctttcagaaaatccagagcaggagaccctcctctttgctctgtttctctgcatgtatgtggtcacagtagtggggaatctgctcatcatcctggccatcagctcagactcctacctccacactcccatgtacttcttcctggccaatctctccttggttgatttctgtctggccaccgatacagtccccaagatgctagtgaacatccaaatcaggagcaagtcaatctcctacgcctgttgcctgacccagatgtactttttccatttctttggcattatggacagtgtcttaattgctgtgatggcttatgaccggtttgtggctatatgtcatcccttacactatactaccatcatgagcccacgcctctgtggcctgctggctggtggtccatgggtattttcctgcttcatttccctcactcatatcctcttgatggcccgtctggttttctgtgggagcaatgagttgccccactacttctgtgacctcactcctcttctcaggctttcttgcactgatacatctgtgaacaagatctttgtgctcattgtggctgggatggtgatagccacaccattcatctgcatcctggcctcctatgctcgcatcattgtggccatcatgaaggtcccttctgcaggcggcaggaagaaagccttttccacctgcagctcccatctgtctgtggttgctctcttctatgggaccaccattggggtctatttgtgtccttcctctgtgcgcacagctgtgaaggagaaagcctctgctgtgatgtacactgcggtcacccccatgctgaacccctttatctatagcctgaggaacagagatcttaagggggccctgaggaagcttgtcaacagaaaaatcacttcatcttcctga

SEQ ID NO: 1006 - protein, 313 aa, Canis familiaris
MEPRNQTSASEFILLGLSENPEQETLLFALFLCMYVVTVVGNLLIILAISSDSYLHTPMYFFLANLSLVDFCLATDTVPKMLVNIQIRSKSISYACCLTQMYFFHFFGIMDSVLIAVMAYDRFVAICHPLHYTTIMSPRLCGLLAGGPWVFSCFISLTHILLMARLVFCGSNELPHYFCDLTPLLRLSCTDTSVNKIFVLIVAGMVIATPFICILASYARIIVAIMKVPSAGGRKKAFSTCSSHLSVVALFYGTTIGVYLCPSSVRTAVKEKASAVMYTAVTPMLNPFIYSLRNRDLKGALRKLVNRKITSSS

SEQ ID NO: 1007 - DNA, 855 bp, Canis familiaris
cttctagatgattcagaactgcagtccctccaccttgggctgttcctatccatgtacctggtcaccatgctcgggaacctgctaatcatcctggctgtcagctctgactgccatctgtacacccccatatacttctacaatctgtccttgattgacatctgtttcatatccaccactgtcccgaagatgatgtcggacatccaaactcacagaatcatctcctgtgtgggctcagatgtctatttttattctctttggatgtttggacaatctagagactgcaaaggcctatgaccagtttgtagccacctgtcaccccttgcactacctggtgatcatgaatctccacctctgtgtcgggctggttttggtgtcttttttttccatcagtattttggactcctagctgcacagtttgatgtcacagcttaccttcttcatagatgcagaaatacctcatctctttcatggcccttctcagcaactcgaccttgcctccttggaaatccctgccagttttattttattggtgccatttttggtggtgttctactctcaagaatccttttctcttacgttcaaattatttcctccatcctgagagtcacatccataggtgggaagtacgaacctcttcctacttgtggctcttgcctgtcagttgtttgcttgtttttgcctgtcagttgtttgcttgtttttggaacaggtcttggagtgtacctcaggttggctatcccatattctgccaagaaaggtgaggtgatctcggcagtgtataccgtggtcacccacatgcttaatcccttcctttatagtctgaggaacaaagcaaccaagagagccatgcagagg

SEQ ID NO: 1008 - protein, 97 aa, Canis familiaris
LLDDSELQSLHLGLFLSMYLVTMLGNLLIILAVSSDCHLYTPIYFYNLSLIDICFISTTVPKMMSDIQTHRIISCVGSDVYFYSLWMFGQSRDCKGL

SEQ ID NO: 1009 - DNA, 993 bp, Canis familiaris
atgctcatttacttgtttcacttttccaaccctcttttcttttttaaaaggtgtccaagctacatagaaccacaaaatctaacaagtgtatcagagttcttcctcatgggcctctcagatgatccagaactgcagcccctcctctttgggctgttcctgtccatgtacctggtcactgtgcttgggaatctgctcatcatcttggccgtcagctctgactcccacctccacatccccatgtacttcctcctctccaacctgtccttggctgacattggtttcacctccaccacagtccccaagatgatcatggacatccaaactcagagcagagtcatctcctatgtgggttgcctgactcaaatgtctttttttatgctttttggatgtttggatagtctcctcctggctgtgatggcgtatgaccggtttgtggccatctgtcaccccctgcactacttgatcatcatgaacccccgcctctgtggcttgttggttttggcgtcatttttaatcagcctgttggtctcccagatgcacaattcaattgtgttacaacttacttacttcaaggatgtggaaatttctcatttcttctgtgatccttctcaactcctcaaccttgcctgttctgacacttttatcaataacatagtcatgtattttgttggtgccatctctggctttcttcctatttcagggatctttttctcttactataaaattgtttcctccattctgagagtcccatccacaggtgggagatacaaagccttctccacctgtggctcccacctgtcagttgtttgcttattttatggaacaggccttggggtgtaccttagttcagctgtctcactttctcccaggaaggatgcagtggcctcagtggtgtatactgtggtcacccccatgctgaaccctttcatctacagcctgaggaacagggacatcaaaagggccatgtggaggctcttcagtaaaacaatctaa

SEQ ID NO: 1010 - protein, 330 aa, Canis familiaris
MLIYLFHFSNPLFFFKRCPSYIEPQNLTSVSEFFLMGLSDDPELQPLLFGLFLSMYLVTVLGNLLIILAVSSDSHLHIPMYFLLSNLSLADIGFTSTTVPKMIMDIQTQSRVISYVGCLTQMSFFMLFGCLDSLLLAVMAYDRFVAICHPLHYLIIMNPRLCGLLVLASFLISLLVSQMHNSIVLQLTYFKDVEISHFFCDPSQLLNLACSDTFINNIVMYFVGAISGFLPISGIFFSYYKIVSSILRVPSTGGRYKAFSTCGSHLSVVCLFYGTGLGVYLSSAVSLSPRKDAVASVVYTVVTPMLNPFIYSLRNRDIKRAMWRLFSKTI

SEQ ID NO: 1011 - DNA, 990 bp, Canis familiaris
atgctcatttacttgtttcacttttccaacccttttttcttttttgaaaggtgtctaggctacaaagaacaaaacctaacaagtgtctcagaattcttcctcaccagattctcagatgatctagagctgcagcctctcttctttgggctgttcctgtccatgtacctgctcaccgtgcttgggaatctgctcatcatcctgactgtcagctctgactctcacctccacacccccatgtacttcttcctctccaacctgtccttggctgacatcggtttcacctccaccacagtccccaagatgatcatggacatccaaactcagagcagagtcatctcctatgtgggttgcctgactcaaatgtcttttttgatcctttttggatgtatggatggtatgcttctgactgtaatggcatatgacaggtttgtggccatctgtcaccctctacactactcaatcatcatgaacccccgcctctgtggcttgttggttttggtgtcttttttggttagccttttggactcccagctgcacagtttgattgtgttacaacttacctgcttcaaggatgtggaaatttctaattttttctgcgatccttctcaactcctcaaccttgcctgttctgacactttcaccaataacatagtcatgtattttgttggtgccatctctggctttcttcctatttcagggatctttttctcttactataaaattgtttcctccattctgagagtcccatccacaggtgggagatacaaagccttctctacctgtggctcccacctgtcagttgtttgcttattttatggaactgctattggagtgtaccttggatcagcattgctgccttcccccaggaaggatatagtggcctcggtgatgtacactgtggtcactcccatgctgaatcccttcatttacagcctgagaaacagggacattaagagtgccctatggaggttcctcagaagaacagcctaa

SEQ ID NO: 1012 - protein, 329 aa, Canis familiaris
MLIYLFHFSNPFFFFERCLGYKEQNLTSVSEFFLTRFSDDLELQPLFFGLFLSMYLLTVLGNLLIILTVSSDSHLHTPMYFFLSNLSLADIGFTSTTVPKMIMDIQTQSRVISYVGCLTQMSFLILFGCMDGMLLTVMAYDRFVAICHPLHYSIIMNPRLCGLLVLVSFLVSLLDSQLHSLIVLQLTCFKDVEISNFFCDPSQLLNLACSDTFTNNIVMYFVGAISGFLPISGIFFSYYKIVSSILRVPSTGGRYKAFSTCGSHLSVVCLFYGTAIGVYLGSALLPSPRKDIVASVMYTVVTPMLNPFIYSLRNRDIKSALWRFLRRTA

SEQ ID NO: 1013 - DNA, 1038 bp, Canis familiaris
atgaattgcttgaattcaaaatatagacacactgacagatcccagtatacttgtttcctttatttaaactctcatttatttctcaaaagctgtctctgctacacagaaccccagaatctaacagatgtcttggaattcttcctcctggggttctcagaagatccagaactgcagcctgtaatctttagcctgttcctgtccatgtatctggtcaccatgctggggaatctactgatcctccttgctgtcagctctgactcctgccttcacacccccatgtacttcttcctttccatcctgtccctggctgacatcggtttcatttctaccacagtcccaaaggtgattttggacattgaaactcacaacagagtcatctcccatgtgggctgcctgattcagttgtctttttttaatctttttggatgtttggacagtgtactcttaactgtgatggcctatgatcggtttgtagccatttgttatcctctgcactacccagtcatcatgaacccccgcctctgtagcctgctgattctgatatcttttttaatcagccttctggactctcagctgcactgcctcatgatgtcacaacttaccttctgcataaatgtggaaattcctcatttcttctgtgaccctcctcagctcctcaagctttcctgtaatgatacttccaccactaaaatattcatgtgttttcttggtgccatctttggtggtattccagtctcagggatccttttctcttacacacgaattgtttcctccattctgagagtcccatccacaggtgggaagtacaaagccttctccacctgtggctcccacctgtcagttgttatcttattttatggaacaggtcttggggtgtacctcagttctactatctcacattctcccagaaaggatgcagtggcctcagtaatgtatgctttcattgttcccatgctaaatcccttcatctacagtctgaggaacaaggacatcaagagtgctttgcagaggctcctcaacagaaaagcccagtcttaa

SEQ ID NO: 1014 - protein, 345 aa, Canis familiaris
MNCLNSKYRHTDRSQYTCFLYLNSHLFLKSCLCYTEPQNLTDVLEFFLLGFSEDPELQPVIFSLFLSMYLVTMLGNLLILLAVSSDSCLHTPMYFFLSILSLADIGFISTTVPKVILDIETHNRVISHVGCLIQLSFFNLFGCLDSVLLTVMAYDRFVAICYPLHYPVIMNPRLCSLLILISFLISLLDSQLHCLMMSQLTFCINVEIPHFFCDPPQLLKLSCNDTSTTKIFMCFLGAIFGGIPVSGILFSYTRIVSSILRVPSTGGKYKAFSTCGSHLSVVILFYGTGLGVYLSSTISHSPRKDAVASVMYAFIVPMLNPFIYSLRNKDIKSALQRLLNRKAQS

SEQ ID NO: 1015 - DNA, 930 bp, Canis familiaris
atggaaccacagaatctaacaagtgtttcagaattcctcctcctgggcctctcagatgatccagaactgcagcccctcctctttgggctgctcctgaccatgtacctggtcactgtgcttgggaacctgctcatcatcttggccgtcagctctgactcccacctccacacccccatgtacttcttcctctccaacctgtccttggctgacattggtttcagcaccactacagtcccaaagatgctggtgaacattcaaacacacagcaaatatatcacttatgcaggctgcctaactcagatgtccttttattttctatttgggtgtttggacaatctactcctggctgtgatggcctatgaccggtttgtggccatttgtcaccccctgaactacccaattatcatgaacccacgcctctgtggcttgttggtcctgttgtcatttttcagcagccttttggaatctcagattcactgtttgatggtgtcacaacttaccttctgcacagatgtggaaattcatcatttcttttgtgatgcacctcaacttctccaccttgcctgctcttatacctccatcaacaccatactaatctattttattggtgccatttttggtggcattccactttcagggatcctttgttcttatagtagaattgcttcctccattctgagagtcccaaccacaggtgggaagtacaaagcgttctccacctgtggctcccacctgtcagttgtttgcttattttatggaacaggccttggagtgtacctcggttcatccatctccccctcccctgggaaggatgcagtggcctcagtagtgtacactgtggtcattcccatgctgaaccccttcatctatagcctgaggaacagggacatcaagagggcactgtgggggattataagcataacagcttaa

SEQ ID NO: 1016 - protein, 309 aa, Canis familiaris
MEPQNLTSVSEFLLLGLSDDPELQPLLFGLLLTMYLVTVLGNLLIILAVSSDSHLHTPMYFFLSNLSLADIGFSTTTVPKMLVNIQTHSKYITYAGCLTQMSFYFLFGCLDNLLLAVMAYDRFVAICHPLNYPIIMNPRLCGLLVLLSFFSSLLESQIHCLMVSQLTFCTDVEIHHFFCDAPQLLHLACSYTSINTILIYFIGAIFGGIPLSGILCSYSRIASSILRVPTTGGKYKAFSTCGSHLSVVCLFYGTGLGVYLGSSISPSPGKDAVASVVYTVVIPMLNPFIYSLRNRDIKRALWGIISITA

SEQ ID NO: 1017 - DNA, 909 bp, Canis familiaris
atggaaccaagaaatcaaacaagtgtttcagaatttttactcctgggattttctcaagactcagtgcatcagcccattctatttgggctattcttgtccatgtacctggtcaccgtgcttgggaacctactcatcatcctggccatcacctctgactcccacctccacacccccatgtacttcttcctctccaacttgtcctttgctgacatcagtttcacctccaccacagtccctaagatgctggtgaacatccaaacacagagcaaatccatcacctatgcaggctgcatcacccagatgtatttttttatggtttttggaggcatggacactttcctccttactgtgatggcctatgaccggtttgtggccatctgtcaccccttgcactacacagtcatcatgaatccacagctctgtggcctcctggttcttgtgtcctggttcatcagcttctcatactccctgatccagagtttgttgatgttgcggctgtctttctgcaccaactgggtaattccacacttttactgtgaacttgctcaggccctcacccttgcctgttcagacacattggtcaatcatatcttgcaatatatggtgactgcccttcttggcattgttcccttctcagggatccttttctcctatactcggattgcctcctcaatcctgagaatcccatcagctaatgggaagtataagtataaggcattttccacctgtgcgtctcacctctccgtggtttctttattctatgggacagggcttggtgtgtatctcagttctgatgtatcttcctggagaggcatgattgcctcggtgatgtacactgtggtcaccccaatgctgaaccccttcatctacagcctacggaacagggacatgaagagggctctacaaaaa

SEQ ID NO: 1018 - protein, 303 aa, Canis familiaris
MEPRNQTSVSEFLLLGFSQDSVHQPILFGLFLSMYLVTVLGNLLIILAITSDSHLHTPMYFFLSNLSFADISFTSTTVPKMLVNIQTQSKSITYAGCITQMYFFMVFGGMDTFLLTVMAYDRFVAICHPLHYTVIMNPQLCGLLVLVSWFISFSYSLIQSLLMLRLSFCTNWVIPHFYCELAQALTLACSDTLVNHILQYMVTALLGIVPFSGILFSYTRIASSILRIPSANGKYKYKAFSTCASHLSVVSLFYGTGLGVYLSSDVSSWRGMIASVMYTVVTPMLNPFIYSLRNRDMKRALQK

SEQ ID NO: 1019 - DNA, 939 bp, Canis familiaris
atgggagcaggaaaccagacagaagtatcagtattcctccttctgggcttctcagaagatccagaactgcagcctctcctctttggcttgttcctgtccatgttcctggtgactgtactgggaaatctgctcatcatcctggctatcctttctgattcccacctccacacccccatgtacttcttcctctccaacctgtcttttgttgacatctgtttcatctccaccactgtcccgaagatgctgctaaacatccaggtacacagcaaagacatttcctatataggatgcatcactcaggtatatttctttatgatttttgctggaatggatgatttcctcttgactgtgatggcctatgaccggtttgtggccatctgccaccctctgcactataccatcatcatgaacccacgactctgtgtcctcctggttctgatttgttggctcaccattttctgggtctccctgattcatattctaatggtagggcagctgaccttctgtacaggcactgaacttccacatttcttctgtgaactggctcagattctcaaggtggcctgctctgacaccctcatcaataacatctgcttgtatgttgccactgctctgctgtgtgtttttcctctcactgggattcttttctcttactctcagatcgtctcctccttaatgaggatgtcttccactgagggcaagtataaagcattttccacttgtgggtctcacctttctgtggtctccttgttctatggtacaagcctgggggtctatctcacttctgctgtgacccattcttcccagagaagctcagttgcatcagtgatgtacactgtggtcacccccatgctgaacccctttatctacagcctgaggaacaaggatgtgaagggcgccctgcgaaggctcctcaacagagcagcctcatgtccatga

SEQ ID NO: 1020 - protein, 312 aa, Canis familiaris
MGAGNQTEVSVFLLLGFSEDPELQPLLFGLFLSMFLVTVLGNLLIILAILSDSHLHTPMYFFLSNLSFVDICFISTTVPKMLLNIQVHSKDISYIGCITQVYFFMIFAGMDDFLLTVMAYDRFVAICHPLHYTIIMNPRLCVLLVLICWLTIFWVSLIHILMVGQLTFCTGTELPHFFCELAQILKVACSDTLINNICLYVATALLCVFPLTGILFSYSQIVSSLMRMSSTEGKYKAFSTCGSHLSVVSLFYGTSLGVYLTSAVTHSSQRSSVASVMYTVVTPMLNPFIYSLRNKDVKGALRRLLNRAASCP

SEQ ID NO: 1021 - DNA, 939 bp, Canis familiaris
atggaagcaggaaatctaacaggaattttagagttcatcctccttgggttctctgaggatccagaactacaacccttcatatttgggctattcctgtgtatgttcctggtcactgtgcttgggaacctgctcatcatcctggccatctgctctgacccccacctccatacccccatgtacttcttcctctccaatctgtcgttggttgacatctgtttcagcaccaccatagtgcccaagatgctggtgaacatccacacagagaacaaagccatctcctacatggactgcctcacgcaggtatatttttccatgttttttcccatcctagacactctactccttactgtaatggcctatgaccggtttgtggccatctgccaccccctgcactacacagtcatcatgagcccacgcctctgtggcctgttggtttttgctacctggtttgttggtatcatgacatcccttcttcatatctctctgatgaggcacctgagcttctgcagagaccttgaaattccacatttcttctgtgaactgacacagattctcaagttggcctgctctgatacctttctgaacagcacgttgatatactttatgactggtgtgctgggtgtttttccccttgttggtatccttttctcctactcacagattgcttcatctataaggaagatgtcttcatctgggggaaagcaaaaagcattttccacctgtgggtctcacctctcagttgtttctttattttatgggacaggtgttggggtatacttcacttctgcagtaactcactccccccagaaagtctcagtggcttcagtgatgtacactgtggtcacccccatgctgaaccccttcatctacagcctgaggaacaaggatgtgaagggggcactgggaagccttctcagtagagtgacctcttgtctgtga

SEQ ID NO: 1022 - protein, 312 aa, Canis familiaris
MEAGNLTGILEFILLGFSEDPELQPFIFGLFLCMFLVTVLGNLLIILAICSDPHLHTPMYFFLSNLSLVDICFSTTIVPKMLVNIHTENKAISYMDCLTQVYFSMFFPILDTLLLTVMAYDRFVAICHPLHYTVIMSPRLCGLLVFATWFVGIMTSLLHISLMRHLSFCRDLEIPHFFCELTQILKLACSDTFLNSTLIYFMTGVLGVFPLVGILFSYSQIASSIRKMSSSGGKQKAFSTCGSHLSVVSLFYGTGVGVYFTSAVTHSPQKVSVASVMYTVVTPMLNPFIYSLRNKDVKGALGSLLSRVTSCL

SEQ ID NO: 1023 - DNA, 942 bp, Canis familiaris
atgggggatgtgaatcaatcagtgacctctgacttcgttctggtgggcctcttcagtcactcagggtcacgtcagctactcttctccctggtggctgccacgtttaccatgggcctcctgggcaacaccattctgctcttcgtgatccgtacagactcccggctccacacacccatgtactttctgctcagccagctctctctgtttgatgttggcttccctctggtcaccatccccaagatggcatccgactttctgcagggagacgggtccatctccttcgggggctgcgcagctcaaatattcttcctgactctgatgggcgtggctgagggcatcctgttggccctcatgtcctatgaccgctatgttgccgtgtgtcaccctctgcagtatcccgtgctcatgaggcgccaggtgtgcttgctcatggtgggctcttcctggctagcaggggtgctcaacgcctccgtccagacctccatcactctgcacttcccctactgcgcctcccgcatcgtggaccacttcttctgcgaggtgccagccctgctgaaactctcctgcgcagacacctcggcctacgagttggcgctgtccacctcgggggtgctgatccttgtgcttccacttttcctcattgccacttcctacggccacgtgttgggggccgttatacgcatgcactcagaggaggcccgaaacaaagccttcaccacctgttcctcgcacatcacagtagtgggactcttttacggagcagctgtgttcatgtacatggtgccgggtgcctaccacagcccacaccaggacaatgtggtctccctgttctatagccttgtcacccccacactcaatccccttatctacagtctgaggaaccgggaggtgcggatggctctggtcaaagtgctcagcagaactgggctcaggccaaagtga

SEQ ID NO: 1024 - protein, 313 aa, Canis familiaris
MGDVNQSVTSDFVLVGLFSHSGSRQLLFSLVAATFTMGLLGNTILLFVIRTDSRLHTPMYFLLSQLSLFDVGFPLVTIPKMASDFLQGDGSISFGGCAAQIFFLTLMGVAEGILLALMSYDRYVAVCHPLQYPVLMRRQVCLLMVGSSWLAGVLNASVQTSITLHFPYCASRIVDHFFCEVPALLKLSCADTSAYELALSTSGVLILVLPLFLIATSYGHVLGAVIRMHSEEARNKAFTTCSSHITVVGLFYGAAVFMYMVPGAYHSPHQDNVVSLFYSLVTPTLNPLIYSLRNREVRMALVKVLSRTGLRPK

SEQ ID NO: 1025 - DNA, 648 bp, Canis familiaris
ttcctcagcttccctgcctgcttcctacagatgtacctcatccacagcttctcctgctctgaagccttcatcctggtggtcatggcttatgaccgccaagtgaatatctgccacccactgcactaccctgtcctcatgaccccacagaccagtgctacactggcagcctgtgcctggctcactgccctcctcccgcccatcccagcagtggtgcagacttcccacttggcttttgacagcactgctcacatctatcactgcttctgtgactacttggccgtggtccaggcctcctgctctgacaccatgccccagaccctcatgggcttctgcactgccatggtggtatccttcctgccccgtctcctggcgcttctctcctatgcccacatcctggcctcggtgcttcacatcagctcccaggaaggacgttcaaaagccttctccacctgtagctcccacctgctgatggttggcacatactgctcatccattgccatagcctatgtggcctacagggctgacctgccccttgatgtccacatcatgggcaatgtggtatatgctattctcacatctgtcctcagccatctcatttacatgctgaggaacaaggatgtcaaagtagccatcaccagaatggcatgt

SEQ ID NO: 1026 - protein, 216 aa, Canis familiaris
FLSFPACFLQMYLIHSFSCSEAFILVVMAYDRQVNICHPLHYPVLMTPQTSATLAACAWLTALLPPIPAVVQTSHLAFDSTAHIYHCFCDYLAVVQASCSDTMPQTLMGFCTAMVVSFLPRLLALLSYAHILASVLHISSQEGRSKAFSTCSSHLLMVGTYCSSIAIAYVAYRADLPLDVHIMGNVVYAILTSVLSHLIYMLRNKDVKVAITRMAC

SEQ ID NO: 1027 - DNA, 501 bp, Canis familiaris
cccactgcataccctgtcctcatgaccctacagaccaatgctacactggcagcctgtgcctggctcactgccctcctcctgcccattccagcagtggtgcagacttcccacttggcttttgacagcactgctcacatctatcactgcttctgtgaccacttggccatggtccaggcctcctgctccatgcccgagaccctcatgggcttctgcattgccatggtggtatccttcctgccccttctcctggtgcttctctcctatgcccacatcctggcctcggtgcttcgcatcagctcctgagaaggatgttcaaaagccttctccacctgtagctcccacttcctggtagttggcacatactgctcatccattgccatagcctatgtggcctacagggctgacctgctccttgacctccacatcatgggtgatgtggtatttgccattctcacacctgtcctcaaccctgtcgtctacatgctgaggaacaaggatgtc

SEQ ID NO: 1028 - protein, 100 aa, Canis familiaris
PTAYPVLMTLQTNATLAACAWLTALLLPIPAVVQTSHLAFDSTAHIYHCFCDHLAMVQASCSMPETLMGFCIAMVVSFLPLLLVLLSYAHILASVLRISS

SEQ ID NO: 1029 - DNA, 951 bp, Canis familiaris
atggaggccacaacctgtaatggatcactggatggatcacctgtcttctacctggtgggaatcccctctctgccagagaccttcttcctccctgtgttttttattttcctcctcttctatcttcttatccttatgggaaatgtcctgatcctggtggctgtggtgggagagcccagcctccacaagcccatgtacttctttctgatcaacctctctactctggacattctcttcaccacaaccaccgtccccaagatgctgtccctgttcctgcttggggaccacttcctcagcttccctgcctgcttattgcaaatgtacctcttccaaagcttcacatgttcagaagccttcatcctggtggtcatggcctatgaccgctatgtggctatctgccgcccactgcactaccctgtccacatgaccccacagaccaatgctgtgctggcagcctgtgcctggctcactgccctcctcttgcccatcccagcagtggtcaagacctcccagatggcatataacaacattgctcgcatctaccattgtttctgtgatcacttggctctggtccaggcctcctgctctgacaccatgccccagaccctcatgggcttctgcattgccatggtggtatccttcctgccccttctcctggtgcttctctcctatgcccacatcctggcctcggtgcttcgcatcagctcccgagaaggacgttcaaaagccttctccacctgtagctcccacctcctggtggttggcacatactactcatctattgccgtagcctatgtggcctacagggctgacctgccccttgacttccacatcatgggcaatgtagcatatgctattctcacaccaattctcaaccctctcatttacactctgagaaacaaggatgtcaaagcagccattaccaaaatcacatgtctcaagacccagtcttga

SEQ ID NO: 1030 - protein, 316 aa, Canis familiaris
MEATTCNGSLDGSPVFYLVGIPSLPETFFLPVFFIFLLFYLLILMGNVLILVAVVGEPSLHKPMYFFLINLSTLDILFTTTTVPKMLSLFLLGDHFLSFPACLLQMYLFQSFTCSEAFILVVMAYDRYVAICRPLHYPVHMTPQTNAVLAACAWLTALLLPIPAVVKTSQMAYNNIARIYHCFCDHLALVQASCSDTMPQTLMGFCIAMVVSFLPLLLVLLSYAHILASVLRISSREGRSKAFSTCSSHLLVVGTYYSSIAVAYVAYRADLPLDFHIMGNVAYAILTPILNPLIYTLRNKDVKAAITKITCLKTQS

SEQ ID NO: 1031 - DNA, 939 bp, Canis familiaris
atggaaactatagcctgtaatggatcagaggattcctcacccatcttctacctggtgggcattccttctctgcccaaatccctctttcttcctatcttctttgtctttctcttcctttacctgctcatcctgctgggaaatgtcctgatcctactggctgtggtggcagagcccagcctccacaagcccatgtacttcttcctgattaatctctcagccctggacatccttttcaccacaaccaccgtccccaagatgctgtccctcctcttacttggggaccgcttcctcagcttccctgcctgcttcctgcagatgtacctcttccacagcttctcctgctctgaagccttcatcctggtggtcatggcctatgaccgctatgtggctatctgccgcccactgcactaccctgtcctcatgaccccacagaccaatgctacactggcagcctgtgcctggctcactgccctcctcctgcccatcccagcagtggtgcagacttcccacttggcttttgacagcactgctcacatctatcactgcttctgtgaccacttggccgtggtccaggcctcctgctctgacaccatgccccagaccctcatgggattctgcattgccatggtggtatccttcctgccccttctcctggtgcttctctcctatgcccacatcctggcctcggtgcttcgcatcagctcccgagaaggacgttcaaaagccttctccacctgtagctcccacctcctggtggttggcacatactactcatccattgccatagcctatgtggcctataaggctgacctgccccttgatttccacatcatgggcaatgtggtatatgctattctcacacctgtcctcaaccctctcatctacacgctgaggaacaaggatgtcaaagcagccatcaccagaatggcatgtctctga

SEQ ID NO: 1032 - protein, 312 aa, Canis familiaris
METIACNGSEDSSPIFYLVGIPSLPKSLFLPIFFVFLFLYLLILLGNVLILLAVVAEPSLHKPMYFFLINLSALDILFTTTTVPKMLSLLLLGDRFLSFPACFLQMYLFHSFSCSEAFILVVMAYDRYVAICRPLHYPVLMTPQTNATLAACAWLTALLLPIPAVVQTSHLAFDSTAHIYHCFCDHLAVVQASCSDTMPQTLMGFCIAMVVSFLPLLLVLLSYAHILASVLRISSREGRSKAFSTCSSHLLVVGTYYSSIAIAYVAYKADLPLDFHIMGNVVYAILTPVLNPLIYTLRNKDVKAAITRMACL

SEQ ID NO: 1033 - DNA, 1032 bp, Canis familiaris
atgggtgaagatggaaataccagcaccttcaacatctcctacaccaacttcttcctggtgggcttccctggattccgagagtggcgacctctcctggtcctgccccttaccttcctatatgtgaccgtcatctcagccaatgccctggtcatccacacagtggtggcccagcggagcctgcatcagcccatgtacatgctcatcgccctgctcctggctgtcaacatttgtgctgccactgccgtgatgcccaaaatgctggagggctttgtgcattatgctaaccccatatcactgcacagctgcctagcccagatgttctttatctacttcactcttcttctggactacaatctcctgctggccatggccctagaccgctatgtcgccatctgtcacccactccgctatactgacctaatgacctctcacctgcttggtgtgctggccattcttgccctgacacagagcctgggagtggcagtgcctttggtagtgctaacatcacaagctcgattctgccggacaatggtgattccacacttcacctgtgagtacattgcactgctgagcatagcttgtggagacttgactttcaacaataggttgggactggccatgcggttggtcactgtgacctttgatctcgccctgctagggacctcctacacccgcatcatttatgctgcctttcggatctcttctgggggagcccgagctaaggccttgcacacatgtggctcccacttactagtcatcctcactatctacctctctggtctctccacttccattgttttccgggtagccaagactgtgtctcaggatgtccagaacctgctcagtgccatctacttgctgctcccaggcaccttgaatcctgtcatttatggggtgaggaccagggagatccggcaacatgtggaaaagatgctctttagcaagatatcagcccaggaagttggggagaagccagagagaatgcaaaatatgaggggaaattgccagggtgagaggactttatcaacttga

SEQ ID NO: 1034 - protein, 343 aa, Canis familiaris
MGEDGNTSTFNISYTNFFLVGFPGFREWRPLLVLPLTFLYVTVISANALVIHTVVAQRSLHQPMYMLIALLLAVNICAATAVMPKMLEGFVHYANPISLHSCLAQMFFIYFTLLLDYNLLLAMALDRYVAICHPLRYTDLMTSHLLGVLAILALTQSLGVAVPLVVLTSQARFCRTMVIPHFTCEYIALLSIACGDLTFNNRLGLAMRLVTVTFDLALLGTSYTRIIYAAFRISSGGARAKALHTCGSHLLVILTIYLSGLSTSIVFRVAKTVSQDVQNLLSAIYLLLPGTLNPVIYGVRTREIRQHVEKMLFSKISAQEVGEKPERMQNMRGNCQGERTLST

SEQ ID NO: 1035 - DNA, 945 bp, Canis familiaris
atgacagtgttcaatatcaccacaacccatccagcttccttcctgctggtaggaattccaggtttggagcaattgcatgtctggatctccattccattctgctttgcctatactctggccctgctaggcaactgcacccttctcttcattattcaggctgatgcagccctccatgagcccatgtacttctttctggccatgttggcagccattgacctggtcctctcttctacaacacttcccaaaatgctggctattttttggttcagagatcgggagatcagcttctatggctgtctggtccagatgttctttctccactccttctctatcatggagtcagcagtgctgctggccatggcctttgaccgctatgtggccatctgcaagccattgcactacaccacagtcctgactaggcccctgatcaccaagattggcatggcagctgtggctcgggctgtgacattaatgactccgctcccctttctgctcagacgcttccactactgccgaggcaccatgattgcccactgctactgtgagcatatggctgtggtgaggctggcctgtggggatactcgcttcaacaatatctatggcattgctgtggccatgtttatagtggtgttggacctgctgtttgttatcttgtcttacatcttcatccttcgggcagttttacagcttgcctctcaagaggcccgctacaaggcctttgggacatgtgtatctcacataggtgccatcttatctacctacacacctgtggtcatctcctcagtcatgcatcgtgtggctcgccgggctgcccctcatgtccacatactacttgctattttctatcttctttttccgcccatgatcaatcccatcatctatggtgtcaagaccaagcagattcgtgatcatgtgctcaatctgttccagagaaagaaagtgtag

SEQ ID NO: 1036 - protein, 314 aa, Canis familiaris
MTVFNITTTHPASFLLVGIPGLEQLHVWISIPFCFAYTLALLGNCTLLFIIQADAALHEPMYFFLAMLAAIDLVLSSTTLPKMLAIFWFRDREISFYGCLVQMFFLHSFSIMESAVLLAMAFDRYVAICKPLHYTTVLTRPLITKIGMAAVARAVTLMTPLPFLLRRFHYCRGTMIAHCYCEHMAVVRLACGDTRFNNIYGIAVAMFIVVLDLLFVILSYIFILRAVLQLASQEARYKAFGTCVSHIGAILSTYTPVVISSVMHRVARRAAPHVHILLAIFYLLFPPMINPIIYGVKTKQIRDHVLNLFQRKKV

SEQ ID NO: 1037 - DNA, 303 bp, Canis familiaris
tctgtccgggtcaacaagatatatggtctttttattgccttcagtatcttggggtttgacacaatcttcatcaccttgtcttatgttcagatctttatcactgtgcttcaattgcctcagaaggaggcacgattcaaggcctttaatacctgccttgtccacatctgtgtctttttacagttctacctccttgccttcttctccttcttaacacataggtttgtttcttacataccaccttatattcatatcctcttatcaagcctttacctgttagtccctcctttcctcaacccgatagtc

SEQ ID NO: 1038 - protein, 101 aa, Canis familiaris
SVRVNKIYGLFIAFSILGFDTIFITLSYVQIFITVLQLPQKEARFKAFNTCLVHICVFLQFYLLAFFSFLTHRFVSYIPPYIHILLSSLYLLVPPFLNPIV

SEQ ID NO: 1039 - DNA, 936 bp, Canis familiaris
atgtccatctccaacattacaatcttcatgccttctgtgttgacactaatagggatcccaggcctagagtctgtgcagtgctggattgggattccattctgtgccatgtatcactttgctatgattggaaatttcttgcttctgatcatcatcaaatcagagcgcagcctccatgagcccatgtatattttcttaggcatgttaggagtcacagatattgtacctggcacaggcattgtgcccaagatgcttggaattttttgactacatgtaccagagatttattttgattcctgcttgcttcaaatggggctcatccacacatttgagtgcatagagtcaggcatcctccttgccatggccctggaccgttatgtggccatctgttatccactcaaacacagtggcatcttcacccaccagctggtggcccaaataggggctatggtaacactcagggctgccattctggtagccccatctttagcactcataaagtgtcggtttcaattttatcatacaaccaccatctcccactcctactgtgagcatatggccattgtgaaactggctgcagaaaatgtgcgggtcaacaaaatctatgacttgtttgtggcatttgctgttgcagggttcgacctcaccttcatcactatgtcctacatacagatcttcttcacggtttttcgtttgccccagaaggagccccacttgaaagcattcagtacctgcatcgcccacatctgcgttttcctccagctctacttccttgccttcttctccttcttcactcataggtttggtactcatgtccctccttatatccatatcctcttttctagcctctacttgctggtccccccatttcttaatccacttgtctatggtgccaagaccaagcaaatccgcattcacgtggtaaagatgttctgttct

SEQ ID NO: 1040 - protein, 210 aa, Canis familiaris
MGLIHTFECIESGILLAMALDRYVAICYPLKHSGIFTHQLVAQIGAMVTLRAAILVAPSLALIKCRFQFYHTTTISHSYCEHMAIVKLAAENVRVNKIYDLFVAFAVAGFDLTFITMSYIQIFFTVFRLPQKEPHLKAFSTCIAHICVFLQLYFLAFFSFFTHRFGTHVPPYIHILFSSLYLLVPPFLNPLVYGAKTKQIRIHVVKMFCS

SEQ ID NO: 1041 - DNA, 984 bp, Canis familiaris
atgaagtctcaccatgacattttcaatgcgtccattgcattcacacctgcaacattcactcttgctggcattccagggctagaggcagaacatatctggatatccatccctttctgcctgatatacatcatcatcttcctaggaaatggcatcattcttcatatcatccggattgaccctgctttgcaccaacccatgtactcctttttggccacgctggcctttgttgaacttggggtctctgcttccaccatgcccactgtgctaggcattttcctctgtggaattaatgaaatcagttttggtggttgcctgttccagatgttttccatgcattcttttaccataatggagtcaggtgtccttctcactatgtctgtagaccgttttgtggccatctacagccccctgcgctacacaaccatcctgacaattccccgcatcattgggatgggtgtcatcattgccttacgaagtgtggtgctcatgttcccactgctcttcctcctgaagggcctgcctttctgtggtcacaatactctcacacactcttactgtctccattcagatctaatcaaattgccctgtggagacactagacccaatagcatcctgggtttgtttgtcattacctccacatttgggctggactcactgctcattgtagtttcttatatgttgattcttcacactgtactgggaatagcttctggagctgggcagtggaaggcactcaacacatgcgtgtcacacatctgtgctgttctggtgtactacgtgcccatgattagcctctccttgctgcatcgctttgggggacacttacctccactccttcagactgtcatggccaatgcctacctcttcttcccacctgtggtcaaccccattgtgtatagtatgaaaacaaaagaaattcgcaatagcattgttcgtatactgcctagaaagaggcatgaagtctcaagacagataataccctaa

SEQ ID NO: 1042 - protein, 327 aa, Canis familiaris
MKSHHDIFNASIAFTPATFTLAGIPGLEAEHIWISIPFCLIYIIIFLGNGIILHIIRIDPALHQPMYSFLATLAFVELGVSASTMPTVLGIFLCGINEISFGGCLFQMFSMHSFTIMESGVLLTMSVDRFVAIYSPLRYTTILTIPRIIGMGVIIALRSVVLMFPLLFLLKGLPFCGHNTLTHSYCLHSDLIKLPCGDTRPNSILGLFVITSTFGLDSLLIVVSYMLILHTVLGIASGAGQWKALNTCVSHICAVLVYYVPMISLSLLHRFGGHLPPLLQTVMANAYLFFPPVVNPIVYSMKTKEIRNSIVRILPRKRHEVSRQIIP

SEQ ID NO: 1043 - DNA, 972 bp, Canis familiaris
atgctgcaggagatggctcctttctcttacaaccacaccaatacccaggatatgtggtatgtcctgattggaatcccagggctggaagattctcacccctggatctccatccctatctgttcgatgtacgtgttggctgtcataggcaacagcttcttgatcttcctgattgtgactgagcgcagtctccacgagcccatgtattttttcctttccatgctggccttggcagatgtgctgctctccacagccacggcccccaagatgctggccatcttctggttccagtccatggatatatccttcggtagctgtgtatctcagatgttcttcatacatttcatctttgtggcagaatctgctattctcctggccatggcatttgaccgctatgtggccatctgtcaccccctgagatacaccaccatcttaacctcctcagccactgggaagattggcatagcagctgtggtcaggagctttttcatctgccttccattcatcttcctggtttaccgacttaggtactgtgggagaaacatcattccccactcctactgtgagcacatgggcattgccagattggcatgtgacagtatcaaggtcaacatcatctatggcctgactgtggccctactgtctacaggactggatattgtgttcatcattatgtcgtacaccatgatcctttgcacagtgtttcagataccttcctgggctgccagattcaaggccctcaacacatgtgcttcccacatctgtgtcatccttatgttctatgccccagcattcttttcattttttgcccatcgttttgggggtaaaaccatccctcaccacatccacatcctggtagccaatctctatgtggttgttccccctatgctaaaccccatcatttatggggtgaagaccaaacagattcaagaccgagtaacattgcttttctccttcatcagcacatgttgttaa

SEQ ID NO: 1044 - protein, 323 aa, Canis familiaris
MLQEMAPFSYNHTNTQDMWYVLIGIPGLEDSHPWISIPICSMYVLAVIGNSFLIFLIVTERSLHEPMYFFLSMLALADVLLSTATAPKMLAIFWFQSMDISFGSCVSQMFFIHFIFVAESAILLAMAFDRYVAICHPLRYTTILTSSATGKIGIAAVVRSFFICLPFIFLVYRLRYCGRNIIPHSYCEHMGIARLACDSIKVNIIYGLTVALLSTGLDIVFIIMSYTMILCTVFQIPSWAARFKALNTCASHICVILMFYAPAFFSFFAHRFGGKTIPHHIHILVANLYVVVPPMLNPIIYGVKTKQIQDRVTLLFSFISTCC

SEQ ID NO: 1045 - DNA, 972 bp, Canis familiaris
atgctgcaggagatggcccctttctcttacaaccacaccaatacccaggatatgtggtatgtcctgattggaatcccagggctggaagattctcacccctggatctccatccctatctgttcgatgtacgtgttggctgtcataggcaacagcttcttgatcttcctgattgtgactgagcgcagtctccacgagcccatgtattttttcctttccatgctggcctcggcagatgtgctgctctccacagccacggcccccaagatgctggccatcttctggttccagtccatggatatatccttcggtagctgtgtatctcagatgtttttcatacatttcatctttgcgacagaatctgctattctcctggccatggcatttgaccgctatgtggccatctgtcaccccctgagatacaccaccatcttaacctcctcagccactgggaagattggcatagcagctgtggtcaggagctttttcatctgccttccattcatcttcctggtttaccgacttaggtactgtgggagaaacatcattccccactcctactgtgagcacatgggcattgccagattggcatgtgacagtatcaaggtcaacatcatctatggcctgactgtggccctactgtctacaggactggatattgtgttcatcattatgtcgtacatcatgatcctttgcacagtgtttcagataccttcctgggctgccagattcaaggccctcaacacatgtgcttcccacatctgtgtcatccttatgttctatgccccagcattcttttcattttttgcccatcgttttgggggtaaaaccatccctcaccacatccacatcctggtagccaatctctatgtggttgttccccctatgctaaaccccatcatttatggggtgaagaccaaacagtttcaagaccgagtgatgtcgcttttctctcccatcagcacatgttgttaa

SEQ ID NO: 1046 - protein, 323 aa, Canis familiaris
MLQEMAPFSYNHTNTQDMWYVLIGIPGLEDSHPWISIPICSMYVLAVIGNSFLIFLIVTERSLHEPMYFFLSMLASADVLLSTATAPKMLAIFWFQSMDISFGSCVSQMFFIHFIFATESAILLAMAFDRYVAICHPLRYTTILTSSATGKIGIAAVVRSFFICLPFIFLVYRLRYCGRNIIPHSYCEHMGIARLACDSIKVNIIYGLTVALLSTGLDIVFIIMSYIMILCTVFQIPSWAARFKALNTCASHICVILMFYAPAFFSFFAHRFGGKTIPHHIHILVANLYVVVPPMLNPIIYGVKTKQFQDRVMSLFSPISTCC

SEQ ID NO: 1047 - DNA, 819 bp, Canis familiaris
gctagtgtactgtctgggaactgcctggtgctgcatgtgatccggactgagccgagcctgcaccagcccatgttctacttcctggccatgctggccctcactgacctgtgcatggggctgtccacggtgcacacggtgctgggcatcctgtgggggttcattcgagaaatcagcctggattcgtgcattgcccagtcctacttcatccatggtctttccttcatggagtcctctgtcctccttactatggcctttgataggtatgtcgccatttgcaatccactgcggtattcctccattctgactaattccaggattttcaaaatcgggctcatcatagtgggtaggagtttcttctttattacaccccccatcatcaatctgaaatttttccattactgtcactcccatagcctctctcactcgttctgcctacaccaggaccttctgcgtctagcttgctcagacatcaggtttaatagctactatgccctgatgttggtcattctcacgctgttgttggatgctgttctcatcctttactcctatgtgctgattcttagggcagtcctggcaattgcctctcaggaggaacagcataaattatttcagacctgcatctcccacctgtgtgctgttctcgtgttctatatccctatcattagcttaacaatggtgcaccgttttggcaagcatctctcacctgtgatccatgtacttatgggcaacatctacatccttttcccacctttgatgaaccccatcatctacagtgtcaagacccagcagattcggagcagaatgctcagactcttttct

SEQ ID NO: 1048 - protein, 273 aa, Canis familiaris
ASVLSGNCLVLHVIRTEPSLHQPMFYFLAMLALTDLCMGLSTVHTVLGILWGFIREISLDSCIAQSYFIHGLSFMESSVLLTMAFDRYVAICNPLRYSSILTNSRIFKIGLIIVGRSFFFITPPIINLKFFHYCHSHSLSHSFCLHQDLLRLACSDIRFNSYYALMLVILTLLLDAVLILYSYVLILRAVLAIASQEEQHKLFQTCISHLCAVLVFYIPIISLTMVHRFGKHLSPVIHVLMGNIYILFPPLMNPIIYSVKTQQIRSRMLRLFS

SEQ ID NO: 1049 - DNA, 864 bp, Canis familiaris
ttttctaggatggaatatgggccccactgctgagtctccatctctgttgtctaggtgtactaggcagcagtgctgggcaaagccactatcattcccatcgtccacatagacttatccctgaactaatccatgtactattttctggttatgctggcaggaattgacctgggtctctgtgttccagtattatccacagtactgggaaagctatggataaattttgtatcatttatatgactatattttccatccctaagttgttcatatctttctttcatggagtcaatcatgcttttagccatggcatatgattgctctgtggccattgctgaccctctgagatatccctcagtgcttatcagctcccaagtagtgaggattgttttgtggattcagagtgcatatttcaccatctttcatggcctgtacctctttggtttctcttattgtcatgacagtatcctttctcactcctgctatctacaccaggatatgatccaactcccctgctctggctcatggatcaacagtttctatactttgtttttcatcttgcttgccatgggcccagacttccttttaatagtgccttcttatgttctgattctcagatctgcaatggccattgtctcctacaggaggcaactctcagtccagcgtgtgtctcacattcttacttcccttttactttatgtccttgtgctgggctcttctatcattcacaagtttgcaaagcattccctctcccttatccacatcatcacaagcaaagtgtccattttctttgtacccctaatgaacccagtcatttttagcatcaaggcctactggatgtactgaaccattatcaaggtgttctctttg

SEQ ID NO: 1050 - protein, 35 aa, Canis familiaris
FLGWNMGPTAESPSLLSRCTRQQCWAKPLSFPSST

SEQ ID NO: 1051 - DNA, 936 bp, Canis familiaris
atgtggtccaataacagtgctgctcccttcttgctaactggcttcctgggctcagaggcaattcaccactggatctctattcccttctttatgatctatttcttcatccttttgggcaatggcacacttttcttcctcatttggaacgactccagccttcatgagcccatgtactatttcctggctatgctggcaggtacagaccttggaatgacactaactacaatgcccacagtcctgggtgtcttattgctggaccagagggaaatttcccagggtgcctgtttcactcagtcctacttcattcataccctggccattgtggaatcgggtgtgttgcttgccatggcctatgaccgattcatcgccatccgcactcctctgaggtataactccattcttaccaattctcgggtgatgaaggtaggactgggtgtactaatgaggggctttatgtccattgtgcccccaatcatgccactctactggttcccatattgccgttcccatgttctttcccatgccttttgcctccaccaagatgtcatgaaacttgcctgtgctgatattacatttaatcgtgtgtacccagtcattctggttgctttgactttcttcctagatgctctcattatactcttctcttatattttaatcctgaagacagttatgggtattgcctctagagaagagagagctaaggcccttaacacctgtgtctcacatattagcagtgtcctggtcttttatattactgtgattggcctgactttcatccacaggtttgggaagcatgcaccacatgtggtccacatcaccatgagctacgtctactttctctttcctccattcatgaaccccattatatatagtatgaagaccaagcaaattcagagaggtttcattcgcctattttctctacacaatagggcttga

SEQ ID NO: 1052 - protein, 311 aa, Canis familiaris
MWSNNSAAPFLLTGFLGSEAIHHWISIPFFMIYFFILLGNGTLFFLIWNDSSLHEPMYYFLAMLAGTDLGMTLTTMPTVLGVLLLDQREISQGACFTQSYFIHTLAIVESGVLLAMAYDRFIAIRTPLRYNSILTNSRVMKVGLGVLMRGFMSIVPPIMPLYWFPYCRSHVLSHAFCLHQDVMKLACADITFNRVYPVILVALTFFLDALIILFSYILILKTVMGIASREERAKALNTCVSHISSVLVFYITVIGLTFIHRFGKHAPHVVHITMSYVYFLFPPFMNPIIYSMKTKQIQRGFIRLFSLHNRA

SEQ ID NO: 1053 - DNA, 936 bp, Canis familiaris
atgtggctcaatattagcactgccccctttttgctgactgggttcccaggtctggaggctgctcatcactggatctccatccccttctttgcagtctatatctctgtgcttcttggcaatggcactctcctctacctcatcaaggacgaccacagcctccatgaacccatgtactatttccttgccatgctggcaggtaccgatctaatggtgacattgactacgatgcctactgtaatgggcgtcttatggatgaatcaccgggagatgagccatggagcctgcttcctgcaggcttacttcattcattccctttccattgtggaatcgggtgtcttgcttgccatggcctatgaccgattcatcgccatccgcactcctctgaggtataactccattcttaccaattctcgggtgatgaaggtaggactgggtgtactactgaggggctttttatcccttgtgcctccaattgtgccactctactggttcccatattgccgttcccatgttctttcccacgccttttgcctccaccaagatgtcatgaaacttgcctgtgctgatattacatttaatcgtgtgtacccagtcattctggttgctttgactttcttcctagatgctctcattatcctcttctcttatattttaatcctgaagacagttatgggtattgcctctagagaagagagagctaaggcccttaacacctgtgtctcacatattagcagtgtcctggtcttttatattactgtgattggcctgactttcatccacaggtttgggaagcatgcaccacatgtggtccacatcaccatgagctatgtctactttctctttcctccattcatgaaccctgttatatatagtatcaagaccaagcaaattcagagaagcatcatttacctactttctgtgcacagaaggccttga

SEQ ID NO: 1054 - protein, 311 aa, Canis familiaris
MWLNISTAPFLLTGFPGLEAAHHWISIPFFAVYISVLLGNGTLLYLIKDDHSLHEPMYYFLAMLAGTDLMVTLTTMPTVMGVLWMNHREMSHGACFLQAYFIHSLSIVESGVLLAMAYDRFIAIRTPLRYNSILTNSRVMKVGLGVLLRGFLSLVPPIVPLYWFPYCRSHVLSHAFCLHQDVMKLACADITFNRVYPVILVALTFFLDALIILFSYILILKTVMGIASREERAKALNTCVSHISSVLVFYITVIGLTFIHRFGKHAPHVVHITMSYVYFLFPPFMNPVIYSIKTKQIQRSIIYLLSVHRRP

SEQ ID NO: 1055 - DNA, 1008 bp, Canis familiaris
atatggcccaaaattagcactgccccctttttgctgactgggttcccaggtctggaggctgctcatcactggatctccccacttttccccttctttgcagtctacatctctgtgcttcttggcaatggcactctcctctacctcatcaaggacgaccacagcctccatgaacccatgtactatttccttgccatgctggcaggtaccgatctgatggtgacattgactatgatgcctactgtaatgggcgtcttatggatgaatcaccgggagatgagccatggagcctgcttcctgcaggcttacttcattcattccctttccattgtggaatcagatgtcttgcttgccatggcctatgatcattttattgccatccacaatcctttgcgatacacttccattctcaccaatattcaagtggtaatgttagggatgggagcttttatgagggattttatattcatcatccctctaatcttgtatcattttattttttcatttccatattgccattctaatattctctcccatgctttctgtcttcatcaagaagtcatgaaactggcctgtgctgacataactttcaatagaccttaccctctatttttttctctttctttctttctttctttctttctttctttctttctttctttctttctttctttctttctttcttctttctttctctttctttttttttttttcctagattctctgatcatccttttctcctatatcctaattcttaagactgtcatgggcatagcctttggtgaagagagaaccgagtccctcaatacttgtatctcccacgctggctgtgtcctcatcttttatgtcactgtgattttgtcattaatccatcagtttgggaagaatgtgccaccagtggtccacattataatgagctatatctacttcctctttcctcctttaacgaatcctaccatctatagcatcaagacaaagcaaattcaatatggcattctctgccttttatcc

SEQ ID NO: 1056 - protein, 336 aa, Canis familiaris
IWPKISTAPFLLTGFPGLEAAHHWISPLFPFFAVYISVLLGNGTLLYLIKDDHSLHEPMYYFLAMLAGTDLMVTLTMMPTVMGVLWMNHREMSHGACFLQAYFIHSLSIVESDVLLAMAYDHFIAIHNPLRYTSILTNIQVVMLGMGAFMRDFIFIIPLILYHFIFSFPYCHSNILSHAFCLHQEVMKLACADITFNRPYPLFFSLSFFLSFFLSFFLSFFLSFFLSSFFLFLFFFFLDSLIILFSYILILKTVMGIAFGEERTESLNTCISHAGCVLIFYVTVILSLIHQFGKNVPPVVHIIMSYIYFLFPPLTNPTIYSIKTKQIQYGILCLLS

SEQ ID NO: 1057 - DNA, 954 bp, Canis familiaris
atgttcatgtctaataatgcctgtttggtgcctagttctttctggcttactggtattccagggctgcaatccctgcacatctggctctccatccccttcagctctatgtacctgatggctatagtggggaatgtgactatcctggcagtgataaaggtggaacgcagcctgcaccaacccatgtacttcttcctgtgcatgttggctgtcattgacttggtcctttcaacgtctaccatgcccaaactactagccatcttctggtttggtgcccacaacattgacctggatgcctgcttggctcagatgttcttcatccactgctttgccactgttgagtcaggaatcttccttgccatggcttttgatcgctatgtggccatatgtgacccattacgccacaccttggtgctcactcatgcagcagtgggtcgtttgggcttggctgccctcttccgtggagtactctacattgggcctctgcctctgatgattcgcctgaggctgcctcattaccagacccaaatcattgcccattcctattgtgagcacatggccatagttaccttagcatgtggtgacacaacagtcaacaacttgtatggaatgggaattggcttcctggtattgatcctagattcattagctatcactgcctcatatgtgatgattttcagggctgtaatggggttggccaccccagaggccaggcttaaaactctagggacatgtagttctcacatttgtgccattcttgtcttctatatccccattgctgtttcttctctcactcaccgctttggccatcatgtgcctcctcatatccatatccttttggccaacttttacctcctcattccacccattctcaacccagttgtctatgctgtccgtaccaaacagattcgagagagacttctctacattcttaaggcagggtctcaacccaagtga

SEQ ID NO: 1058 - protein, 317 aa, Canis familiaris
MFMSNNACLVPSSFWLTGIPGLQSLHIWLSIPFSSMYLMAIVGNVTILAVIKVERSLHQPMYFFLCMLAVIDLVLSTSTMPKLLAIFWFGAHNIDLDACLAQMFFIHCFATVESGIFLAMAFDRYVAICDPLRHTLVLTHAAVGRLGLAALFRGVLYIGPLPLMIRLRLPHYQTQIIAHSYCEHMAIVTLACGDTTVNNLYGMGIGFLVLILDSLAITASYVMIFRAVMGLATPEARLKTLGTCSSHICAILVFYIPIAVSSLTHRFGHHVPPHIHILLANFYLLIPPILNPVVYAVRTKQIRERLLYILKAGSQPK

SEQ ID NO: 1059 - DNA, 933 bp, Canis familiaris
atgtggcccaacatcagtgctgccccttttctactgactggcttcccaggtctggagatatttcatccttggatctcgatctccttctttgtcatttatgtctccatactcctcagcaatggtaccctcctcttccttatcagagaagaccacactctccatgagccaatgtactactttttggcgatactggcagccacagaccttggagtgactttgacaacgatgcctactgtgcttggtgttctatggcttgatcatagggccatcagccatgaagcctgctactttcaggcctatctaatccattcactctctattgtagagtctggagtcttgctcattatggcctatgatcgttttattgccatccgcaaccccctgagatacacttccattctcactaatgctaaggtggtgaagataggtctggggattctaatgaggggatttatcctcattgttcctataatcatcactctctctggattcccctactgcaaatcccatgtcctctcccatgctttctgcttacaccaggatgtgatcaaactggcctgtgccgacatcacctttaatagaatctatcctatagtcctggtctcattaactggtttcttggactctatacttattcttatctcttatattttaatccttaatactatcatgggaattgcctcaggtaaggagcgggctaaggctctaaacacttgtgtctcccacattagctgtgttctggttttttatgtcactgttactgggctgactctcattcatcgatttgggaaatatgtgcctcatatagttcatattatcatgagctatatatatttcctattccctccatttatgaatccaataatctatagtattaagacaaagcagataaggaatggtatcaatcaccttctctctttccatagaatttga

SEQ ID NO: 1060 - protein, 310 aa, Canis familiaris
MWPNISAAPFLLTGFPGLEIFHPWISISFFVIYVSILLSNGTLLFLIREDHTLHEPMYYFLAILAATDLGVTLTTMPTVLGVLWLDHRAISHEACYFQAYLIHSLSIVESGVLLIMAYDRFIAIRNPLRYTSILTNAKVVKIGLGILMRGFILIVPIIITLSGFPYCKSHVLSHAFCLHQDVIKLACADITFNRIYPIVLVSLTGFLDSILILISYILILNTIMGIASGKERAKALNTCVSHISCVLVFYVTVTGLTLIHRFGKYVPHIVHIIMSYIYFLFPPFMNPIIYSIKTKQIRNGINHLLSFHRI

SEQ ID NO: 1061 - DNA, 939 bp, Canis familiaris
atgtggcccaacagcagttccagttccttccttttgactggttttccaggcttggaggcagttcaccactggatttccacacccttctttttcatctacgtctctatccttttaggcaacagcactctccttcttctcattaaggaagatcacaatcttcatgagcctatgtactacttcctggccatgctggcagccacagacctagggctgactttgaccacaatgcctacagtgttgggagtcctctggttggatcacagggagattggaaaagtagcctgtttttctcaagcctactttatacactcacttgcctttgtagaatctggtgttttgcttgctatggcctatgatcgttttattgccatttgcaacccccttagatatagctctatactcactaataatcaagtgctgaaaattgggctaggagttctgatgagggggtttatatctgttgttcctccaatcttacccctttacttttttccctattgccattctcacatcctctcacatgcattctgccttcaccaggacgtcatcaaactggcctgtgctgataccaccttcaatcgcctatatccagttgtgcttgtagtcttgatatttgtgctggattctctgattatcctcatctcctatgtgttgatactcaagagagtcctgagtattgcctccaaagaagagagggccaagaccctcaacacctgtgtctcccatatctgctgtgtcctggttttctatgtcacagtgattggactgtctctgattcatcggtttggaaagcaggttccacatattgttcaccttactatgagctacatatattttattttccctccattaatgaatcctataatctatagtgtcaagaccaagcagatccagattggcatttttcgccttttcactacccatagaatcaaagtatga

SEQ ID NO: 1062 - protein, 312 aa, Canis familiaris
MWPNSSSSSFLLTGFPGLEAVHHWISTPFFFIYVSILLGNSTLLLLIKEDHNLHEPMYYFLAMLAATDLGLTLTTMPTVLGVLWLDHREIGKVACFSQAYFIHSLAFVESGVLLAMAYDRFIAICNPLRYSSILTNNQVLKIGLGVLMRGFISVVPPILPLYFFPYCHSHILSHAFCLHQDVIKLACADTTFNRLYPVVLVVLIFVLDSLIILISYVLILKRVLSIASKEERAKTLNTCVSHICCVLVFYVTVIGLSLIHRFGKQVPHIVHLTMSYIYFIFPPLMNPIIYSVKTKQIQIGIFRLFTTHRIKV

SEQ ID NO: 1063 - DNA, 939 bp, Canis familiaris
atgtggctcaacactactgtttccccatttctgcttactggcttcccaggcatggagaaggcacaccactggatttccatcccattattggtggtttatgtctccattattcttggtaatggcacccttctctttcttatcaaagatgatcatagccttcatgagcccatgtactattttttagctatgttggcagccacagaccttggagtgactttgaccacaatgcccacagttctgggtgtcctatggttaaatcacagagagattggccatcaggtctgtttctctcaggcctattttatccatactctttctattgtggaatctggtgttttgcttgccatggcctatgaccgtttcattgccatccgcaaccccttgagatatacttccatccttaccaataccaaggtaatgaagattgggataggggtattgacaagggctggtctgtcaattatgccaataattattcgccttcactggtttccctactgtcattcccatgtactttctcatgctttttgtctacaccaagatgtcattaagttagcctgtgctgacatcaccttcaatcgactctatccagttgtggttgtatttgcaatggtcttgttggactttctcatcatctttttctcctacattttgatcctcaagactgtcatgggcattgcttctggagaagaaagagccaaggccctcaacacctgtgtctctcacatctgttgtatcttggtcttctatgtcactgtagttggtctgacatttattcatagatttggaaaacatgctcctcatgtggtccacatcacaatgagctatatctacttcctcttccccccttttatgaaccctgttatctatagcattaaaaccaagcagatccagagtggtatagttcgtttattctctctgcctaattctagagcataa

SEQ ID NO: 1064 - protein, 312 aa, Canis familiaris
MWLNTTVSPFLLTGFPGMEKAHHWISIPLLVVYVSIILGNGTLLFLIKDDHSLHEPMYYFLAMLAATDLGVTLTTMPTVLGVLWLNHREIGHQVCFSQAYFIHTLSIVESGVLLAMAYDRFIAIRNPLRYTSILTNTKVMKIGIGVLTRAGLSIMPIIIRLHWFPYCHSHVLSHAFCLHQDVIKLACADITFNRLYPVVVVFAMVLLDFLIIFFSYILILKTVMGIASGEERAKALNTCVSHICCILVFYVTVVGLTFIHRFGKHAPHVVHITMSYIYFLFPPFMNPVIYSIKTKQIQSGIVRLFSLPNSRA

SEQ ID NO: 1065 - DNA, 954 bp, Canis familiaris
atgaaaatgcctattatggaactcaataccagtgctacaccctttctgctgactggcttcgtgggcctggaaaaagcacaccactggatctccatcccattatctgtcgtctatatctctatacttcttggcaatggcattctcctatttctcatcagggttgaccataacctccatgaacccatgtactatttcttagccctgctggcaaccacagacctagggatgaccctagttacaatgcctactgtgctgtgtgtgatgtggataaatcacagggaagtcagccatggcatctgctttctccaagcctacttcatccacagcctctctatgatagagtctggaattttgcttgccatggcctatgatcggtttattgccatccgcaacccactgagatatacttccattatcaccaacatccaagtgttaaagattggagtgggagttttcatgaggggatttgttctcatcttgcctccaatattgcctctctactggttttcctattgcagatcccatgtcctctctcatgcattctgtcttcaccaggatgttatcaaattagcctgtgctgacatcaccttcaatcgcctgtatcctgttgtggtggtattttctatggtcctaatggactgcttgataatattttgctcctatattttgatactccagactgtgatgagcattgcctctgaagaagagaggtccaaggccctcaacacttgtgtctcccacatctgctgcatcttggtcttctatgtcactgtttttggtttgacattcatccaccgatttgggaagaatgttccccatctagtacacatcataatgagctacatctacttccttttcccccctttcatgaaccctattatctatagtattaaaactaagcagattcgtggtagtatactccaattattttctctgtccccaccaagaacatga

SEQ ID NO: 1066 - protein, 317 aa, Canis familiaris
MKMPIMELNTSATPFLLTGFVGLEKAHHWISIPLSVVYISILLGNGILLFLIRVDHNLHEPMYYFLALLATTDLGMTLVTMPTVLCVMWINHREVSHGICFLQAYFIHSLSMIESGILLAMAYDRFIAIRNPLRYTSIITNIQVLKIGVGVFMRGFVLILPPILPLYWFSYCRSHVLSHAFCLHQDVIKLACADITFNRLYPVVVVFSMVLMDCLIIFCSYILILQTVMSIASEEERSKALNTCVSHICCILVFYVTVFGLTFIHRFGKNVPHLVHIIMSYIYFLFPPFMNPIIYSIKTKQIRGSILQLFSLSPPRT

SEQ ID NO: 1067 - DNA, 813 bp, Canis familiaris
gttactaactccactcaagtccccttttgcttcatccttaatggcatccctggctttgaggttttccataactggatttccatccccttttgttgtctctacactgtctccatcatgggcaataccaccatcctggcggtcatcaggacagagccctccctacataagcccatgtacttgttcctctctatgttggctgtaacagctctggggctcaccctcaccactttgcctacagtcatgggagtcctctggtttggggcctcagaaattagctttgaggcttgttttgcccagttcttcttcctccatggattctcctttatagaatcttctgtgttgctggccatgtcctttgatcgctatgtggccttctgccgtcccctgcattatgtctccatcctcaccaaccaagtaatcagaagaataggggtggccatcatttgccactgtgttctggctgttcctcccccattgctcctgctgaaacgattgcccttttgtggctcccaccagctttcccactcctactgcctccatcaagacatgatttgccgggtgtgtgctgacaccactgtcaataactggtatggatttgttctagctctggtcattattacactggaccccctgctcattgtgctttcctatgtactcatcctgagaagtgtcttgagaatcagctcccaggttgaaaggcttcgggcactcaataactgtctatcccatattctggctgttttggtcctctatgtgcccatggtgggattgtccatgactcaccgctttgccaagcatgcccctccaattgtc

SEQ ID NO: 1068 - protein, 271 aa, Canis familiaris
VTNSTQVPFCFILNGIPGFEVFHNWISIPFCCLYTVSIMGNTTILAVIRTEPSLHKPMYLFLSMLAVTALGLTLTTLPTVMGVLWFGASEISFEACFAQFFFLHGFSFIESSVLLAMSFDRYVAFCRPLHYVSILTNQVIRRIGVAIICHCVLAVPPPLLLLKRLPFCGSHQLSHSYCLHQDMICRVCADTTVNNWYGFVLALVIITLDPLLIVLSYVLILRSVLRISSQVERLRALNNCLSHILAVLVLYVPMVGLSMTHRFAKHAPPIV

SEQ ID NO: 1069 - DNA, 960 bp, Canis familiaris
atgctcttgtccaatatcactcagtttagccccatgttgtacctcactggctttcctggattagaaaccatcgaacactggatcttcatcccctttttccttatgtaccttgtggccatctcaggcaattgtttcattctgataattatcaagaccaaccatcgtctacacacacccatgtactatctactctcctttctggccttcactgacctgggactgtcagtgtcaactttgcccactactatgggaatcttttggttcaaatctcgtggtatctacttttcagcttgccaaatccagatgttctgtatccactcattttccttcatggagtcttcagtgctccttataatgtcctttgaccgctgtttggccatctgccacccccttaggtactcggtcattatcactagccagcgagtggtaagggcaggcctggctgtcatcttccggggacctgtggccctagttcctcttgtcgtcctcctgaagacttttccctactgtgggcctcgagtcctctcccattccttctgcctacaccaggaagtgatacacctggcctgcacagacacctccttcaacaacctgtatggactggcggtggtggtattcactatgatgctggacctggtgctcatcgcactgtcctatggggtcatcctgcgcactgtggcaagactggcctcccaagaggagcaactccgagccttccaaacatgtacctcacacctctgtgctgtgctgatattctttgtacccatggtggggctgtctctggtacaccgctttgggaagcatgtaccacttgctgtccaccttcttatggccaatgtctatctctttgtaccacccatgcttaatccaatcatatatagtattaagaccaaggagatccgtcatgttatcagcaagctcctgggtcttaggaaggtcagtgctgagtcctggggctaa

SEQ ID NO: 1070 - protein, 319 aa, Canis familiaris
MLLSNITQFSPMLYLTGFPGLETIEHWIFIPFFLMYLVAISGNCFILIIIKTNHRLHTPMYYLLSFLAFTDLGLSVSTLPTTMGIFWFKSRGIYFSACQIQMFCIHSFSFMESSVLLIMSFDRCLAICHPLRYSVIITSQRVVRAGLAVIFRGPVALVPLVVLLKTFPYCGPRVLSHSFCLHQEVIHLACTDTSFNNLYGLAVVVFTMMLDLVLIALSYGVILRTVARLASQEEQLRAFQTCTSHLCAVLIFFVPMVGLSLVHRFGKHVPLAVHLLMANVYLFVPPMLNPIIYSIKTKEIRHVISKLLGLRKVSAESWG

SEQ ID NO: 1071 - DNA, 954 bp, Canis familiaris
atgaggatatccaccctaccaagggccaacatgagcttctctacattcctgctaacaggtttcccaggcctggaatgggctcaccactggatctcactacccatttttgtaggatacttggtgaccctcataggtaatgctaccatcttgcatctggtacgaactgaaccttctctccagcagcccatgtactacttcttggccatcctggctgtgacagacttgggcctgtgcatgtccacgctgccctcagtgttaggtgtactgtggtttgacgcccggagggtgggcctggtgccgtgtgttctgcagcagcatttcctgcactccttctccttcatggagtcagctgtgctctttgctatggccctggaccgcctggtggccatccggttcccattgcattatgcatctgtgctcacaggtcctcgcgtggcactggccggggctgtgctgggtatgcgcagtgccgccatcacagctgcgccctcactgcatctgttgaagtttgactattgtcgcccagggtctctgtctcatgcctactgccttcaccaggacatgatccgcctggcctgctccgacacacgcttcaacagactctatgggttgtgcatcatcatgctggccatgggttcagatgtccttttcatcctgctctcctacgctgtcatcctccgcactgtgctggccatcgcttctgccggggagaggctcaaagccctcaatacttgtgtctcgcacatcctggctgtgctttgcttctatgtgcctgtgctaggcctttccatcgtgcacagatttggacaccacacttcgcccttagtgcacatcctcatgggcaccgtctccgtgctcttcccacccctgatgaaccccgttatctatagcatcaagacccagcagatccgcagggccatcctcaaggtggtttcactggggaagatacagtga

SEQ ID NO: 1072 - protein, 317 aa, Canis familiaris
MRISTLPRANMSFSTFLLTGFPGLEWAHHWISLPIFVGYLVTLIGNATILHLVRTEPSLQQPMYYFLAILAVTDLGLCMSTLPSVLGVLWFDARRVGLVPCVLQQHFLHSFSFMESAVLFAMALDRLVAIRFPLHYASVLTGPRVALAGAVLGMRSAAITAAPSLHLLKFDYCRPGSLSHAYCLHQDMIRLACSDTRFNRLYGLCIIMLAMGSDVLFILLSYAVILRTVLAIASAGERLKALNTCVSHILAVLCFYVPVLGLSIVHRFGHHTSPLVHILMGTVSVLFPPLMNPVIYSIKTQQIRRAILKVVSLGKIQ

SEQ ID NO: 1073 - DNA, 936 bp, Canis familiaris
atgttcaacagcagtcaattcaatcccaagtattttctgctaactggtctccctggtctggaggccctgtacccttggtttattgtcccattctgctccatatatcttgtggcccttgtgggcaatagcctggtcctggcagtgatcaggaaaaacaccactctgcaccagccgatgtacctttttctagctatgctggcctttgcagaacttggtgtctctgcttctacactgcccactgtgttgggcatcttcctttttggtgccaatgagatctgctttgaagcctgccttttacagatgttctccatacattgcttttccatcatggagtcaggagttctgctggccatgtctgtggaccgttttgtggccatctacaacccactgaggtacacagccatcctgaccaggccccgtattgctgctactggtgctgcacttggactgaagagtgtgatgctcatgttcccactgcctttcctcctgaagcgtctgcccttctgtggccacaatgtcctctcccactcctactgccttcactcagatctaattcagctgccctgtggggatacacgtcccaacagcattctggggctctgcattgttacttctacttttgggctggattcgctgctcatcatcctctcgtatgtgctgatcctctacacagtgctgggcattacctctggggagggaaggtgtaaggccctcaacacatgtgtgtcacatatgtgtgcagtgcttgtgtactatgtgcccatgatcagcgtggctctggtgcaccgcttcatgaagcacactgcacctgctctccgtctactcctggccaacatctatcttctggtgcctcctgtgctcaaccccatcatctacagtgttaagacaaaacagattcgccaggggctcatccaactctttcttccaagaaaataa

SEQ ID NO: 1074 - protein, 311 aa, Canis familiaris
MFNSSQFNPKYFLLTGLPGLEALYPWFIVPFCSIYLVALVGNSLVLAVIRKNTTLHQPMYLFLAMLAFAELGVSASTLPTVLGIFLFGANEICFEACLLQMFSIHCFSIMESGVLLAMSVDRFVAIYNPLRYTAILTRPRIAATGAALGLKSVMLMFPLPFLLKRLPFCGHNVLSHSYCLHSDLIQLPCGDTRPNSILGLCIVTSTFGLDSLLIILSYVLILYTVLGITSGEGRCKALNTCVSHMCAVLVYYVPMISVALVHRFMKHTAPALRLLLANIYLLVPPVLNPIIYSVKTKQIRQGLIQLFLPRK

SEQ ID NO: 1075 - DNA, 954 bp, Canis familiaris
atgaagaactccaatagttctttggagtctttacctacaactttcattctggttggcatcccagggctggaggcagagcacatttggatatccatccccttctgcctgatgtatattatcatcttccttgggaatggcaccattcttcatgtcatcagaacagaccccgccttgcaccagcccatgtacctctttcttgccatgttggccctggctgaagttggtgtctctgcaacaactctgcctacagttctaggcatcttcctttttggcaccactgagattaattttgatgcctgcctttttcagatgttcttcatccattctttctccattatggagtcagctgtgttgctggccatgtctgtggaccgatttgtggccatccataatccactgcgctatacagccatcctcaccctgccccgtatatttggcacaggaatgatcatggggctgaaaagcattattctcatggccccattacccatgctattaaggcatctgcccttctgtggccataatgtccttgcgcattcctattgcctccaccccaaccttatccatctaccttgtggggatgtttctatcaacaatatctatgggcttttcattgttacctctacttttgggctggattcactgcttattgtgatctcctatcggctcatactccacactgtactgagtatcactactgggaaggggaggaggaaggcactcaacacttgtggctcacatatctgtgctgtactcacttactatgtgcctatgattggcttatctatggtgcatcgccttggattccatgtgtcccctttggtgcacgctatgatggccaatgcttatctcttcttcccacctgttgtcaaccccattgtctacagcattaagaccaaagagatccattgtggcattgtacgaatgctctcacagaaaaaagcaagaatttaa

SEQ ID NO: 1076 - protein, 317 aa, Canis familiaris
MKNSNSSLESLPTTFILVGIPGLEAEHIWISIPFCLMYIIIFLGNGTILHVIRTDPALHQPMYLFLAMLALAEVGVSATTLPTVLGIFLFGTTEINFDACLFQMFFIHSFSIMESAVLLAMSVDRFVAIHNPLRYTAILTLPRIFGTGMIMGLKSIILMAPLPMLLRHLPFCGHNVLAHSYCLHPNLIHLPCGDVSINNIYGLFIVTSTFGLDSLLIVISYRLILHTVLSITTGKGRRKALNTCGSHICAVLTYYVPMIGLSMVHRLGFHVSPLVHAMMANAYLFFPPVVNPIVYSIKTKEIHCGIVRMLSQKKARI

SEQ ID NO: 1077 - DNA, 948 bp, Canis familiaris
atgcctgaggtcactaataccacccaagctcccttctacttcatcctcacgggcatccctggatttgaggctttccacatctggatctccatccccttctgctgcctctataccatctccatcgtggggaacaccaccattctcgctgtcatccgcacagagccatccctccaccagcccatgtacctgtttctctccatgctggccctgactgacctgggcctcaccctcactaccttgcccacagtcatgcagcttctctggttcaacattcccaagatcagctttgaagcttgctttgcccaattcttcttcctccatggattctccttcatggaatcttcagtcctattggccatgtcctttgatcgctatgtagccatctgccgccccctccattatgacaccatcctcaccagcgaagtcattggcaggattgggttggccatcattggccgctgtatcctggctgttctcccttcccttttcctactcaagcgcctgcctttctgccactcccatcttctctctcactcctattgcctccaccaggatatgatccgcctggtctgtgctgacatccgggtcaacagctggtatggatttgctctagttttgctcattattgtcatggaccctctgctcatcattctctcctacacgttcattctgaaaaatatcttgggcacagcctcctggactgagcggctccgggctctcaataactgtctatcccacattctggctgttctggtgctttatgtccccatgattggagtatccatgacccatcgatttgccaagcatgcctctccactggtccatgttatcatggccaatgtctacctgttggcacctcctgtgatgaaccccatcatttacagtgtcaagactaagcaaatccgccagggaatcttccatgtacttttccaaaggaaagtgtactaa

SEQ ID NO: 1078 - protein, 315 aa, Canis familiaris
MPEVTNTTQAPFYFILTGIPGFEAFHIWISIPFCCLYTISIVGNTTILAVIRTEPSLHQPMYLFLSMLALTDLGLTLTTLPTVMQLLWFNIPKISFEACFAQFFFLHGFSFMESSVLLAMSFDRYVAICRPLHYDTILTSEVIGRIGLAIIGRCILAVLPSLFLLKRLPFCHSHLLSHSYCLHQDMIRLVCADIRVNSWYGFALVLLIIVMDPLLIILSYTFILKNILGTASWTERLRALNNCLSHILAVLVLYVPMIGVSMTHRFAKHASPLVHVIMANVYLLAPPVMNPIIYSVKTKQIRQGIFHVLFQRKVY

SEQ ID NO: 1079 - DNA, 954 bp, Canis familiaris
atgtccaaggtgtctaacagcacccaagtccccttctactttatcctcacgggcatccctggatttgaggctttccacatctggatctccatccccttctgctgcctctataccatctccatcgtggggaacaccaccattctcgctgtcatccgcacagagccatccctccaccagcccatgtacctatttctctccatgctggccctgactgacctgggcctcaccctcaccaccttgcccacagtcatgcagcttctctggttcaacattcccaagatcagctttgaagcttgctttgcacaggtatttttcattcatacattctctttcatggaatcttcagtcctattggccatgtcctttgatcgctatgtagccatctgtcgccccctccattatgacaccatcctcaccagcgaagtcattggcaggattgggttggccatcattggccgctgtatcctggctgttctcccttcccttttcctactcaagcgcctgcctttctgccactcccatcttctctctcactcctattgcctccaccaggatatgatccgcctggtctgtgctgacatccgggtcaacagctggtatggatttgctctggttttgctcattattgtcatggaccctctgctcatcattctctcctacacgttcatcctgaaaaatatcttgggcacagcctcttggactgagcggctccgggctctcaataactgtctatcccacattctggctgttctggtgctttatgtccccatgattggagtatccatgacccatcgatttgccaagcatgcctctccactggtccatgttatcatggccaatgtctacctgttggcacctcctgtgatgaaccccatcatttacagtgtcaagactaagcagatccgccagggaattatccacctcatttcccaaagaaatatgtgcttaaaatga

SEQ ID NO: 1080 - protein, 317 aa, Canis familiaris
MSKVSNSTQVPFYFILTGIPGFEAFHIWISIPFCCLYTISIVGNTTILAVIRTEPSLHQPMYLFLSMLALTDLGLTLTTLPTVMQLLWFNIPKISFEACFAQVFFIHTFSFMESSVLLAMSFDRYVAICRPLHYDTILTSEVIGRIGLAIIGRCILAVLPSLFLLKRLPFCHSHLLSHSYCLHQDMIRLVCADIRVNSWYGFALVLLIIVMDPLLIILSYTFILKNILGTASWTERLRALNNCLSHILAVLVLYVPMIGVSMTHRFAKHASPLVHVIMANVYLLAPPVMNPIIYSVKTKQIRQGIIHLISQRNMCLK

SEQ ID NO: 1081 - DNA, 945 bp, Canis familiaris
atgggagctgaaagcaatgaaagtcttgacgtcctatctgtcttcctaactggcatcccaggattagagtcccagcatggctggctttccattcccttctccactatgtatgttgtggccattgtgggtaacagcctaatcatgatagcagtgcaggaggaccctgtgctacatgagcccatgtacctgtttctctccatgctggctgtgactgaggtgggtgtttctgtgtctacactgcccactgtcatgggtattctttggtttgatgcccaccagatcgattttgatggctgcctggctcagatgttcttcatccacaccttctcttgtatggagtcaggggtccttttggccatgagttatgaccgctttgtagccatctataatccactgcgatatactgccatcctaaccctgccccgtatcatctgcatgggtctgggaatcacactgaagagtgtgacacttatggccccacttcccatccttttgaagcaactgccttattgccacactaatgtcctctcccattcctactgtctccactcagacttgatccagctgccttgtgctgatactaagctcaatagtattctaggcttggccattgtcctggccacttttgggctggactcactgctcattgtggtctcttatgtgctgattctttacactgtgctgggcattgcttctgaggagggacggtggaaggccctcaacacgtgtgtatcacatatgtgtgcagtgcttgtgtactacgtgcctatgattggtgtgtctgtgatgcatcgtgctgccaagcatgcctcacccctggtccatacactcatgtctagcatatacctttttgtgccccctgtgctcaatcccatcatctacagtgtcaagaccaagccaatccgacagggaattttcaccttgttttcttgcaagaggaaatag

SEQ ID NO: 1082 - protein, 314 aa, Canis familiaris
MGAESNESLDVLSVFLTGIPGLESQHGWLSIPFSTMYVVAIVGNSLIMIAVQEDPVLHEPMYLFLSMLAVTEVGVSVSTLPTVMGILWFDAHQIDFDGCLAQMFFIHTFSCMESGVLLAMSYDRFVAIYNPLRYTAILTLPRIICMGLGITLKSVTLMAPLPILLKQLPYCHTNVLSHSYCLHSDLIQLPCADTKLNSILGLAIVLATFGLDSLLIVVSYVLILYTVLGIASEEGRWKALNTCVSHMCAVLVYYVPMIGVSVMHRAAKHASPLVHTLMSSIYLFVPPVLNPIIYSVKTKPIRQGIFTLFSCKRK

SEQ ID NO: 1083 - DNA, 945 bp, Canis familiaris
atgttgagcttcaatgatacccccttccatccagccacactccagctgacaggcattccggggatgcagacaggccatgcctgggttgccctggctttctgcatcctctacctaatttccatcataggcaacctcagcatcctcactctggtgattcgggagcctgcgctgcaccagcccatgtactacttcctctctatgctgtctctcaacgatctgggagtgtccttctctacacttcccactgtgcttgctaccttttgtttcaactaccaccatgttggcttcgatgcctgcttagttcagatgttcttcatccacactttctctttcatggaatcaggcatattgctggccatgagctttgatcgctttgtggctatttgtgacccattacgatatgccactgtgctcaccaacagccgcatcttggctatgggcctgggcatccttgccaagagtttcatcactctcttccctttcccttttctggtaaaacgactgcccttctgcaagggcagaattttgcatcattcatactgtctccatccagatctcatgaaagtggcctgtggagacatccatgttaacaacatctatgggctttttgtggtcattttcacctatggcatagactcagtgtttatcctgctttcctatgcattgattctgagagccgtgctggccatcgcatcccaggagcaacggctcaaagcactcaacacctgcatgtcacacatctgtgcagtgctggctttttatgtgcccataattgctgtctccatgatccatcgtttctggaaaagtgccccatctgttgttcatgtcatgatgtccaatgtctacctgtttgtaccccccgtgctcaacccgatcatctacagtgtgaagacaaaggagatacgcagagggatcttcaaagtcctctataaatcccagagctga

SEQ ID NO: 1084 - protein, 314 aa, Canis familiaris
MLSFNDTPFHPATLQLTGIPGMQTGHAWVALAFCILYLISIIGNLSILTLVIREPALHQPMYYFLSMLSLNDLGVSFSTLPTVLATFCFNYHHVGFDACLVQMFFIHTFSFMESGILLAMSFDRFVAICDPLRYATVLTNSRILAMGLGILAKSFITLFPFPFLVKRLPFCKGRILHHSYCLHPDLMKVACGDIHVNNIYGLFVVIFTYGIDSVFILLSYALILRAVLAIASQEQRLKALNTCMSHICAVLAFYVPIIAVSMIHRFWKSAPSVVHVMMSNVYLFVPPVLNPIIYSVKTKEIRRGIFKVLYKSQS

SEQ ID NO: 1085 - DNA, 939 bp, Canis familiaris
atgggactgttcaatgtcagtcatcctgcttccttcctcctgactggcatccctggtctggagagctctcactcctggctagcagggcccctctgtgtgatgtatgccgtggccctcggaggcaacactgtgatcctacaggccgtgcgagtggagcccagtctccacgagcccatgtactacttcctgtccatgctgtccttcagtgacgtggccatgtccatggccaccctgcccaccgtgctcagaaccttctgcctcaacgcccgcagcattgcttttgatgcctgtctgatccagatgtttctcattcattccttctccatgatggagtcagggattctgctggccatgagctttgaccgctatgtggccatttgtgatcctttgcactatgccactgtgctcaccaatggagtcattgctggaatcggcgtagctgtgactgcccggagcttcatcaccctctttccccttcccttcctcttcaagaggctgcctgtctgcagatccaatgttctttctcactcctattgcctgcacccagacatgatgaagctagcctgtgcagatatcactatcaacagcatctatggattctttgttcttatatccacctttggcatggacatgttttttatcttcctctcctatgtgctcattctgcgttcagtcatggccatcgcttcccgcaaggaacgcctgaaagctctcaacacatgtgtgtcacatatcttggttgtattagcattttatgtaccgatgattggggtttctgtagtgcaccgctttggggagcatgccccacgctacatacatgtcttcatgtccaacgtttacctctttgtacctcctgtgctcaaccctctcatttacagcgccaagacaaaggagatccgccgagccattgtccgtatgtttcaccgcatcaaaatgtga

SEQ ID NO: 1086 - protein, 312 aa, Canis familiaris
MGLFNVSHPASFLLTGIPGLESSHSWLAGPLCVMYAVALGGNTVILQAVRVEPSLHEPMYYFLSMLSFSDVAMSMATLPTVLRTFCLNARSIAFDACLIQMFLIHSFSMMESGILLAMSFDRYVAICDPLHYATVLTNGVIAGIGVAVTARSFITLFPLPFLFKRLPVCRSNVLSHSYCLHPDMMKLACADITINSIYGFFVLISTFGMDMFFIFLSYVLILRSVMAIASRKERLKALNTCVSHILVVLAFYVPMIGVSVVHRFGEHAPRYIHVFMSNVYLFVPPVLNPLIYSAKTKEIRRAIVRMFHRIKM

SEQ ID NO: 1087 - DNA, 957 bp, Canis familiaris
atgtctgccatgatcattttcaacctgagcaattacaacccaggacccttcattctggtgggaatccccggcctggagcattgccatgtgtggattgggattcccttctgtatcatctatgttgtggccctcgtgggaaactgtacccttctctacctcatcacagtggaacgtagccttcatgaacccatgtttttctttctctccatgctggccatgactgatctcatcctgtccacagctggtgttcccaaaacactcagtatcttttggcttggggctcgagaaatcacattcccagggtgtcttacacaaatgttcttcctccactatagctttgtcctagattcagccatcttgatggccatggcatttgatcgctatgtggccatctgctcccccctgagatataccactattctgacccccaggaccatcaccaagattgcagtaggcatctcctctcgaagcttctgcatcattctgccagttatattcttgcttacacgtttgcctttctgcaggacacacatcataccacacacatattgtgagcacataggtgtggcccggctcgcctgtgctgacatctccatcaacatctggtatggcttttgtgttcccatcatgacagtcatctcagatgtgattctcattgccgtttcttacaccctcatcctctgtgcggtcttccgcctgccctcccgagatgcccgccagaaggcccttggcacctgtggttcccatgtctgtgtcatcctcatgttttatacacctgcttttttctccatccttgctcatcgttttggacacaatgtctcccgcactttccacatcatgtttgccaatctctacattgttattcctcctgcactcaaccccattgtctatggagtgaagaccaagcagatcagagataaggtcatccttttgttttctaccaagggttcagaatga

SEQ ID NO: 1088 - protein, 318 aa, Canis familiaris
MSAMIIFNLSNYNPGPFILVGIPGLEHCHVWIGIPFCIIYVVALVGNCTLLYLITVERSLHEPMFFFLSMLAMTDLILSTAGVPKTLSIFWLGAREITFPGCLTQMFFLHYSFVLDSAILMAMAFDRYVAICSPLRYTTILTPRTITKIAVGISSRSFCIILPVIFLLTRLPFCRTHIIPHTYCEHIGVARLACADISINIWYGFCVPIMTVISDVILIAVSYTLILCAVFRLPSRDARQKALGTCGSHVCVILMFYTPAFFSILAHRFGHNVSRTFHIMFANLYIVIPPALNPIVYGVKTKQIRDKVILLFSTKGSE

SEQ ID NO: 1089 - DNA, 942 bp, Canis familiaris
atgtacaacctgagtagctacaacacaggtgacttcaccctcctgggcatccctggccttgagcagtaccacgtctggatcagcatccccttctgctttatctatctcgtggccattgtgggcaacagtatcctcctctacctcattgccgtggagcggagtcttcacgcacccatgttctttttcctttccatgctagccattacagatgtgatcttgtctaccacatgtgtccccaaatcccttaccgtcttctggcttggtccccagaaaatcagttttcctggttgcctcacccagttattctttctgcattatagctttgtcctggactcagctatactcctggccatggcatttgatcgctatgtggccatctgcttccccttgagatataccgctattctgacctccaggaccactgtcaaaattgttgtgggaatttccttcagaagtttctgcatttttgctccatgtgtttttcttgtaaatcgtctacctttttgcgggacacgcatcataccacacacatactgtgagcacataggtgtggcccggctcgcctgtgctgacatctccatcaacatctggtatggcttttgtgttcccatcatgacagtcatctcagatgtgattctcattgccgtttcttacaccctcatcctctgtgcggtcttccgcctgccctcccaagatgcccgccagaaggcccttggcacctgtggttcccatgtctgtgtcatcctcatgttctatataccagcattcttctccatccttgcccatcgctttggccataatgtcccccggacttttcacatcctctttgccaacctctatgtagttatgccacctgcactcaatcctattgtctacggagtaaagaccaagagtatctgggacaaagtcgttctcttgctcttccctcgtgggactcaatga

SEQ ID NO: 1090 - protein, 313 aa, Canis familiaris
MYNLSSYNTGDFTLLGIPGLEQYHVWISIPFCFIYLVAIVGNSILLYLIAVERSLHAPMFFFLSMLAITDVILSTTCVPKSLTVFWLGPQKISFPGCLTQLFFLHYSFVLDSAILLAMAFDRYVAICFPLRYTAILTSRTTVKIVVGISFRSFCIFAPCVFLVNRLPFCGTRIIPHTYCEHIGVARLACADISINIWYGFCVPIMTVISDVILIAVSYTLILCAVFRLPSQDARQKALGTCGSHVCVILMFYIPAFFSILAHRFGHNVPRTFHILFANLYVVMPPALNPIVYGVKTKSIWDKVVLLLFPRGTQ

SEQ ID NO: 1091 - DNA, 957 bp, Canis familiaris
atgtctgccatgatcattttcaacctgagcaattacaacccaggacccttcattctggtgggaatccccggcctggagcattgccatgtgtggattgggattcccttctgtatcatctatgttgtggccctcgtgggaaactgtacccttctctacctcatcacagtggaacgtagccttcatgaacccatgtttttctttctctccatgctggccatgactgatctcatcctgtccacagctggtgttcccaaatcactcagtatcttttggcttggggctcgagaaatcacattcccagggtgtcttacacaaatgttcttccaccactgtagctttgtcctagattcagccatcttgatggccatggcatttgatcgctatgtggccatctgctcccccctgagatatgccactattctgacccccaggaccatcaccaagattgcagtgggcatctcctgtcgaagcttctgcatcattctgccagttgtatttttgcttacacgtttgcctttctgcaggacacgcatcataccacacacatactgtgagcacataggtgtggcccggctcgcctgtgctgacatctccatcaacatctggtatggcttttgtgttcccatcatgacagtcatctcagatgtgattctcattgccgtttcttacaccctcatcctctgtgcggtcttccgcctgccctcccgagatgcccgccagaaggcccttggcacctgtggttcccatgtctgtgtcatcctcatgttctatataccagcattcttctccatccttgcccatcgttttgggcataatgtccctcgtacatttcacatcctctttgccaacctctatgtagttatcccacctgcactcaaccccattgtctatggagtgaaaaccaagcaaataagagaaagggtcatccttttattttctaccaagagttcagaatga

SEQ ID NO: 1092 - protein, 318 aa, Canis familiaris
MSAMIIFNLSNYNPGPFILVGIPGLEHCHVWIGIPFCIIYVVALVGNCTLLYLITVERSLHEPMFFFLSMLAMTDLILSTAGVPKSLSIFWLGAREITFPGCLTQMFFHHCSFVLDSAILMAMAFDRYVAICSPLRYATILTPRTITKIAVGISCRSFCIILPVVFLLTRLPFCRTRIIPHTYCEHIGVARLACADISINIWYGFCVPIMTVISDVILIAVSYTLILCAVFRLPSRDARQKALGTCGSHVCVILMFYIPAFFSILAHRFGHNVPRTFHILFANLYVVIPPALNPIVYGVKTKQIRERVILLFSTKSSE

SEQ ID NO: 1093 - DNA, 942 bp, Canis familiaris
atgtacaacctgagtagctacaacacaggtgacttcaccctcctgggcatccctggccttgagcagtaccacgtctggatcagcatccccttctgctttatctatctcgtggccattgtgggcaacagtatcctcctctacctcattgccgtggagcggagtcttcacgcacccatgttctttttcctttccatgctagccattacagatgtgatcttgtctaccacatgtgtccccaaatcccttaccgtcttctggcttggtccccagaaaatcagttttcctggttgcctcacccagttattctttctgcattatagctttgtcctggactcagctatactcctggccatggcatttgatcgctatgtggccatctgcttcctcttgagatataccgctattctgacctccaggaccactgtcaaaattgttgtgggaatttccttcagaagtttctgcatttttgctccatgtgtttttcttgtaaatcgtctacctttttgcgggacacgcatcataccacacacatactgtgagcacataggtgtggcccggctcgcctgtgctgacatctccatcaacatctggtatggcttttgtgttcccatcatgacagtcatctcagatgtgattctcattgccgtttcttacaccctcatcctctgtgcggtcttccgcctgccctcccaagatgcccgccagaaggcccttggcacctgtggttcccatgtctgtgtcatcctcatgttctatataccagcattcttctccatccttgcccatcgctttggccataatgtcccccggacttttcacatcctctttgccaacctctatgtagttatgccacctgcactcaatcctattgtctacggagtaaagaccaagagtatctgggacaaagtcgttctcttgctcttccctcgtgggactcaatga

SEQ ID NO: 1094 - protein, 313 aa, Canis familiaris
MYNLSSYNTGDFTLLGIPGLEQYHVWISIPFCFIYLVAIVGNSILLYLIAVERSLHAPMFFFLSMLAITDVILSTTCVPKSLTVFWLGPQKISFPGCLTQLFFLHYSFVLDSAILLAMAFDRYVAICFLLRYTAILTSRTTVKIVVGISFRSFCIFAPCVFLVNRLPFCGTRIIPHTYCEHIGVARLACADISINIWYGFCVPIMTVISDVILIAVSYTLILCAVFRLPSQDARQKALGTCGSHVCVILMFYIPAFFSILAHRFGHNVPRTFHILFANLYVVMPPALNPIVYGVKTKSIWDKVVLLLFPRGTQ

SEQ ID NO: 1095 - DNA, 957 bp, Canis familiaris
atgtctgccatgatcattttcaacctgagcaattacaacccaggacccttcattctggtgggaatccctggcctggagcattgccatgtgtggattgggattcccttctgtatcatctatgttgtggccctcgtgggaaactgtacccttctctacctcatcacagtggaacgtagccttcatgaacccatgtttttctttctctccatgctggccatgactgatctcatcctgtccacagctggtgttcccaaatcactcagtatcttttggcttggggctcgagaaatcacattcccagggtgtcttacacaaatgttcttccaccactgtagctttgtcctagattcagccatcttgatggccatggcatttgatcgctatgtggccatctgctcccccctgagatataccactattctgacccccaggaccatcaccaagattgcagtgggcatctcctttcgaagcttctgcatcattctgccagttgtattcttgcttacacgtttgcctttctgcaggacacgcatcataccacacacatactgtgagcacataggtgtggcccggctcgcctgtgctgacatctccatcaacatctggtatggcttttgtgttcccatcatgacagtcatctcagatgtgattctcattgccgtttcttacaccctcatcctctgtgcggtcttccgcctgccctcccgagatgcccgccagaaggcccttggcacctgtggttcccatgtctgtgtcatcctcatgttctatataccagcattcttctccatccttgcccatcgttttgggcataatgtccctcgtacatttcacatcctctttgccaacctctatgtagttatcccacctgcactcaaccccattgtctatggagtgaaaaccaagcaaataagagaaagggtcatccttttattttctaccaagagttcagaatga

SEQ ID NO: 1096 - protein, 318 aa, Canis familiaris
MSAMIIFNLSNYNPGPFILVGIPGLEHCHVWIGIPFCIIYVVALVGNCTLLYLITVERSLHEPMFFFLSMLAMTDLILSTAGVPKSLSIFWLGAREITFPGCLTQMFFHHCSFVLDSAILMAMAFDRYVAICSPLRYTTILTPRTITKIAVGISFRSFCIILPVVFLLTRLPFCRTRIIPHTYCEHIGVARLACADISINIWYGFCVPIMTVISDVILIAVSYTLILCAVFRLPSRDARQKALGTCGSHVCVILMFYIPAFFSILAHRFGHNVPRTFHILFANLYVVIPPALNPIVYGVKTKQIRERVILLFSTKSSE

SEQ ID NO: 1097 - DNA, 957 bp, Canis familiaris
atgtctgccatgatcattttcaacctgagcaattacaacccaggacccttcattctggtgggaatccccggcctggagcattgctatgtgtggattgggattcccttctgtatcatctatgttgtggccctcgtgggaaactgtacccttctctacctcatcacagtggaacgtagccttcatgaacccatgtttttctttctctccatgctggccatgactgatctcatcctgtccacagctggtgttcccaaatcactcagtatcttttggcttggggctcgagaaatcacattcccagggtgtcttacacaaatgttcttccaccactgtagctttgtcctagattcagccatcttgatggccatggcatttgatcgctatgtggccatctgctcccccctgagatataccactattctgacccccaggaccatcaccaagattgcagtgggcatctcctttcgaagcttctgcatcatcctgcctgatgtattcttgcttacacgtttgcctttctgcaggacacgcatcataccacacacatactgtgagcacataggtgtggcccggctcgcctgtgctgacatctccatcaacatctggtatggcttttgtgttcccatcatgacagtcatctcagatgtgattctcattgccgtttcttacaccctcatcctctgtgcggtcttccgcctgccctcccgagatgcccgccagaaggcccttggcacctgtggttcccatgtctgtgtcatcctcatgttctatataccagcattcttctccattcttgcccatcgctttggccataatgtccctcgtacttttcacatcctctttgccaacctctatattgttattccacctgcactcaaccccattgtctatggagtaaagaccacacagatccgacataaggtcatccttttgttttctaccaagggttcagaatga

SEQ ID NO: 1098 - protein, 318 aa, Canis familiaris
MSAMIIFNLSNYNPGPFILVGIPGLEHCYVWIGIPFCIIYVVALVGNCTLLYLITVERSLHEPMFFFLSMLAMTDLILSTAGVPKSLSIFWLGAREITFPGCLTQMFFHHCSFVLDSAILMAMAFDRYVAICSPLRYTTILTPRTITKIAVGISFRSFCIILPDVFLLTRLPFCRTRIIPHTYCEHIGVARLACADISINIWYGFCVPIMTVISDVILIAVSYTLILCAVFRLPSRDARQKALGTCGSHVCVILMFYIPAFFSILAHRFGHNVPRTFHILFANLYIVIPPALNPIVYGVKTTQIRHKVILLFSTKGSE

SEQ ID NO: 1099 - DNA, 501 bp, Canis familiaris
ctagagtccctatatatctggctttccatccccctcagctccatttacctggttgctgtggtggggaatgtcaccattctggctgtggtaaaggtggagcatagcctgcatcagcccatgtatttcttcctgtgtgttttggccgtcattgacctggttctgtctactatgcccaaaatgctgggaatcttctggtttggcgctgggaacattggcctggatgcctgcctggctcaagtgttcctcatccactactttgccacagtggagtccagcatcttccttgctgtaacttttaaccactgtgtagccatctgtaacctactctgttccactacagtatgagtgagcactgtggtgtgatgtttgggggtggctgccctcctctggggtatactctacattagacccctgcctttgataatccacctgtggctactcctttacaaagctcatgtcatctcccacgcctactgtgagcacatggatgtgagcaccttg

SEQ ID NO: 1100 - protein, 114 aa, Canis familiaris
LESLYIWLSIPLSSIYLVAVVGNVTILAVVKVEHSLHQPMYFFLCVLAVIDLVLSTMPKMLGIFWFGAGNIGLDACLAQVFLIHYFATVESSIFLAVTFNHCVAICNLLCSTTV

SEQ ID NO: 1101 - DNA, 975 bp, Canis familiaris
atgttggggataccttataaccacacaatggaaacccctgccaccttcttccttgtgggtatcccaggtttgcagtcttcacatctttggctggctatttcactgagtgcaacgtatatcatatctctgttaggaaacacactcataatgactgttatctggatggatttcactctacaagagcccatgtattgctttctgtatgttttggctgccgttgacattgttatggcctcctctgttgtacccaagatggtaagcatcttcttctcaggagatggctccatcagctttaatgcttgtttcactcagatgtattttgtccatgcagctacatctgtggagacggggctactgctagccatggcttttgaccgctatatagccatctgtaagcccctacactacaagagaattctcacacctaaattgatgctggtaatgagtgtggccatcaccatcagagctgtcatattcatgactccattgagttggatgttaagtcatctgcctttttgtggctccaatgtggttctccattcctactgtgaacacatagctgtggccaagctggcatgtgctgaccccatgcccagtagtctctacagtgtaattggctcctccattattgtgggctctgatgtagccctcattgctgcctcttatcacctaattctccgggcagtatgtggtctggcctcaaagaatgctcagctgaaagcattaagcacatgtggctctcatgtgggggttatggctctgtactatctacctgggatggcatcaatctatgtggcctggctagggagggatacagtgcctctgcatactcaagtactgttagctgatttgtatctgatcattccacccaccttaaaccctatcatttatggcctgaggaccaaacaaatacggaagcgaacatggaacttgctgatgaactgcctctttgaccactccaagctgggttcataa

SEQ ID NO: 1102 - protein, 324 aa, Canis familiaris
MLGIPYNHTMETPATFFLVGIPGLQSSHLWLAISLSATYIISLLGNTLIMTVIWMDFTLQEPMYCFLYVLAAVDIVMASSVVPKMVSIFFSGDGSISFNACFTQMYFVHAATSVETGLLLAMAFDRYIAICKPLHYKRILTPKLMLVMSVAITIRAVIFMTPLSWMLSHLPFCGSNVVLHSYCEHIAVAKLACADPMPSSLYSVIGSSIIVGSDVALIAASYHLILRAVCGLASKNAQLKALSTCGSHVGVMALYYLPGMASIYVAWLGRDTVPLHTQVLLADLYLIIPPTLNPIIYGLRTKQIRKRTWNLLMNCLFDHSKLGS

SEQ ID NO: 1103 - DNA, 1020 bp, Canis familiaris
atggaactggatcctgcactgcctgttctcaaccagactgtgctcacctctgggcctgggccttttgtcctgttgggggtgccaggactgcagaccttgcatgcctggctttcagtgcctgtgtgtctgctgtacatggctgctttggcagggaatgcccttctcttggggctggtagccactgacaagacacttcagacacccatgtaccagctgctggggcttctggcagccgcggacttggttctggccacatccacagtgcccaaagctctggctgtgctctggggcctgtcaggggagatctccttcgcagcctgcctagcccagctctttgtaacccatgtgaccttcattgctgagtcttcagtgctcctggccatggccatagaccgctatgtggccatctgtcagcctctgcgctatggggcactgcttacccagcgtgtggtgggcatagtggcagtagccgcagtgacccgtggtgcctgtgtcatggcacctccagtggccttgctccagagactgccttactgtgggcagcgggagctcccccacacctactgcgaacacatgggtgtggctcggctggcatgtggcgacacacgccccaacgtttggtatggcttggccaccacattgctgtctccagccctggacttagggctcattgctgcttcctatgccctcattctccgtgctgtatgtcgcctgccatcccatggtgcccgctgcaaagccttgggtacctgtggggcgcatgccagcgtcatcactcttttctacacccctgccctcttctctttcctggctcaccgttttggccgccacacagtgcccagtcatatccacatcctcctggctaacctctatgtggtggtgccacctgcccttaatcctgtggtctatggagtacgtacccagcagattgctcagaggctccggtacttgcttcggctctggtgggcaagggcagtaagggatgtgggccccgagagggcctcccgtggcagtgaatga

SEQ ID NO: 1104 - protein, 339 aa, Canis familiaris
MELDPALPVLNQTVLTSGPGPFVLLGVPGLQTLHAWLSVPVCLLYMAALAGNALLLGLVATDKTLQTPMYQLLGLLAAADLVLATSTVPKALAVLWGLSGEISFAACLAQLFVTHVTFIAESSVLLAMAIDRYVAICQPLRYGALLTQRVVGIVAVAAVTRGACVMAPPVALLQRLPYCGQRELPHTYCEHMGVARLACGDTRPNVWYGLATTLLSPALDLGLIAASYALILRAVCRLPSHGARCKALGTCGAHASVITLFYTPALFSFLAHRFGRHTVPSHIHILLANLYVVVPPALNPVVYGVRTQQIAQRLRYLLRLWWARAVRDVGPERASRGSE

SEQ ID NO: 1105 - DNA, 957 bp, Canis familiaris
atgtcaacctccaacctcagtgatgacagtcttccagccatcatgttcctgacaggaatcccagggctggagtgggctcatgcctggattgccatccccttctgtgccatgtatctggtagcactggctgggaatgctgccctcatcctggtcattgtgacagacagtgctcttcatgcacccatgtacctcttcctgtgtcttctctcattcactgacctggctctcagctcaaccaccgtgcccaaaatgctagccattttgtggctccatgctggagaaatttcctttggtggatgcctggcccagatgttttgtgtccattctatctatgctctggagtcctcagttcttctggccatggcctttgatcgctatgtagctatctgcaacccactgagatacacaaccattcttaaccatactgtaataggcaaaattggccttgttggcctcctccgcagcgtggccattgtctccccatttatcttcctgctgaggcgactgccttactgtgatcaccatgtcatggcacatacatactgtgagcacatgggcatcgctcgcctggcctgtggcaacatcactgtcaatattgtctatgggctgactgtggccctgctggccatgggtctggattccatcctcattgccatttcctatggctttatcctccacgctgtcttccgccttccatctcaagatgccaggcacaaggctctgagtacctgtggctcccacctcggggtcatcctggtcttctacattcctgccttcttctccttcctcacccatcgttttggccagcaccgagttcccaagaatgtgcacatctttctggcgaacctctatgtgctggtgcctcctgtgctcaatccaatcatctatggagctaggaccaaggagattcagagtcgactgctgagattccttcacttggggaaaattttaatgtga

SEQ ID NO: 1106 - protein, 318 aa, Canis familiaris
MSTSNLSDDSLPAIMFLTGIPGLEWAHAWIAIPFCAMYLVALAGNAALILVIVTDSALHAPMYLFLCLLSFTDLALSSTTVPKMLAILWLHAGEISFGGCLAQMFCVHSIYALESSVLLAMAFDRYVAICNPLRYTTILNHTVIGKIGLVGLLRSVAIVSPFIFLLRRLPYCDHHVMAHTYCEHMGIARLACGNITVNIVYGLTVALLAMGLDSILIAISYGFILHAVFRLPSQDARHKALSTCGSHLGVILVFYIPAFFSFLTHRFGQHRVPKNVHIFLANLYVLVPPVLNPIIYGARTKEIQSRLLRFLHLGKILM

SEQ ID NO: 1107 - DNA, 957 bp, Canis familiaris
atgtcaacctctaacctcagtgatgacagtcttccagccatcatgttcctgacgggaatcccagggctggagtgggctcatgcctggattgccatccccttctgtgccatgtatctggtagcactggctgggaatgctgccctcatcctggtcattgtgacagacagtgctcttcatgcacccatgtacctcttcctgtgccttctctcactcactgacttggctctcagctccaccaccgtgccgaagacattagcaattttgtggctccatgctggagaaatttcctttggtggatgcctggcccagatgttttgtgtccattctatctatgctctggagtcctcagttcttctggccatggcctttgatcgctatgtggctatttgcaacccactgagatatatgatcatcctcaaccgtagcatcataggcagaattggccttactggcatactccgtagtatcgctgttgtctccccgttcattttcttgctgaggcgactgccttactgtggtcaccatgtcatggcacatacatattgtgagcacatgggcattgctcgcctggcctgtggcaacatcactgtcaatattgtctatgggctgactgtggccctgctagctgtgggtctggattccatcctcattgccatttcctatggctttatcctccacgctgtcttccgccttccatctcaagatgccaggcacaaggctctgagtacctgtggctcccacctcggggtcatcctggtcttctacattcctgccttcttctccttcctcacccatcgttttggccagcaccgagttcccaagaatgtgcacatctttctggcgaacctctatgtgctggtgcctcctgtgctcaatccaatcatctatggggctaggaccaaggagattcggagtcggcttctgagactgcttcacttggggaaggtctcagtgtga

SEQ ID NO: 1108 - protein, 318 aa, Canis familiaris
MSTSNLSDDSLPAIMFLTGIPGLEWAHAWIAIPFCAMYLVALAGNAALILVIVTDSALHAPMYLFLCLLSLTDLALSSTTVPKTLAILWLHAGEISFGGCLAQMFCVHSIYALESSVLLAMAFDRYVAICNPLRYMIILNRSIIGRIGLTGILRSIAVVSPFIFLLRRLPYCGHHVMAHTYCEHMGIARLACGNITVNIVYGLTVALLAVGLDSILIAISYGFILHAVFRLPSQDARHKALSTCGSHLGVILVFYIPAFFSFLTHRFGQHRVPKNVHIFLANLYVLVPPVLNPIIYGARTKEIRSRLLRLLHLGKVSV

SEQ ID NO: 1109 - DNA, 948 bp, Canis familiaris
atgggtgccttcggaatcaatgcctctgatgctcccacctttatactgacaggcttcccaggaatggagtccatggaatcctggctatccttccctctctttctattctatgctgtctccattgtgggaaacactttgatcctcctcattgttaaggaggagcagagcttgcaccagcccatgtattacttcttgtctctcctttcaatcaatgacttgggagtgtccttttccacattgccaactgtgctggctgccctttgcttccatgcccgggtgatttcctttaatgcctgcttagcccaaatgtttttcatccatctcttctcttggacagagtctggaatccttctggctatgagcttcgatcgctatgtggccatctgcaaccccctgcgctatgctacagtgctcactaatgcctgcattgtggcaatgggcctgtgtattgtcctccgaagctttgccctcatccttgtcttcccactgctgctgcacagactgcccttctgtcacccccagaatatcctctcccatgcctactgccttcacgtggatatgattaagctggcatgtactgatgtctccctcaatagccactatggactttccattgtgctattcacctttggcctggactctgcactcatattcatctcttatgtactaatcttacgatcagtgattgccattgcttcccgagaggagcttatcaagacactgaacacatgtgtgtcccacatcctagctgtgctcatcttctatgtactcatggtgtgtgtgtccattgttcatcgctttggtgctggtctgcctcatgctgtccatatcctcatgtcaattctctacctctttgtgcctcccatgctcaatcctattatctattccatcaagacaaaggagatacgtcgcaggctcttcaagatgctctttaggcttaagtcctga

SEQ ID NO: 1110 - protein, 315 aa, Canis familiaris
MGAFGINASDAPTFILTGFPGMESMESWLSFPLFLFYAVSIVGNTLILLIVKEEQSLHQPMYYFLSLLSINDLGVSFSTLPTVLAALCFHARVISFNACLAQMFFIHLFSWTESGILLAMSFDRYVAICNPLRYATVLTNACIVAMGLCIVLRSFALILVFPLLLHRLPFCHPQNILSHAYCLHVDMIKLACTDVSLNSHYGLSIVLFTFGLDSALIFISYVLILRSVIAIASREELIKTLNTCVSHILAVLIFYVLMVCVSIVHRFGAGLPHAVHILMSILYLFVPPMLNPIIYSIKTKEIRRRLFKMLFRLKS

SEQ ID NO: 1111 - DNA, 906 bp, Canis familiaris
aacagctcagacttgcctcctttcaccctgtcagggttcccagggctggagacttcccaacattggatgtttctgctctttggtatcctctacattgtctccattgtgggcaatgcccttatccttttcatcatcaaggaggtacagagtttgcataagcctatgtactacttcctatccctgctgtcagttaatgacctaggtgtgtccttttccacactgcccaccgtgttggccacattttgcttaagagagatcggctttgattcttacatggctcaaatgttttttatccacctcttctcctttatggagtctggagttctcctggttatgagttttgaccgctatgtggccatctgtaaccccttgcgctatgccacagtgctcactgatgcacctgtggtggtgcgcctgggcatagctgttgtcatccgtggtttctgtatggttttcccactgcccttccttctgaagaggttgtccttctgcaaggccaatgtactctctcatccttactgcctgcatccagatctgatccgcttgccctgtggtgacattaccatcaataatatttttggtcaattcattgtcatctctaactttggtctggattctgctctcattctcctctcctacatgctcatcctgcgctctgtacttgctattgcctcccgggaggaaagacttaagaccctcaatacgtgtgtgtcacacatgtgtgctgtgcttatgttctttgtgcctatggtcggtgtgtccatggccgctcgctatgggaggcatgccccacagtatgtacatacactcatgtccctcatctacctttttgtacctcctatgctcaacccagtcatctattccatcaaaaccaaagagatccgtcaaaggctttgcaaaatacta

SEQ ID NO: 1112 - protein, 302 aa, Canis familiaris
NSSDLPPFTLSGFPGLETSQHWMFLLFGILYIVSIVGNALILFIIKEVQSLHKPMYYFLSLLSVNDLGVSFSTLPTVLATFCLREIGFDSYMAQMFFIHLFSFMESGVLLVMSFDRYVAICNPLRYATVLTDAPVVVRLGIAVVIRGFCMVFPLPFLLKRLSFCKANVLSHPYCLHPDLIRLPCGDITINNIFGQFIVISNFGLDSALILLSYMLILRSVLAIASREERLKTLNTCVSHMCAVLMFFVPMVGVSMAARYGRHAPQYVHTLMSLIYLFVPPMLNPVIYSIKTKEIRQRLCKIL

SEQ ID NO: 1113 - DNA, 945 bp, Canis familiaris
atgggaagttttgggactaacatctctagcactaccagcttctcactaacaggcttcccagagatggagggtctacaacactcgttagctgccctcctcttgctgctttatgctatttccatcctgggcaatatcctaatcctcgtcattataaaggaggagcagagcttgcaccagcctatgtactacttcttgtctctgttgtctgtcaatgacctgggtgtgtccttttctacattgcccactgtattggctgccttgtgctttcatgctccagagattgcctttgatgcctgcctgacccagatgttcttcatccactttttctcctggacagaatctgggatcctgctggccatgagttttgatcgctatgtggccatctgtaaccctctgcgttattcttcggtgctcactgatatccgtgtggctcacatgggcatatccatcatcatccgcagcttctgcatggttttcccattgcctttccttctgaagaggctgcctttctgtaaagccaatgtgttaacacattcctactgtttgcacccagacttgatccgcctgccttgtggagataccaccatcaacagcatgtatggcctgttcattgttatctctgcctttggtgtagactcagtgctcattctcctctcctacgtgcttatactgcactccatattggccattgcctcccaggaggagaggcttaagacactcaacacatgtgtgtcacacatatgtgctgtgctcatcttctatgtacccatggttagtgtgtccatggttcatcgatttgggaagcatgcccctgagtacatgcacaagttcatgtccctggtatatctctttgtgcctccaatgctcaacccaattatctattccattaaaactaaagaaattcgtaagaggctgtacaaaatgtttttgaagcctaatatttga

SEQ ID NO: 1114 - protein, 314 aa, Canis familiaris
MGSFGTNISSTTSFSLTGFPEMEGLQHSLAALLLLLYAISILGNILILVIIKEEQSLHQPMYYFLSLLSVNDLGVSFSTLPTVLAALCFHAPEIAFDACLTQMFFIHFFSWTESGILLAMSFDRYVAICNPLRYSSVLTDIRVAHMGISIIIRSFCMVFPLPFLLKRLPFCKANVLTHSYCLHPDLIRLPCGDTTINSMYGLFIVISAFGVDSVLILLSYVLILHSILAIASQEERLKTLNTCVSHICAVLIFYVPMVSVSMVHRFGKHAPEYMHKFMSLVYLFVPPMLNPIIYSIKTKEIRKRLYKMFLKPNI

SEQ ID NO: 1115 - DNA, 939 bp, Canis familiaris
atgggactgttcaatgtcagtcatcctgcttccttcctcctgactggcatccctggtctggagagctctcactcctggctagcagggcccctctgtgtgatgtatgccgtggccctcggaggcaacactgtgatcctacaggccgtgcgagtggagcccagtctccacgagcccatgtactacttcctgtccatgctgtccttcagtgacgtggccatgtccatggccaccctgcccaccgtgctcagaaccttctgcctcaacgcccgcagcattgcttttgatgcctgtctgatccagatgtttctcattcattccttctccatgatggagtcagggattctgctggccatgagctttgaccgctatgtggccatttgtgatcctttgcactatgccactgtgctcaccaatggagtcattgctggaatcggcgtagctgtgactgcccggagcttcatcaccctctttccccttcccttcctcttcaagaggctgcctgtctgcagatccaatgttctttctcactcctattgcctgcacccagacatgatgaagctagcctgtgctgatatcactatcaacagcatctatggactctttgttcttgtatccacctttggcatggacatgttttttattttcctctcctatgtgctcattctgcgttcagtcatggccatcgcttcccgcaaggaacgcctgaaagctctcaacacatgtgtgtcacatatcttggttgtattagcattttatgtaccaatgattggggtttctgtagtccaccgctttgggaagcatgccccacgctacatacatgtcctcatgtctaatgtttacctctttgtacctcctgtgctcaaccctctgatttatagtgccaagacaaaggagatccgccgagccattgtccgtatgtttcgccccatcagaatgtga

SEQ ID NO: 1116 - protein, 312 aa, Canis familiaris
MGLFNVSHPASFLLTGIPGLESSHSWLAGPLCVMYAVALGGNTVILQAVRVEPSLHEPMYYFLSMLSFSDVAMSMATLPTVLRTFCLNARSIAFDACLIQMFLIHSFSMMESGILLAMSFDRYVAICDPLHYATVLTNGVIAGIGVAVTARSFITLFPLPFLFKRLPVCRSNVLSHSYCLHPDMMKLACADITINSIYGLFVLVSTFGMDMFFIFLSYVLILRSVMAIASRKERLKALNTCVSHILVVLAFYVPMIGVSVVHRFGKHAPRYIHVLMSNVYLFVPPVLNPLIYSAKTKEIRRAIVRMFRPIRM

SEQ ID NO: 1117 - DNA, 948 bp, Canis familiaris
atgtacaacctgagtagctacaacacaggtgacttcaccctcctgggcatccctggtcttgagcagtaccacgtctggatcagcatccccttctgctttatctatcttgtggccattgtgggcaacagtatccttctctacctcattgctgtggagcggagtcttcacgcacccatgttctttttcctttccatgctagccattacagatgtgatcttgtctaccacatgtgtccccaaaacccttaccatcttctggcttggtccccagaaaatcagttttcctggttgtctcacccagttattctttctgcattatagctttgtcctggactcagctatactcctggccatggcatttgaccgctatgtggccatctgctcccctctgagatacaccactattctgaaccccaggaccactgtcaaaattgttgtgggaatttccttcagaagtttctgtgttatagttccatgtgttttccttgcaaatcgtctacctttctgcgggacacgcatcataccacacacatactgtgagcacataggtgtggcccgacttgcctgtgctgacatctccatcaacatctggtatggcttttgtgttcccatcatgacagtcatctcagatgtgattctcattgccgtttcttacaccctcatcctctgtgtagtcttccgcctcccctccctagatgcccgtcagaaggcccttggcacctgtggttcccatgtctgtgtcatcctcatgttctatataccagcattcttctccatccttgcccatcgctttgggcataatgtcccccgtacttttcacatcctctttgctaacctctatgtagttatgccacctgcactcaatcctattgtctatggagtaaagaccaagcagatccgggacaaagttattctcctgctctttccccagaaggttgcagtgatatag

SEQ ID NO: 1118 - protein, 315 aa, Canis familiaris
MYNLSSYNTGDFTLLGIPGLEQYHVWISIPFCFIYLVAIVGNSILLYLIAVERSLHAPMFFFLSMLAITDVILSTTCVPKTLTIFWLGPQKISFPGCLTQLFFLHYSFVLDSAILLAMAFDRYVAICSPLRYTTILNPRTTVKIVVGISFRSFCVIVPCVFLANRLPFCGTRIIPHTYCEHIGVARLACADISINIWYGFCVPIMTVISDVILIAVSYTLILCVVFRLPSLDARQKALGTCGSHVCVILMFYIPAFFSILAHRFGHNVPRTFHILFANLYVVMPPALNPIVYGVKTKQIRDKVILLLFPQKVAVI

SEQ ID NO: 1119 - DNA, 942 bp, Canis familiaris
atgtacaacctgagtagctacaacacaggtgacttcaccctcttgggcatccctggccttgagcagtaccacgtctggatcagcatccccttctgctttatctatctcatggccattgtgggcaacagtatccttctctacctcattgccatggagcggagtcttcacacacccatgttctttttcctttccatgctagccattacagatgtgatcttgtctaccacatgtgtccccaaaacccttaccgtcttctggcttggtccccagaaaatcagttttcctggttgcctcacccagttattctttctgcacagtagctttgtcctggactcagctatactcctggccatggcatttgaccgctatgtggccatctgctcccctctgagatacaccactattctgacccccaggaccatcaccaagattgcagtgggcatctcctgtcgaagcttctgcatcatcctgccagttatattcttgcttacacgcttgcctttctgcaggacacgcatcataccacacacatactgtgagcacataggtgtggcccggctcgcctgtgctgacatctccatcaacatctggtatggcttttgtgttcccatcatgacagtcatctcagatgtgattctcattgccgtttcttacaccctcatcctctgtgcggtcttccgcttgccctcccgagatgcccgccagaaggcccttggcacatgtggttcccatgtctgtgtcatcctcatgttttatacacctgcctttttctccatccttgctcatcgttttggacacaatgtctcccgcactttccacatcatgtttgccaacctctacattgttattccacctgcactcaaccccattgtctatggagtgaagaccaagcagatcagagataaggtcatccttttgttttctaccaagggttcagaatga

SEQ ID NO: 1120 - protein, 313 aa, Canis familiaris
MYNLSSYNTGDFTLLGIPGLEQYHVWISIPFCFIYLMAIVGNSILLYLIAMERSLHTPMFFFLSMLAITDVILSTTCVPKTLTVFWLGPQKISFPGCLTQLFFLHSSFVLDSAILLAMAFDRYVAICSPLRYTTILTPRTITKIAVGISCRSFCIILPVIFLLTRLPFCRTRIIPHTYCEHIGVARLACADISINIWYGFCVPIMTVISDVILIAVSYTLILCAVFRLPSRDARQKALGTCGSHVCVILMFYTPAFFSILAHRFGHNVSRTFHIMFANLYIVIPPALNPIVYGVKTKQIRDKVILLFSTKGSE

SEQ ID NO: 1121 - DNA, 888 bp, Canis familiaris
cacatgtggatctccatccctttctgtctgatgtacccagtggctgtgtcaggaaatgttatcctaatcagcatcgtggcagtggaacacagtcttcatgaacccatgtacctcttcctctccatgttggctttttgggatctgatgctatccacattcatagtacccaaagccctgagcatcttctggtttgatgatatggacatctcttttggggttgtgtaacccaactctttttttttttttaatgaattttgcctttttagtgaagtcaggcattctcttagcctctgcttttgattgctatgaacccttctgctctgcatagcagtggtcatctgctacccactgagatataccaccattctctgccatggtgtcattggtaaaatgggggtgctgtagtgctgaggaattttgcaactgttttccccattatcttcctagtggggaaagataatagaggtgtctgcccctctttttacaaacatcattgcccacacattctgtgaacacatgaggctggtaaagttggcttgtgctgttatcatcatcaacatctggcatggaatctctgtgtcattactcactattatgctagatatggtgacaatagtcatctcctatgagctcattcttgaggcagtcttcagactgccattccatgatggacaaattaaagccctcagcatgtgtggttctcacgtctgtgtcatcctcatgttctgccttccaggggttttcactgttattgctcagcgcttcagctgaaaaatccccaaccatggccacatcctgttggtcaatctctatgatgtccccataacaatcccaattatctatggagtaaagaccaaacatattcatgactgagtggccttgctattt

SEQ ID NO: 1122 - protein, 74 aa, Canis familiaris
HMWISIPFCLMYPVAVSGNVILISIVAVEHSLHEPMYLFLSMLAFWDLMLSTFIVPKALSIFWFDDMDISFGVV

SEQ ID NO: 1123 - DNA, 957 bp, Canis familiaris
atggttcctgtcatggccactccaaatggaactctggtccacccagcatatttcctgctggtgggcattcctggcctggggcctaacatacacttttggctagcttttccactgtgttttatgtatgccttggccaccctggggaacctggccattgtccttatcatccgtgtggaaaggcgcctgcatgagcccatgtacctcttcctggccatgctttctaccattgacctagtcctgtcttctgtcactatgcccaagatggccagcctcttcctgactggcatccaggagataggattcaatgtttgtctggctcagatgttccttatccatgctctgtcagccatggagtcagctgtcctgctggccatggcttttgaccgctttgtggccatctgccatccactgcggcatgcttctgtgctcacagggcctactgtggccaagattggactagctgcccttaccaggggatttgttttcttcttcccactgcccttcatcctgaagcggttgtcatattgccaaacacatactgtcacacactccttctgtttgcaccaagatattatgaagttgtcctgtactgataccatggttaatgtagtatatggactcttcattatcctctcagtgatgggtgtggactccctcttcattggcctctcctacatcctcatactgaagactgtattggatctgtcttctcggggcgcagcactcaaggcttttaacacatgcgtctcccatctctgtgctgtcctggtcttctatgtgcccctcattgggctctcagtggtgcacaggctggggggtcctacctccatgctccatgtggttatggctaatatctatcttctgctaccacctgtggtcaatcctgttgtctatggagccaagaccaaggagatccgttcacgggtcctccatatcttctcacagggtggtaggtga

SEQ ID NO: 1124 - protein, 318 aa, Canis familiaris
MVPVMATPNGTLVHPAYFLLVGIPGLGPNIHFWLAFPLCFMYALATLGNLAIVLIIRVERRLHEPMYLFLAMLSTIDLVLSSVTMPKMASLFLTGIQEIGFNVCLAQMFLIHALSAMESAVLLAMAFDRFVAICHPLRHASVLTGPTVAKIGLAALTRGFVFFFPLPFILKRLSYCQTHTVTHSFCLHQDIMKLSCTDTMVNVVYGLFIILSVMGVDSLFIGLSYILILKTVLDLSSRGAALKAFNTCVSHLCAVLVFYVPLIGLSVVHRLGGPTSMLHVVMANIYLLLPPVVNPVVYGAKTKEIRSRVLHIFSQGGR

SEQ ID NO: 1125 - DNA, 951 bp, Canis familiaris
atgatgtccacattgaatttaacaagtgtcaatccaagtgtcttcatgttggtggggatcccaggactggagcaattccacatctggattggaattcctttcttcgttatctacctggtggcccttgtaggtaatggcatccttctttacctcatcactatggaccacaacctccatgagcccatgttcttctttctctccatgttggcctctgcagacctcatattatgcaccacgtgtatgcccaaaacacttggcatattctggttgaaatctcagaaaatcacttttcctggctgccttacccagttgttctttcttcacttcagcttttttctggattcagccattttgttgggcatggcgtttgatcgttacatggccatttgctctcctttgagatacagaagtgttttgacacctaggacaatagtcaagatcatggtgggcattgtgggtcggagctttagtgtcattctgcctgttgttttcctggtgaaacgtttgcccttctgcaggacgcgaatcattcctcacacatactgtgaacatataggtgtggctcggctcgcctgcgcggacatctccatcaacatctggtatggctttgctgtgcctgtaatgactattatctcagacctgatcctcattggtatttcctattctctcatccttcatgctgttttccaccttccatccagagatgcccggcagaaagccctcagcacctgtggttctcatgtcagtgtcattctcatattctacacaccagccatgttctctgtccttactcatcgctttggccacaatatctctctcacctttcacatcatgtttgccaacctctatgtggcaatacctcctgcactcaatcctatcatttacggtgtaaaaaccaagcagatcagggacaagatcatccttctattctttcctaaagggatgcagtga

SEQ ID NO: 1126 - protein, 316 aa, Canis familiaris
MMSTLNLTSVNPSVFMLVGIPGLEQFHIWIGIPFFVIYLVALVGNGILLYLITMDHNLHEPMFFFLSMLASADLILCTTCMPKTLGIFWLKSQKITFPGCLTQLFFLHFSFFLDSAILLGMAFDRYMAICSPLRYRSVLTPRTIVKIMVGIVGRSFSVILPVVFLVKRLPFCRTRIIPHTYCEHIGVARLACADISINIWYGFAVPVMTIISDLILIGISYSLILHAVFHLPSRDARQKALSTCGSHVSVILIFYTPAMFSVLTHRFGHNISLTFHIMFANLYVAIPPALNPIIYGVKTKQIRDKIILLFFPKGMQ

SEQ ID NO: 1127 - DNA, 981 bp, Canis familiaris
atggccctttcatctgccaccagcccagctgctgtgaatgactctgacactcgagtggccggctgcctcctcattggcatccctgggctggagcatctgcacatctggctctccatccccttctgtactatgtatgcagctgccctggcaggcaatggcattttaatttgtgtcatcctctcccagccaagcctgcatgagcctatgtacatattcctgtccatgttggccagtgcggatatcttgctctccacttccaccatgcccaaagcactggccaacttctggctgggttcaagccatatttccttcgatggctgcctcacccagatgttcttcatccatttcctcttcgtggctgactctgcggtcctgctggccatggcctttgaccgctttgtggctatctgctaccctctgcgatattccacaatcctgacgaagacggtcattgggaagatcgttgctgccaccctgacccgcagcttcatcatcatgtttccatcagtctttcttctcaagcgcctgcactattgccggataaacatcattgcacacactttttgtgagcacatgggcatcgcccgtctgtcctgttctgatatctccatcaatatctggtatgggttggcagctgctctactctccacaggcctggacatcatccttatcactgtttcctacattcacatcctccaagctgtcttccacctcccttctcaaaatgcccggtccaaggccctgagcacgtgtggctcccatgtctgtgtcatcctactcttctatatccctgccctcttctctgtctttgcctacagatttggtaggaaacgcatcccacgctatgtccatatcctcttggctaacctctatgtggtcatcccacctatgctcaatcccattatttatggagtgaggaccaagcagatttgggaaggggttaaacagatgttttcacatcttgtccaggaatctaaataa

SEQ ID NO: 1128 - protein, 326 aa, Canis familiaris
MALSSATSPAAVNDSDTRVAGCLLIGIPGLEHLHIWLSIPFCTMYAAALAGNGILICVILSQPSLHEPMYIFLSMLASADILLSTSTMPKALANFWLGSSHISFDGCLTQMFFIHFLFVADSAVLLAMAFDRFVAICYPLRYSTILTKTVIGKIVAATLTRSFIIMFPSVFLLKRLHYCRINIIAHTFCEHMGIARLSCSDISINIWYGLAAALLSTGLDIILITVSYIHILQAVFHLPSQNARSKALSTCGSHVCVILLFYIPALFSVFAYRFGRKRIPRYVHILLANLYVVIPPMLNPIIYGVRTKQIWEGVKQMFSHLVQESK

SEQ ID NO: 1129 - DNA, 954 bp, Canis familiaris
atgactgccttaaaccacactgctgttagtcacacagtcttccagttgttgggtatccctgggctagaagaccagcacatgtggatttccatccccttcttcatttcctacgtcattgccctgcttgggaacagcttgctcatctgcattatcctcacaaagtgcagcctccatgaacccatgtacctcttcctctgaatgctggccggagcagacgttgtcctctccacgtgcacagtaccccaggccttggccatcttctggttccgtgctggggagatctccttggatcgctgcatcactcagttcttcatcatacattgcactttcatgtctgagtcagggatattgctggtgatggcctttgaccgctacattgccatatgctacccactgagatacaccactattcttacacaagcactgattgggaaaatcgtgactgtctttctgagaagtttttgtacacttttccccataatatttcttttgaaaagattgactttctgccaaaataataccattccacacaccttttgtgaacacattggcttggccaaatatgcttgtaatgacattcaagtgaacatctggtatggattttccatcctaatgttaacagtggttttagatgtagtgctaatttttgtttcctatgtgctgattctccatgctgtcttccacatcccttctcaagatgctcgccacaaagccctcaacacctgtggttcccacatctgtgtcatcatccttttttatgggcctggaatcttcacaatccttactcaacggtttggacgccacattccacctcatacccacatcttgttggctaatgtttgcatgcttgccccacctatgctcaatcccatcatttatgggatcaagaccaagcaaatccgggtgcaggtggttcatgtgttgttcacaaagcagaaatcactttggtttaaa

SEQ ID NO: 1130 - protein, 252 aa, Canis familiaris
MLAGADVVLSTCTVPQALAIFWFRAGEISLDRCITQFFIIHCTFMSESGILLVMAFDRYIAICYPLRYTTILTQALIGKIVTVFLRSFCTLFPIIFLLKRLTFCQNNTIPHTFCEHIGLAKYACNDIQVNIWYGFSILMLTVVLDVVLIFVSYVLILHAVFHIPSQDARHKALNTCGSHICVIILFYGPGIFTILTQRFGRHIPPHTHILLANVCMLAPPMLNPIIYGIKTKQIRVQVVHVLFTKQKSLWFK

SEQ ID NO: 1131 - DNA, 942 bp, Canis familiaris
atgtataatctgagctgttacgatcctggttcctttatccttgtggggatacctggcctggagaagtttcacatctggatcgggattcccttttgtgtcatctatgttctggctcttgtgggtaactgcaccctcctctacctcattgcagtggagcacagcctccatgagcccatgtttttcttcctagctatgctggctaccacggacctcatcctgtccactgccacagtgcccaaactgctcactaacctctggctgcactcccaggaaataaccttctctggctgtctcacccagatgtttttcctccacttcagctttgtagtcgactcagccatcctgttggccatggcatttgatcgctacgttgccatctgcttccccttgaggtacaccaccatcctgactcctcaggtgatcatcaagcttgcagcgagcattgttgtgaggagcttctctgtcatcttgccagatgtttttctgctgaaacggttacccttctgtgggacacgcatcataccacacacatactgtgagcacataggtgttgctcggcttgcctctgctgacatctccatcaacatctggtatggcttttctgtgcctcttatgactgtcatctcagatgtgatcattattgctgtttcctataccttcatcctccgtgctgtctttcagctctcatctcagggtgcccgccagaaggccctcagcacttgtggttctcatgtctgtgtcattctcatgttttacacacctgccttcttctccatccttgcccatcgctttgggcatagtgtccctcgaaatgtgcttatcctgtttgccaacctctatgtggccatcccccccgctctcaatcctattgtctatggagtgaagactaagcagatccaggacaaatttattctcctcttctctttgaagaagacacaatga

SEQ ID NO: 1132 - protein, 313 aa, Canis familiaris
MYNLSCYDPGSFILVGIPGLEKFHIWIGIPFCVIYVLALVGNCTLLYLIAVEHSLHEPMFFFLAMLATTDLILSTATVPKLLTNLWLHSQEITFSGCLTQMFFLHFSFVVDSAILLAMAFDRYVAICFPLRYTTILTPQVIIKLAASIVVRSFSVILPDVFLLKRLPFCGTRIIPHTYCEHIGVARLASADISINIWYGFSVPLMTVISDVIIIAVSYTFILRAVFQLSSQGARQKALSTCGSHVCVILMFYTPAFFSILAHRFGHSVPRNVLILFANLYVAIPPALNPIVYGVKTKQIQDKFILLFSLKKTQ

SEQ ID NO: 1133 - DNA, 948 bp, Canis familiaris
atggtggccacattcaacttgagcagcttcaatccgggcccattcatcttactgggaatcccagggctggaggagtttcatgtctggattgggattctcttctttattatctatcttgtggccctggcgggcaacagcatccttctctaccttatttccatggagcgtacccttcatgagcccatgttctttttcctctccatgctggctgctacagatgtcatcctgtctaatacatgtgtacccaaaacattcagcatcttctggctaggtcctcaggaaatcacttttcctgcatgccttactcagatgttctttctccactacagctttgctatggattctgctattctgctggctatggcatttgatcgctatgttgctatttgcttccccctaaggtatacgaatattctcacccgtcagattattactaagattgtagtggctattgtcagcaggagcttttgtatcatcttcccatgtgtcttcctattaaagagactgcctttttgccgaacactcttcattccacacacatactgtgagcacataggcatagcccaactagcctgtgcggatatctccatcaacatctggtatggattagctgtacctataatgactgtcacatcagacttgatccttattggcatctcctacggtctcatccttcgtgccgtctttaaccttccatctcgagatgcccgcaagaaagccctcaacacgtgtggttcccatgtttgtgtcattcttatattctatacaccagccatgttctctgtcctcacccaccgttttggtcacaatattcctcgctctttccacatactgactgccaacctctatgtagccatccctcctgcactcaatccaatcatctatggggtgaagaccaagcagattcgggagaaaatcatcttacccttcttctctaaagggaattag

SEQ ID NO: 1134 - protein, 315 aa, Canis familiaris
MVATFNLSSFNPGPFILLGIPGLEEFHVWIGILFFIIYLVALAGNSILLYLISMERTLHEPMFFFLSMLAATDVILSNTCVPKTFSIFWLGPQEITFPACLTQMFFLHYSFAMDSAILLAMAFDRYVAICFPLRYTNILTRQIITKIVVAIVSRSFCIIFPCVFLLKRLPFCRTLFIPHTYCEHIGIAQLACADISINIWYGLAVPIMTVTSDLILIGISYGLILRAVFNLPSRDARKKALNTCGSHVCVILIFYTPAMFSVLTHRFGHNIPRSFHILTANLYVAIPPALNPIIYGVKTKQIREKIILPFFSKGN

SEQ ID NO: 1135 - DNA, 951 bp, Canis familiaris
atgctttctgcatcggtcaccaatgacactgccttccatccctccacatttattctacttggaatccctgggatgcaagaccagcacatgtgggctgccatacccttctgctccatgtatatccttgctctggttggcaatggcaccatcctctacatcatcatgacagatagaactctgcatgagccaatgtacctcttcctgtgcctactttctatcaccgacctgattctctgttctaccacactgcccaagatgctaacaatcttctggctcaggtcccacataatttcctaccatggctgtctcacacaaatgttttttgttcacactatctttgccacagagtcagcagttctactggccatggcttttgaccgctatgtggctatctgccgtccgcttcattatacatccatcctcaatgctacagtgattgggaagattggtctggcatgtgtggtccgtggtcttctctttgtcttcccctttgttatcctcatcgaacgcttacccttctgtggacatcacatcatcccccacacctactgtgagcacatgggcattgccaagctggcttgtgccagcatcaagcccaacaccatttatggtctcactgtggcactttcagtcactggcatggatgtggtcctcattgccacctcctatggcctgatccttcgggcagtgctgcgcctaccctccaaggatgcccaattccgagcatttagcacttgtggagctcacatttgtgtgattcttgttttctatgtacctgcctttttttcctttttcacccaccgctttggccaccaagtacctcctcatgtccacattgtacttgcaaatctctaccttcttgtgccccctgttctcaaccccctggtctatggcattaataccaaacagatccgtctgagaatatttggcttttttatgggaaggaggtag

SEQ ID NO: 1136 - protein, 316 aa, Canis familiaris
MLSASVTNDTAFHPSTFILLGIPGMQDQHMWAAIPFCSMYILALVGNGTILYIIMTDRTLHEPMYLFLCLLSITDLILCSTTLPKMLTIFWLRSHIISYHGCLTQMFFVHTIFATESAVLLAMAFDRYVAICRPLHYTSILNATVIGKIGLACVVRGLLFVFPFVILIERLPFCGHHIIPHTYCEHMGIAKLACASIKPNTIYGLTVALSVTGMDVVLIATSYGLILRAVLRLPSKDAQFRAFSTCGAHICVILVFYVPAFFSFFTHRFGHQVPPHVHIVLANLYLLVPPVLNPLVYGINTKQIRLRIFGFFMGRR

SEQ ID NO: 1137 - DNA, 978 bp, Canis familiaris
atgactgtgtgcaatgtctccctggggcatcctcctttcttcattctccaaggcattcccgggatggaggacaaacacagatggatctctatccccttctgttccatgtacttcatcaccatccttgggaactgcaccatcatcttcatcatctgcacagagcgctccctgcacaagcccatgttcctgctcctctgcatgttggccctcacagacctgggcatgtccactaccaccattcccaaagtgctatgcatcttctggtttagacacagtgagatcagctatgtgggctgtctggtccaaatgttcttcattcactccatatcggccatgcagtctgccattctgatgaccatggcctttgaccgctacgtagccatctgtgagcccctgcgctatgccaccatcctttccaatagtcgcattgggctcattggcttagtgagtttagtaagagccatccttttcattctgcccatgcctgtcctcctccagaagatgccttttcatgcgaatcatgtcatccccaccacctactgtgaacacatggctgtggtgaagatggtgtgtgtggacaccacagtcaaccggatatatggtctggtggtggccttgttggttgccgggctagacatctcagctatcgcctcctcttatgtgcttatcatcaaggctgtcttgcgactgtcttctaaggaagcccaccacaaagcagtcaacacttgcaccactcatatctgtgtcatgcttatctcttacacgccctcattgttctctttcctcactcaccgctttggcaggggaattccactgcatgtgcacaccattcttggaagtctctacttccttgtacctccaatgctcaatcctattatttatgcagtgaaaaccaaggagtttcgggaaaaactgatcaaatatgggtactggaagaaggagctcaaaaccgttacccatggtccgaagcctgtctga

SEQ ID NO: 1138 - protein, 325 aa, Canis familiaris
MTVCNVSLGHPPFFILQGIPGMEDKHRWISIPFCSMYFITILGNCTIIFIICTERSLHKPMFLLLCMLALTDLGMSTTTIPKVLCIFWFRHSEISYVGCLVQMFFIHSISAMQSAILMTMAFDRYVAICEPLRYATILSNSRIGLIGLVSLVRAILFILPMPVLLQKMPFHANHVIPTTYCEHMAVVKMVCVDTTVNRIYGLVVALLVAGLDISAIASSYVLIIKAVLRLSSKEAHHKAVNTCTTHICVMLISYTPSLFSFLTHRFGRGIPLHVHTILGSLYFLVPPMLNPIIYAVKTKEFREKLIKYGYWKKELKTVTHGPKPV

SEQ ID NO: 1139 - DNA, 978 bp, Canis familiaris
atgactgtgtgcaatgtctccctggggcatcctcctttcttcattctccaaggcattcccgggatggaggacaaacacagatggatctctatccccttctgttccatgtacttcatcaccatccttgggaactgcaccatcatcttcatcatctgcacagagcgctccctgcacaagcccatgttcctgctcctctgcatgttggccctcacagacctgggcatgtccactaccaccattcccaaagtgctatgcatcttctggtttagacacagtgagatcagctatgtgggctgtctggtccaaatgttcttcattcactccatatctgtcatgcagtctgccattctgatgaccatggcctttgaccgctacgtagccatctgtgagcccctgcgctatgccaccatcctttccaatagtcgcattgggctcattggcttagtgagtttagtaagagccatccttttcattctgcccatgcctgtcctcctccagaagatgccttttcatgggaatcatgtcatccccaccacctactgtgaacacatggctgtggtgaagatggtgtgtgtggacaccacagtcaaccggatatatggtctggtggtggccttgttggttgccgggctagacatctcagctattgcctcctcttatgtgcttatcatccaggctgtcctgcggctgtcttctaaggaagcccaccacaaagcagtcaacacctgcactgcacacattgttgtcatgcttctctactatactccctcactgttctctttcctcactcaccgctttggcaggggaattccactgcatgtgcacaccattcttggaaacctctacttccttatacctccaatgctcaatcctattatttatgcagtgaaaaccaaggagtttcgggaaaaactgaccaaatatgggtactggatgaaaaagcacataatcagtaaccatggtcagaatcctttctaa

SEQ ID NO: 1140 - protein, 325 aa, Canis familiaris
MTVCNVSLGHPPFFILQGIPGMEDKHRWISIPFCSMYFITILGNCTIIFIICTERSLHKPMFLLLCMLALTDLGMSTTTIPKVLCIFWFRHSEISYVGCLVQMFFIHSISVMQSAILMTMAFDRYVAICEPLRYATILSNSRIGLIGLVSLVRAILFILPMPVLLQKMPFHGNHVIPTTYCEHMAVVKMVCVDTTVNRIYGLVVALLVAGLDISAIASSYVLIIQAVLRLSSKEAHHKAVNTCTAHIVVMLLYYTPSLFSFLTHRFGRGIPLHVHTILGNLYFLIPPMLNPIIYAVKTKEFREKLTKYGYWMKKHIISNHGQNPF

SEQ ID NO: 1141 - DNA, 978 bp, Canis familiaris
atgactgtgtgcaatgtctccctggggcatcctcctttcttcattctccaaggcattcccgggatggaggacaaacacagatggatctctatccccttctgttccatgtacttcatcaccatccttgggaactgcaccatcatcttcatcatctgcacagagcgctccctgcacaagcccatgttcctgctcctctgcatgttggccctcacagacctgggcatgtccactaccaccattcccaaagtgctatgcatcttctggtttagacacagtgagatcagctacgtgggctgtctggtccaaatgttcttcattcactccatatcggccatgcagtctgccattctgatgaccatggcctttgaccgctacgtagccatctgtgagcccctgcgctatgccaccatcctttccaatagtcgcattgggctcattggcttagtgggtttagtaagagccatccttttcattctgcccatgcctgtactcctccagaagatgccttttcatgcgaatcatgttatccccaccacctactgtgaacacatggctgtggtgaagatggtgtgtgtggacaccacagtcaaccggatatatggtctggtggtggccttgttagttgccgggatagacatctcagctattgcctcctcttatgtgcttatcatccaggctgtcctgcggctgtcttctaaggaagcccaccacaaagcagtcaacacctgcactgcacacattgttgtcatgcttctctactatactccctcactgttctctttcctcactcaccgctttggcaggggaattccaccccatgtgcacaccattcttggaaacctctacttccttatacctccaatgctcaatcctattatttatgcagtgaaaaccaaggagtttcgggaaaaactgaccaaatatgggtactggatgaaggagcacataatcagcaaccatggtcagaatcctttctaa

SEQ ID NO: 1142 - protein, 325 aa, Canis familiaris
MTVCNVSLGHPPFFILQGIPGMEDKHRWISIPFCSMYFITILGNCTIIFIICTERSLHKPMFLLLCMLALTDLGMSTTTIPKVLCIFWFRHSEISYVGCLVQMFFIHSISAMQSAILMTMAFDRYVAICEPLRYATILSNSRIGLIGLVGLVRAILFILPMPVLLQKMPFHANHVIPTTYCEHMAVVKMVCVDTTVNRIYGLVVALLVAGIDISAIASSYVLIIQAVLRLSSKEAHHKAVNTCTAHIVVMLLYYTPSLFSFLTHRFGRGIPPHVHTILGNLYFLIPPMLNPIIYAVKTKEFREKLTKYGYWMKEHIISNHGQNPF

SEQ ID NO: 1143 - DNA, 936 bp, Canis familiaris
atgttaatcttcaaccattccagcttcctgaccttcacattgatgggcataccaggcttagagtcacagcacttgtggttatctcttcctttctcctctatgtttttggctattctcattggcaatggtgctattctctttctggtggccatagaacccacattgcacagtccaatgtatctgctcctggccttgctgatggtggctgacctcatatctactctggcactgttgcccaagctcctctgcctcttcttgttcaatgatcgggacatagctgccaatgcctgcttcacccagatgtttttcatccatggaacatctgtggtacgatcagccctatttgtggcaatggcctttgaccgcttcgtggctgtgtgtgagcctttacgctacaacacaattctgagtcattccttagttggacgcctgggactgctggctttagccaagggtgtgattcttatcctacccatgcctcttctacttcgaagattgacattctgccaaatggtcattcctcatacctactgtgaccacatggctgtggtgaaaatggcctgtggccatacaagacctaaccgtatctatgggctctttgtgattcttcttgtggtgggacttgatttgctgctaattggtttctcttatggcctcatcttgcaatctgtggtacgcctcaactctcgagatgcaacttgcaaagccctcaacacctgttcagcccacttctttgtcattcttgtcacttatgtgcctgcactcttttcatctctcactcaccgcataggtcacaacatcccacctcatgctcatgttctccttgccaatctttatcttcttctaccctcagtactcaaccccatcatctatggcataaaaatgaaggaaatacggcacaaggtggccaaatgcctttgcagaggatctgcatag

SEQ ID NO: 1144 - protein, 311 aa, Canis familiaris
MLIFNHSSFLTFTLMGIPGLESQHLWLSLPFSSMFLAILIGNGAILFLVAIEPTLHSPMYLLLALLMVADLISTLALLPKLLCLFLFNDRDIAANACFTQMFFIHGTSVVRSALFVAMAFDRFVAVCEPLRYNTILSHSLVGRLGLLALAKGVILILPMPLLLRRLTFCQMVIPHTYCDHMAVVKMACGHTRPNRIYGLFVILLVVGLDLLLIGFSYGLILQSVVRLNSRDATCKALNTCSAHFFVILVTYVPALFSSLTHRIGHNIPPHAHVLLANLYLLLPSVLNPIIYGIKMKEIRHKVAKCLCRGSA

SEQ ID NO: 1145 - DNA, 954 bp, Canis familiaris; identical to SEQ ID NO: 13

SEQ ID NO: 1146 - protein, 317 aa, Canis familiaris; identical to SEQ ID NO: 43

SEQ ID NO: 1147 - DNA, 981 bp, Canis familiaris
atgcctagagcttttgtccagtctcctaatcacactaatctggacccttctgtttttttcctcctgggcatcccaggtctggaacaatttcacctgtggctctcactccccgtgtgctgcctgggcacagccacaattgtgggcaacattaccatcctggttgttgttgccactgaaccagccctgcacaagcctgtatatttgttcctctgcatgctctctaccattgacttggctgcctctttctccacagttcccaagctattggccatcctctggtgtggagctggacacatctctgcctctgcctgcctggcacagatgttcttcattcatgccttctgcatgatggagtctactgtgcttctggccatggcctttgatcgctatgtggccatttgtcacccactccgttatgctactatcctcacggacaccatcattgcccgaattggagtggtagctatggtgcggggctccatgctcatgctcccatgtcccttcctcattgggcgtttgagcttctgccaaagccatgtgatcccccacacatactgtgagcacatggctgttgtgaagctagcatgtggagataccaggcctaaccgtgtgtatgggctgacagcagcactattggtcataggggttgacttattctgcattggtctttcctatgtctttattgcacgggctgtcctccgtctttcatcccatgaagctcggtccaaggccttggggacctgtggttctcatgtctgtgtcatcctaatctcttatacaccagccctcttctccttttttacccatcgctttggccaccatgttccacttcatattcacattcttttggccaatgtttatctgctcttcccacctgctcttaaccctatggtatatggagttaaaaccaaagaaatccgggaaagggttatcagggtgtttcaaagggggcagggaactgggttaaaagtaccagagtga

SEQ ID NO: 1148 - protein, 326 aa, Canis familiaris
MPRAFVQSPNHTNLDPSVFFLLGIPGLEQFHLWLSLPVCCLGTATIVGNITILVVVATEPALHKPVYLFLCMLSTIDLAASFSTVPKLLAILWCGAGHISASACLAQMFFIHAFCMMESTVLLAMAFDRYVAICHPLRYATILTDTIIARIGVVAMVRGSMLMLPCPFLIGRLSFCQSHVIPHTYCEHMAVVKLACGDTRPNRVYGLTAALLVIGVDLFCIGLSYVFIARAVLRLSSHEARSKALGTCGSHVCVILISYTPALFSFFTHRFGHHVPLHIHILLANVYLLFPPALNPMVYGVKTKEIRERVIRVFQRGQGTGLKVPE

SEQ ID NO: 1149 - DNA, 969 bp, Canis familiaris
atgatgctaatgctgaaccaaacagacctgactccaggttcattcattcttaatgggatcccaggactggaagacatgcacatgtggatttccttcccattctgctccatgtatattgtggccatggtagggaattgtgggcttctctacctcatccactatgaggactccctgcacaggcccatgtactactttttagctatgctttccctaactgaccttttcatatgctctagtacaatccctaaagccctcagcatactctggttccatttcaaggaaatcagctttgatggatgcctggtccagatgttctttgtccatactttcacagggatggagtctggggttctcatgctcatggccctggaccgctatgtggccatctgctaccctctgcactattctactgccctcaccaattctgttattgcaaaggctgggctctccacctttctcagaggggtgttgctcatcattcccttcactttcctcacgaagcgcctgccctactgcagaggcaatataattccccacacctactgtgaccacatgtctgtagccaaattatcctgtggggacatcaaggtcaatgtcgtctatggtctgacagttgccctcctgattggaggctttgacatcctgtgcatcacaatctcctacaccatgatcctccgggcagtggtcagcctctcttcagcagatgctcgacagaaggccttcagcacctgcactgcccacatctgtgccattgttttctcctacagcccagccttcttctctttcttttcccaccgctttgggggccacacaatccctccctcttgccacatcattgtggccaatatttatttactcctgcctccagctatgaatcctgttgtctatggggtgaaaaccaagcagatacgagactgtattgtaaagatccttttgggttctaaggacatcaaatcccaaagcatatga

SEQ ID NO: 1150 - protein, 322 aa, Canis familiaris
MMLMLNQTDLTPGSFILNGIPGLEDMHMWISFPFCSMYIVAMVGNCGLLYLIHYEDSLHRPMYYFLAMLSLTDLFICSSTIPKALSILWFHFKEISFDGCLVQMFFVHTFTGMESGVLMLMALDRYVAICYPLHYSTALTNSVIAKAGLSTFLRGVLLIIPFTFLTKRLPYCRGNIIPHTYCDHMSVAKLSCGDIKVNVVYGLTVALLIGGFDILCITISYTMILRAVVSLSSADARQKAFSTCTAHICAIVFSYSPAFFSFFSHRFGGHTIPPSCHIIVANIYLLLPPAMNPVVYGVKTKQIRDCIVKILLGSKDIKSQSI

SEQ ID NO: 1151 - DNA, 972 bp, Canis familiaris
atgtctgcatttctgaaaggctctaatagctccaaattgcaggtctctgagttcatcctgttgggattcccaggtattcacagctggcagcattggctttccttaccattggcaatgctctatgtctcagcaattggtgctaacaccctcatcgtcgtcaccatctgccaagaccctgcgcttcagcagcctatgtactatttcctaggtattctctctgtggtggacattggcctggccaccaccatcatgcccaagattctggccatcttctggtttgatgccaagatcatcagcctccctgagtgttttgctcagatttatgccattcactgttttcttggcatggaatctggtaccttcctctgcatggcttttgatagatatatagcaatttgtcatcctcttcgatacccctcaattgtcaccaatggcttaatcttaaaagctactgtgttcatggtacttagaaatggcttgtttgttattccagtgcctgttcttgcagcccagcgtaattattgctccaggaatgagattgagcattgtctgtgctcaaaccttggggtcaccagcctggcttgtgatgacaggaggccaaacagcatctgccaattgattctggcatggcttggaatgggaagtgacctaggtcttataatattgtcatatactttgattctgcgctctgtgcttaagttgaactcggctgaagctgcatccaaagctttgagcacttgtagctcccatctgatccttatcctcttcttctacacagctgttgtagttgtttcagtaactcacctggcagagcctaaggctcctttgattccagttctactcaatgtgctgcacaatatcatccccccttccctcaaccctatggtatatgcacttaggactaaagaacttaggacaggcttccaaaaggtatttcgtttgagcttagaaaagaaaacaaggcaccagtga

SEQ ID NO: 1152 - protein, 323 aa, Canis familiaris
MSAFLKGSNSSKLQVSEFILLGFPGIHSWQHWLSLPLAMLYVSAIGANTLIVVTICQDPALQQPMYYFLGILSVVDIGLATTIMPKILAIFWFDAKIISLPECFAQIYAIHCFLGMESGTFLCMAFDRYIAICHPLRYPSIVTNGLILKATVFMVLRNGLFVIPVPVLAAQRNYCSRNEIEHCLCSNLGVTSLACDDRRPNSICQLILAWLGMGSDLGLIILSYTLILRSVLKLNSAEAASKALSTCSSHLILILFFYTAVVVVSVTHLAEPKAPLIPVLLNVLHNIIPPSLNPMVYALRTKELRTGFQKVFRLSLEKKTRHQ

SEQ ID NO: 1153 - DNA, 966 bp, Canis familiaris
atgataatattgaataaaacaaactggaccctggtctcattcattcttaatggagtcccaggactggaagacatgcatgtgtggatttccttcccattcttctccatgtatattgtggccatggtagggaattgtgggctgttatacctcatctactatgaggattcattgcacagacctatgtattactttttagccatgctttctcttactgatattgtcatgtgctctagtacaattcctaaagctctctgtatcttctggtttcatctcaaggacattggctttaatgaatgtttgctccagatgttcttcatccataccttcacagggatggagtctggagtgcttatgctcatggctctggaccgctatgtggccatctgctaccctctgcggtactcaactatcctcaccaatcatgtcattgcaaaggttgggcttgctactttcctgagaggggtgttgctcatcattcccttcactttcctcacgaagcgcctgtcctactgcagaggcaatataattccccacacctactgtgaccacatgtctgtagccaaattgtcttgtggcaatgtcaaggtcaatgccatctatggtctgatggttgccctcctaattggtggctttgacatcctgtgcatcacaatctcctacaccatgatcctccgggcagtggtcagcctctcttcagcagatgctcgacagaaggccttcagcacctgcactgctcacatctgtgccattgttttctcctacactccagccttcttctctttcttttcccaccgctttgggggccacacaatccctccctcttgccacatcattgtggccaatatttatctgctcttgcctcccactatgaaccctattgtttatggggtgaaaaccaagcagatacgagaccgtgtcataaggatcctttcagggtctaaggacatcaaatcccatggcatatag

SEQ ID NO: 1154 - protein, 321 aa, Canis familiaris
MIILNKTNWTLVSFILNGVPGLEDMHVWISFPFFSMYIVAMVGNCGLLYLIYYEDSLHRPMYYFLAMLSLTDIVMCSSTIPKALCIFWFHLKDIGFNECLLQMFFIHTFTGMESGVLMLMALDRYVAICYPLRYSTILTNHVIAKVGLATFLRGVLLIIPFTFLTKRLSYCRGNIIPHTYCDHMSVAKLSCGNVKVNAIYGLMVALLIGGFDILCITISYTMILRAVVSLSSADARQKAFSTCTAHICAIVFSYTPAFFSFFSHRFGGHTIPPSCHIIVANIYLLLPPTMNPIVYGVKTKQIRDRVIRILSGSKDIKSHGI

SEQ ID NO: 1155 - DNA, 966 bp, Canis familiaris
atgataattctgaatgaaacagatgtaacaccagtctcattcattcttaatgggatcccaggactggaagacatgcacatgtggatttccttcccattctgctccatgtatattgtggccatggtagggaattgtgggcttctatacctcatctgctatgaggactccttgcacagatccatgtattattttttggccatgctttcccttaccgaccttgttatgtgctctagtacaatccctaaagctctctgcatcttctggtttcatctcaagaaaattggatttgaagaatgcctagtccagatgttcttcatccataccttcacagggatggaatctggggtgctcatgctcatggccctggaccgctatgtggccatctgctaccctctgcgctatgcaaccatcctcaccaattctgtcattgcaaaggttgggcttgctacttttctgagagcagtgttgctcatcattcccttgattttcttcaccaagagactaccctattgcaagggcaatataatacaccatacctattgtgaccagctatctgtagccaagttatcctgtggaaatatcaaggccaatgttatctatggtctgatagctgcccttctgattggaggctttgacatcctgtgcatcacaatctcctacaccatgatcctccgggcagtggtcagcctctcttcagcagatgctcgacagaaggccttcagcacctgcactgcccacatctgtgccattgttttctcctacagtccagccttcttctgcttcttttttaatcgttttgggagccgtacaatccctccttcttgccacatcattgtggccaatatttatctgctcctgcctcccactatgaaccctattgtttatggagtgaaaaccaagcagatacgagactgtatcataaagatcttttcaggttctaagaacattaaatcccacagcacataa

SEQ ID NO: 1156 - protein, 321 aa, Canis familiaris
MIILNETDVTPVSFILNGIPGLEDMHMWISFPFCSMYIVAMVGNCGLLYLICYEDSLHRSMYYFLAMLSLTDLVMCSSTIPKALCIFWFHLKKIGFEECLVQMFFIHTFTGMESGVLMLMALDRYVAICYPLRYATILTNSVIAKVGLATFLRAVLLIIPLIFFTKRLPYCKGNIIHHTYCDQLSVAKLSCGNIKANVIYGLIAALLIGGFDILCITISYTMILRAVVSLSSADARQKAFSTCTAHICAIVFSYSPAFFCFFFNRFGSRTIPPSCHIIVANIYLLLPPTMNPIVYGVKTKQIRDCIIKIFSGSKNIKSHST

SEQ ID NO: 1157 - DNA, 867 bp, Canis familiaris
atgtcaatgctgagccaaacagtcctgaccccagtctcatttattcttaatgggatcccaggactggaagacatgaacatgtggattcccttcccattattctccatttatattgtggttatggtagggaattgtgggttgctttacctcacctgctatgaaaattccctgcacaggtccatgtactacttctttgctatgctttccctaactgatcttgttatgtgcacttctacaatccctaaagctctctgcatcttctggttccatcttaaggaaatcagctttaatgaatgcctggtccagatgttcttaatctatgcctcaatagggatggagtgtggtatgctcatactcatggccctggactgctatgcggccatctgctaccttctgcactactcaactatcctcaccaatcctggcattgcaaaggttgggcttgctacttttctgagagtagtgatgcttgtcactcccttgacttacaccatcaagagactaccctactgtagagggaatatactataccatacctattgtgaccacatgtcagtagccaagttatcctgtggaaatatcaaggtcagtgttatctacggactgatggttgccctcctatttggtggctttgacatcctgtgcatcacaatctcctacactatgatcagcctctctttagcagatgctccacagaaggccttcaccacttgcactgcccatatctgttccactgttttcttctatagcccagccttcttctgcttcttttcccactgctttgggggtcacaagatccctccttcttgccacatcattgtggccaatatttatctgctcttgcctcccactatgaaccctatgctt

SEQ ID NO: 1158 - protein, 289 aa, Canis familiaris
MSMLSQTVLTPVSFILNGIPGLEDMNMWIPFPLFSIYIVVMVGNCGLLYLTCYENSLHRSMYYFFAMLSLTDLVMCTSTIPKALCIFWFHLKEISFNECLVQMFLIYASIGMECGMLILMALDCYAAICYLLHYSTILTNPGIAKVGLATFLRVVMLVTPLTYTIKRLPYCRGNILYHTYCDHMSVAKLSCGNIKVSVIYGLMVALLFGGFDILCITISYTMISLSLADAPQKAFTTCTAHICSTVFFYSPAFFCFFSHCFGGHKIPPSCHIIVANIYLLLPPTMNPML

SEQ ID NO: 1159 - DNA, 960 bp, Canis familiaris
atgttccaggatcttagacattccaacatctctaagttccaggtctctgagttcattctgatgggattcccaggcattcacacctggcaacactggctctccctgcccctggcactactttacctcttagctctcactgccaacatccttatcctgattatcatcaaacaagaggctacactgcaccagcctatgtactatttcttggggatcctggctgtggtagacatgggactggctaccaccatcatgcccaagattttggccatcttatggttcagtgcaaaggccatcagtctccctgagtgctttgctcagatgtatgtcatacattgttttgtggccatggagtcaggtatctttgtctgcatggctatagacagatatgtagccatttgccaaccactacgttatccatcaatagttactgattcttttgtcgtcaaggcaactgtgttcatggcactcagaaacagtctggccaccatcccagtgccagtgttggctgctcagaggcactactgttccaagaaccaaattgagcattgcctatgctctaatcttggagtcactaggttatcctgtgatgacaggacaatcaacagcatctaccaggttcttttggcctggacactgatggggagtgacctgggtttgattttcttatcatatgctttgatacttcactcagtgctgaagctgaattcagcagaagctgcatccaaagccctaagtacctgtacttctcacctcattctaatcctgttcttctactcagttattatagtcatttccatcacccacagtgcaacaatgactcttcctctcatcccagttctgcttaatgtactacataatgttattcctcctgcccttaaccctatggtatatgcactcaagaacaaggacctcaggcagggcttctataaggttctgaatctgtacaacaaaggtaattaa

SEQ ID NO: 1160 - protein, 319 aa, Canis familiaris
MFQDLRHSNISKFQVSEFILMGFPGIHTWQHWLSLPLALLYLLALTANILILIIIKQEATLHQPMYYFLGILAVVDMGLATTIMPKILAILWFSAKAISLPECFAQMYVIHCFVAMESGIFVCMAIDRYVAICQPLRYPSIVTDSFVVKATVFMALRNSLATIPVPVLAAQRHYCSKNQIEHCLCSNLGVTRLSCDDRTINSIYQVLLAWTLMGSDLGLIFLSYALILHSVLKLNSAEAASKALSTCTSHLILILFFYSVIIVISITHSATMTLPLIPVLLNVLHNVIPPALNPMVYALKNKDLRQGFYKVLNLYNKGN

SEQ ID NO: 1161 - DNA, 960 bp, Canis familiaris
atgctccaggatcttggacattccaacatctcgaagtcccaagtctctgagttcattctgttgggattcccaggcattcacacctggcagcactggctctccctgcccctggcactgctttacctcttagctctcactgccaacatccttatcctgatcatcatcaaacaagaggccacactgcaccagcctatgtactattttttggggatcctggctgtggtagacatgggactggctaccaccatcatgcccaagattttggccatcttatggtttagtgcaaaggccatcagtctccctgagtgctttgctcagatgtatgtcatacattgttttgtgggcatggagtcaggtatctttgtctgcatggctatagacagatatgtagccatttgccaaccactacgctatccatcaatagttactgattcttttgtcgtcaaggcaactgtgttcatggcactcagaaacagtctggccaccatcccagtgccaatgttggctgctcagaggcactactgttccaagaaccaaattgagcattgcctatgctctaatcttggagtcactaggttatcctgtgatgacaggacaatcaacagcatctaccagctgtttcttgcctggacactgatggggagtgacctgggtttgattttcttatcatatgctctgatacttcactcagtgctgaagctgaattcagcagaagctgcatccaaagccctaagtacctgtacttctcacctcattctaatcctgttcttctacacagttgtcattgttatttccattacccacagtgcaacaatgactcttcccctcatcccagttctgcttaatgtactacacaatgttattcctcctgcccttaaccctatggtatatgcactcaagaacaaggagctcaggcagggcttctataagattctgaagctggacaacaagggtaactaa

SEQ ID NO: 1162 - protein, 319 aa, Canis familiaris
MLQDLGHSNISKSQVSEFILLGFPGIHTWQHWLSLPLALLYLLALTANILILIIIKQEATLHQPMYYFLGILAVVDMGLATTIMPKILAILWFSAKAISLPECFAQMYVIHCFVGMESGIFVCMAIDRYVAICQPLRYPSIVTDSFVVKATVFMALRNSLATIPVPMLAAQRHYCSKNQIEHCLCSNLGVTRLSCDDRTINSIYQLFLAWTLMGSDLGLIFLSYALILHSVLKLNSAEAASKALSTCTSHLILILFFYTVVIVISITHSATMTLPLIPVLLNVLHNVIPPALNPMVYALKNKELRQGFYKILKLDNKGN

SEQ ID NO: 1163 - DNA, 960 bp, Canis familiaris
atgctccaggatcttggacattccaacatctcgaagtcccaagtctctgagttcattctgatgggattcccaggcattcacacctggcagcactggctctccctgcccctggcactactttacctcttagctctcactgccaacatccttatcctgatcatcatcaaacaagaggccacactgcaccagcctatgtactattttttggggatcctggctgtggtagacatgggactggctaccaccatcatgcccaagattttggccatcttatggttcagtgcaaaggccattggtctccctgaatgctttgctcagatgtatgtcatacattgttttgtactcatggagtcaggtatctttgtctgcatggctatagacagatatgtagccatttgccaaccactacgctatccatcaatagttactgattcttttgtcgccaaggcaactgtgtttatggcactcagaaacagtctggctaccatcccagtgccagtgttggccgctgagaggcactactgttccaagaaccaaattgagcattgcctatgctctaatcttggagtcactaggttatcctgtgatgacagaaccatcaacagcatctaccagctatttcttgcctggacactgatggggagtgacctgggtttgatttttttatcatatgctttgatactccactcagtgctgaagctgaattcagcagaagctgcatccaaagccctaagtacctgtacttcccatctcatcctaattttattcttttacactgtcattgttgtcatttctattacccacagtgcaacaatgactcttcccctcatcccagttctgcttaatgtactacacaatgttattcctcctgccctcaatcccatagtgtatgcattcaaaaacaaggagctcaggcagggcttctataaggctcttaagctgaatatcaagggcaactaa

SEQ ID NO: 1164 - protein, 319 aa, Canis familiaris
MLQDLGHSNISKSQVSEFILMGFPGIHTWQHWLSLPLALLYLLALTANILILIIIKQEATLHQPMYYFLGILAVVDMGLATTIMPKILAILWFSAKAIGLPECFAQMYVIHCFVLMESGIFVCMAIDRYVAICQPLRYPSIVTDSFVAKATVFMALRNSLATIPVPVLAAERHYCSKNQIEHCLCSNLGVTRLSCDDRTINSIYQLFLAWTLMGSDLGLIFLSYALILHSVLKLNSAEAASKALSTCTSHLILILFFYTVIVVISITHSATMTLPLIPVLLNVLHNVIPPALNPIVYAFKNKELRQGFYKALKLNIKGN

SEQ ID NO: 1165 - DNA, 963 bp, Canis familiaris
atgtcattcctaaatggtacctacctaactccagcttcattcatcttaaatggcatccctgggctggaagaagtacatttgtggatctccttgcccttgtgcaccatgtacagcattgccatcacagggaactttggcctcatgtacctcatttactctgaagagaccttgcacagacctatgtacatcttcctagctcttctttccttcacagatgtgctcatgtgcaccagcactcttcccaacacactctgcatattgtggttcaacctcaaggagattgattttaaggcctgcttggcccaaatgttctttgtgcacacttttacagggatggagtctggggtgctcatgctcatggctctggaccgctatgtggccatctgctaccccctgcgctatgctactatcctcactaattcagtcattgccaaggctggactcctcacttttcttagaggtgtaatgcttgttatccctttcacttaccttaccaagcgcctgccatactgcaggggcaatgtcataccgcacacctactgtgaccacatgtctgtggccaaggtatcctgtggcaatgttaggatcaatgccatctatggtttaatggttgcccttctgattgggggctttgatatcttatgcatcacaatttcctacacaatgatccttcgagcagttgtgagtctctcatcagcagatgctcagcagaaggccttcagcacatgtactgcccacatctgtgccattgtcatcacctatgtcccagccttcttcaccttctttacccaccggtttgggggacacaccattcctccacacatacacattattatggctaatctctatctgctcatgcctcccacaatgaaccctattgtgtatggggtgaaaaccaagcagatacgagaaagtgtcattagattcttgcttaagggaaagggcaattctcatagcatttaa

SEQ ID NO: 1166 - protein, 320 aa, Canis familiaris
MSFLNGTYLTPASFILNGIPGLEEVHLWISLPLCTMYSIAITGNFGLMYLIYSEETLHRPMYIFLALLSFTDVLMCTSTLPNTLCILWFNLKEIDFKACLAQMFFVHTFTGMESGVLMLMALDRYVAICYPLRYATILTNSVIAKAGLLTFLRGVMLVIPFTYLTKRLPYCRGNVIPHTYCDHMSVAKVSCGNVRINAIYGLMVALLIGGFDILCITISYTMILRAVVSLSSADAQQKAFSTCTAHICAIVITYVPAFFTFFTHRFGGHTIPPHIHIIMANLYLLMPPTMNPIVYGVKTKQIRESVIRFLLKGKGNSHSI

SEQ ID NO: 1167 - DNA, 963 bp, Canis familiaris
atgctcctttcccactcctatgtcaacatctccttcttccagccacatgccttcctgatgattggcatcccagggctggaggctgttcatggatggatctccatccccttctctttcatgtacactgtggccctcactggaaactgcttgattctcttggctgtgaggagaactcccagcttgcaccaacccatgtactacttcctgtccatgctggccctcactgatgtgggccttactctgtccacactgcccaccaccctggctgtgctctggtttaattatcggcacataggcttcaatgcttgcttggtccagatgttcttcctccactccttctctgtggtggagtcatcagtgctcctggccatgtcatttgaccgctttgtggccatctctaaccctcttcactatgcagctatcctcaccaataatgtcattattaggattgggctggccattgtggcccgtgctaccctgtctctcttcccagtgcccttccttcttaaacgtctgaacttctgccctgacaagattctcttgtcccactcattctgtttccatcctgatgtgatgagaagagcctgtgctgacatcaccataaacattcactatgggctctatgtggtactgtccactggtggcatagattctctgttcatcatcctctcctatgttctcatcctacacacagtcctaggactggcctccccccgggagcgcatccgggccttcaacacctgtgtttctcatatcctggctgtctttgtcttcttcatcccaggcattactatgtccatgatccaccgttttgggaggcacctacccactgttgtacatgccctggttgcctatgtgtacctggtggtgccccctgtgctcaaccccatcatctacagtgtgaaatccaagcccatcagggaggccatgattaggatgctaaagaggaaaggccaaggttga

SEQ ID NO: 1168 - protein, 320 aa, Canis familiaris
MLLSHSYVNISFFQPHAFLMIGIPGLEAVHGWISIPFSFMYTVALTGNCLILLAVRRTPSLHQPMYYFLSMLALTDVGLTLSTLPTTLAVLWFNYRHIGFNACLVQMFFLHSFSVVESSVLLAMSFDRFVAISNPLHYAAILTNNVIIRIGLAIVARATLSLFPVPFLLKRLNFCPDKILLSHSFCFHPDVMRRACADITINIHYGLYVVLSTGGIDSLFIILSYVLILHTVLGLASPRERIRAFNTCVSHILAVFVFFIPGITMSMIHRFGRHLPTVVHALVAYVYLVVPPVLNPIIYSVKSKPIREAMIRMLKRKGQG

SEQ ID NO: 1169 - DNA, 960 bp, Canis familiaris
atgcatggagccaacagctccagcctgacaccaagatacttcatccttaatgggattcctgaactagaagccttacacacttggatctccctgccattctgcttcatgtacatcatcactgtcctggggaactgtgggctcatctacctcatcagccatgaggaggccctgcatcggcccatgtattacttcctagctttactgtcccttacagatgttagtgtgtgcacttcatttgttcctaatatgttatgtatcttttggttcaacctcaaagagattgactttgatgcctgccttgtgcagatgtttttcatccacatgctgaccggtatggagtctggcgtgctcatgcttatggccctggaccgctatgtggccatttgctaccctctacgttattctaccatcctcaccaacatggtaattaccaaagttgggtttgccaccttcagtcgaagtgtgttgctcatgatcccattcactttcctgattaggcgtcttccctactgcaagggcaacctcattcaccacacctactgtgaccatatgtctgtagccaaactgtcctgtggcaacatcaagattaatgccatctatggtctcatagctgccatactgataggaggatttgatatgttctgtatcttcatgtcttacaccatgattatccgtgctgtagtgaatctgccatcttcagatgctcggcacaaagccttcagcacctgtacatcacacatatgtgctattgtcatcacctatgtcccagccttcttcaacttttttactcatcgttttgggggacgcaccatacctcaccatgttcacatttttatagccaatctctacctgttgttgcctcccaccttgaatccaattgtctatggagtgaaaaccaagcagatccgtgaaggagtgatcaaattgtttttagagagaaatattttgaggatgagctaa

SEQ ID NO: 1170 - protein, 319 aa, Canis familiaris
MHGANSSSLTPRYFILNGIPELEALHTWISLPFCFMYIITVLGNCGLIYLISHEEALHRPMYYFLALLSLTDVSVCTSFVPNMLCIFWFNLKEIDFDACLVQMFFIHMLTGMESGVLMLMALDRYVAICYPLRYSTILTNMVITKVGFATFSRSVLLMIPFTFLIRRLPYCKGNLIHHTYCDHMSVAKLSCGNIKINAIYGLIAAILIGGFDMFCIFMSYTMIIRAVVNLPSSDARHKAFSTCTSHICAIVITYVPAFFNFFTHRFGGRTIPHHVHIFIANLYLLLPPTLNPIVYGVKTKQIREGVIKLFLERNILRMS

SEQ ID NO: 1171 - DNA, 963 bp, Canis familiaris
atgtgtggggaaaacagctccagcctggccccaggattctttgtcttgaatggtatccctgggctggaagctgcacacacctggatcgccctgccattctgcttcatgtacatcatcactgtcctggggaactgtgggctcatctacctcatcagccatgaggaggccctgcatcagcccatgtactacttcctggccctgctctccttcacagatgtcaccctgtgcaccaccacggtacccaatatgctgtgcatattctggttcaacctcaaggagattcactttaatgcctgcctggctcagatgttttttgtccatatgctgactgggatggagtctggggtgctcatgctcatggccctggaccgctacgtggccatctgccaccccttacgttattccaccatcctcaccaaccctgtcatcaccaaggcaggtcttgccacgttcctgaggggtgtgctgctcatcctcccattcacattcctcaccaagcgtctgccctattgccgaagcaactttattccccatacctactgtgaccacatgtctgtggccaaggtgtcctgtggcaatttcaaggtcaatgctatctatggtctcttggcagccctcctgattggaggctttgatatgttctgtatttctgtgtcttacactatgatactgagggcagtagtgagcctgtcatctgcagatgctcgtcacaaagccttcagcacctgcacatcccacatatgtgctattgttatcacttatgttccagcgctgttcaccatttttactcatcgttttgggggacaaagcattccccaccatgtgcatattcttattgctaatctctatttgatgttgcctcctactctgaatcccattgtttacggagtcaagaccaagcagatccaggaaggagtcatcaagttattttttaaagagaaagatgtcttagttatgaaatag

SEQ ID NO: 1172 - protein, 320 aa, Canis familiaris
MCGENSSSLAPGFFVLNGIPGLEAAHTWIALPFCFMYIITVLGNCGLIYLISHEEALHQPMYYFLALLSFTDVTLCTTTVPNMLCIFWFNLKEIHFNACLAQMFFVHMLTGMESGVLMLMALDRYVAICHPLRYSTILTNPVITKAGLATFLRGVLLILPFTFLTKRLPYCRSNFIPHTYCDHMSVAKVSCGNFKVNAIYGLLAALLIGGFDMFCISVSYTMILRAVVSLSSADARHKAFSTCTSHICAIVITYVPALFTIFTHRFGGQSIPHHVHILIANLYLMLPPTLNPIVYGVKTKQIQEGVIKLFFKEKDVLVMK

SEQ ID NO: 1173 - DNA, 972 bp, Canis familiaris
atgtgtggggaaaacagctccagcctggccccaggattctttgtcttgaatggtatccctgggctggaagctgcacacacctggatcaccctgccattctgcttcatgtacatcaccgctgtcctggggaactgtgggctcatctacctcatcagccatgaggaggccctgcatcggcccatgtactacttcctggccctgctctccttcacagatgtcaccctgtgcaccaccacggtacccaatatgctgtgcatattctggttcaacctcaaggagattcactttaatgcctgcctggctcagatgttttttgtccatatgctgactgggatggagtctggggtgctcatgctcatggccctggaccgctacgtggccatctgccaccccttacgttattccaccatcctcaccaaccctgtcatcaccaaggcaggtcttgccacgttcctgaggggtgtgctgctcatcctcccattcacattcctcaccaagcgtctgccctattgccgaagcaactttattccccatacctactgtgaccacatgtctgtggccaaggtgtcctgtggcaatttcaaggtcaatgctatctatggcttaatggttgctctccttattggtgtgtttgatatatgctgtatttctgtgtcttacactatgatattgagggcagtagtgagcctgtcatctgcagatgctcgtcacaaagccttcagcacctgcacatcccacatatgtgctattgtcatcacttatgttccagcttttttcacattttttgcccaccgttttggaggacacaatatcccccaccacatacacgtcattgtagccaacatttacttgctactgcctcctacaatgaacccaattgtttatggagttaagaccaagcagatccgggaaggtgtgatcaagtttttagttggagataggttgtctttacccaagacaaataaatcataa

SEQ ID NO: 1174 - protein, 323 aa, Canis familiaris
MCGENSSSLAPGFFVLNGIPGLEAAHTWITLPFCFMYITAVLGNCGLIYLISHEEALHRPMYYFLALLSFTDVTLCTTTVPNMLCIFWFNLKEIHFNACLAQMFFVHMLTGMESGVLMLMALDRYVAICHPLRYSTILTNPVITKAGLATFLRGVLLILPFTFLTKRLPYCRSNFIPHTYCDHMSVAKVSCGNFKVNAIYGLMVALLIGVFDICCISVSYTMILRAVVSLSSADARHKAFSTCTSHICAIVITYVPAFFTFFAHRFGGHNIPHHIHVIVANIYLLLPPTMNPIVYGVKTKQIREGVIKFLVGDRLSLPKTNKS

SEQ ID NO: 1175 - DNA, 438 bp, Canis familiaris
tttcctcttcgctatgccactatcctcaccaattctatcgttgccaaggccaagtttctcaccttccctctaggtgtgatacttgccattccatttacattactcaccaaacatcttccctatcgcaagggtaatataatttcccatacccactgtgatcacatgactgtggccaagttgtcctgtggcaatatcaaggtcaatgccatctatagtctgatggttgcccttctgattggggactttgacatcctgtgcatcacagtctcctactccatgattctctgggcagtggtcagcctctcctcagcagatgctcagcagaaggcctttagcacctgaactgcccaaatctgtgctatagtcatcacctatgtctcagccttccttacttttttttactcaccatttagggggtcatacagccctccacagctt

SEQ ID NO: 1176 - protein, 113 aa, Canis familiaris
FPLRYATILTNSIVAKAKFLTFPLGVILAIPFTLLTKHLPYRKGNIISHTHCDHMTVAKLSCGNIKVNAIYSLMVALLIGDFDILCITVSYSMILWAVVSLSSADAQQKAFST

SEQ ID NO: 1177 - DNA, 939 bp, Canis familiaris
atgtccccctcaaatgataccaagtctcatccctcctatttcctcctactgggagttccaggccttgaagagatgcacatctggattgggtttcctttttgttttgtgtatttgattgcccttgtgggaaacatcattatcctgtttgtgatcaagaatgaacacagtcttcatcagcctatgttttacttcttggccatgttagcctccattgatgtgggtctatcgacatccactatccccaaaatgttgggcatattctggtttaatttaaaagagattagttttgatggctgtgtcacccaaatgttctttattcatatattcactgccatggagactgttgcattggtggccatggcctttgaccgccatgttaccatctgcaatcctctgagatacagcctgattctcacgaacaggatgatttgtctcatccttgttgtggtgtttggtgtcaatttcattttggttatccctctggtgtttcttattttgaggctttccttctgtggacaccatataatcccacatacatactgtgagcacatgggaattgctcggctggcctgtgccagtataaaagtaaatatgatatttggattatttcttgtatcagtggtgtttgttgatgttgttctgattgtcatttcctatgtgaaaatactctgagctgtcttctgcctttcttctcaggatgccagactcaaggtacttaatacatgtggctcccatatctgtattattctagccttcttcactccagcttttttctctgtcttgacccatcgttttggcagggatgttcccatatacatatacattcacattctcctggccaatctatatgttgttgttccacctgccctcaatcctctcatctatggagtaaggacaaagcaaattcgggaaagggtttcaagtatcttttggaaaaaa

SEQ ID NO: 1178 - protein, 223 aa, Canis familiaris
MSPSNDTKSHPSYFLLLGVPGLEEMHIWIGFPFCFVYLIALVGNIIILFVIKNEHSLHQPMFYFLAMLASIDVGLSTSTIPKMLGIFWFNLKEISFDGCVTQMFFIHIFTAMETVALVAMAFDRHVTICNPLRYSLILTNRMICLILVVVFGVNFILVIPLVFLILRLSFCGHHIIPHTYCEHMGIARLACASIKVNMIFGLFLVSVVFVDVVLIVISYVKIL

SEQ ID NO: 1179 - DNA, 942 bp, Canis familiaris
atgtctccagccaatacatcatgtattcacccctcatccttcctgctgttgggaatcccaggactggaaaatatgcagttctggcttggtatcccatttggtacggtgtatctgattgccctcctggggaatgtcatcatcctttttgtgattcagactgagcacagccttcaccaacccatgttctacttattggccatgttggctctcactgacctgggcctctccactgccaccattcccaaaatgctgagcattttctggttcggcttcagtgagattgcctttgggggatgcttagctcaaatgttcttcatacacctgtttacaggctttgaaacattcatgcttgtagccatggcttttgatcgctatgttgccatttgccaccctcttcgatacaacacaatcctcaccaacagaactatttgtattattgctggagtaggaatgctgaaaaattttgctttggtgcttccacttgtgtttctccttctaaggctttcattctgtgggaataatattatacctcattcctattgtgagcacatgggcattgcccgcctggcctgtgtcagcataaaggtcaatgtattatttggattaatcctcatctctatgatacttttggatgttgttttgattgctctctcctatgtgaagattctacatgctgtcttcagactcccttcctgggaggctaggctcaaagctcttaatacctgtggttcccatggatgtgtcatcttagcttttttcactccagcatttttctcctttatgactcatcgatttggccacaatattccacgttacatccacatcctcttggctaatttgtatgtaatcatccctcctgctcttaaccccattatttatggggtgagaaccaaacagatccgagagcaggtagtgatgatcttcctttttaaggaagtttga

SEQ ID NO: 1180 - protein, 313 aa, Canis familiaris
MSPANTSCIHPSSFLLLGIPGLENMQFWLGIPFGTVYLIALLGNVIILFVIQTEHSLHQPMFYLLAMLALTDLGLSTATIPKMLSIFWFGFSEIAFGGCLAQMFFIHLFTGFETFMLVAMAFDRYVAICHPLRYNTILTNRTICIIAGVGMLKNFALVLPLVFLLLRLSFCGNNIIPHSYCEHMGIARLACVSIKVNVLFGLILISMILLDVVLIALSYVKILHAVFRLPSWEARLKALNTCGSHGCVILAFFTPAFFSFMTHRFGHNIPRYIHILLANLYVIIPPALNPIIYGVRTKQIREQVVMIFLFKEV

SEQ ID NO: 1181 - DNA, 939 bp, Canis familiaris
atgtccactcttaatgatacccaatttcacccttcttcattcctactcttgggtataccagggctagaagatgtgcatttctggatcggatttccctttttctttgtgtatcttgttgcactcctggggaatactgctgtcctatttgtgatcctgactgagcataatctccatgagcccatgtactactttctggccatattggactgcattgacctgggcttatccacagccaccatccccaaaatgttgggcatcttctggttcagcctcagagatatatcttttgaaagctgtctttctcagatgttcttcatccatttcttcactgccatggagagcattgtgttggtggccatggcctttgaccgctacattgccatttgtaaacctcttcggtacaccatgatcctcaccaacagaatcatcatcatcattgcaggcattgctattctgaggagtctttgcatggtgatcccactggtgtttctcctcctgaggctgcccttttgtgggcaccacatcatccctcatacctattgtgaacacatgggcattgcccgtctggcttgtgccagcatcaaagtcaacataatatttggtcttggggatatgtctattttattattggatgtgcttcttattactctttcctatgtcaggatcctccatgctgtcttctgcttgccctccaaggaggctcgactcaaagctctcaacacctgtggctcccacattggtgttatttcagcctttttcactccagcatttttctctttcttgacacatcgttttggccacaacatcccccagtatatccacatttttttagccaatctatacatcgttgttccaccagctctcaatcctgcaatctacggggtcaggaccaagcagattagagagcgggttttgaggattttttttaaagacatttaa

SEQ ID NO: 1182 - protein, 312 aa, Canis familiaris
MSTLNDTQFHPSSFLLLGIPGLEDVHFWIGFPFFFVYLVALLGNTAVLFVILTEHNLHEPMYYFLAILDCIDLGLSTATIPKMLGIFWFSLRDISFESCLSQMFFIHFFTAMESIVLVAMAFDRYIAICKPLRYTMILTNRIIIIIAGIAILRSLCMVIPLVFLLLRLPFCGHHIIPHTYCEHMGIARLACASIKVNIIFGLGDMSILLLDVLLITLSYVRILHAVFCLPSKEARLKALNTCGSHIGVISAFFTPAFFSFLTHRFGHNIPQYIHIFLANLYIVVPPALNPAIYGVRTKQIRERVLRIFFKDI

SEQ ID NO: 1183 - DNA, 954 bp, Canis familiaris
atgccagaaagaatggctacacctaatgatacccagttccatccctcttcgttcctcctcctgggtatcccagaactagaagatgtgcagttctggatcggatttccctttttctttgtgtatcttgttgcactcctggggaatgctgctgtcctatttgtgatccagactgagcatagtctccatgagcccatgtactactttctggccatgttggactccattgacctgggcttgtccacagccaccatccccaaaatgttgggcatcttctggttcagcctcagagatatatcttttgaaagctgtctttcccagatgttcttcatccatttcttcactgtcatggagagcattgtgttggtggccatggcctttgaccgctacattgccatttgtaaacctcttcggtacaccatgatcctcaccagcaaaatcatcatcatcattgcaggcattgctattctgaggagtctttgcatggtgatcccactggtgtttctcctcctgaggctgcccttctgtgggcaccatatcatccctcatacctattgtgaacacatgggcattgcccgtctggcttgtgccagcatcaaagtcaacattctatttggccttggcaacatttctctcttattattggatgtgctccttataattctctcctatgtcaggatcctccatgctgtcttctgtttgccctccagggaggctcgactcaaagctctcaacacctgtggctcccacattggtgttatcttagcctttttcactccagcctttttctctttcttgacacatcgatttggccacaatattcctcaatatattcacattttcttggctaatctgtatgtagttgttccaccagctttcaatcctgtaatttatggggtcaggaccaagcagatcagggagcgagtcctgagggttttctttaggacagagagctaa

SEQ ID NO: 1184 - protein, 317 aa, Canis familiaris
MPERMATPNDTQFHPSSFLLLGIPELEDVQFWIGFPFFFVYLVALLGNAAVLFVIQTEHSLHEPMYYFLAMLDSIDLGLSTATIPKMLGIFWFSLRDISFESCLSQMFFIHFFTVMESIVLVAMAFDRYIAICKPLRYTMILTSKIIIIIAGIAILRSLCMVIPLVFLLLRLPFCGHHIIPHTYCEHMGIARLACASIKVNILFGLGNISLLLLDVLLIILSYVRILHAVFCLPSREARLKALNTCGSHIGVILAFFTPAFFSFLTHRFGHNIPQYIHIFLANLYVVVPPAFNPVIYGVRTKQIRERVLRVFFRTES

SEQ ID NO: 1185 - DNA, 942 bp, Canis familiaris
atggctacacctaatgacacccagttccatccctcttccttccttctcctgggtattccagggctagaagatgtgcatttctggatcggatttccctttttctttgtgtatcttgttgcactcctggggaatgctgctgtcctgtttgtgatccagactgagcatagtctccatgagcccatgtactactttctggccatgttggactccattgatctgggcttgtccacagccaccatccccaaaatgttgggcatcttctggttcagcctcagagatatatcttttgaaagctgtctttcccagatgttcttcatccatttcttcactgccatggagagcattgtgttggtggccatggcctttgaccgctacattgccatttgtaaacctcttcggtacaccatgatcctcaccagcaaaatcatcatcatcattgcagggattgctattctgaggagtctttgcatggtgatcccactggtgtttctcctcctgaggctgcccttctgtgggcaccatatcatccctcatacctattgtgaacacatgggcattgcccgtctggcttgtgccagcatcaaagtcaacattctatttggccttggcaacatttctctcttattattggatgtgctccttataattctctcctatgtcaggatcctccatgctgtcttctgtttgccctccagggaggctcgactcaaagctctcaacacctgtggctcccacattggtgttatcttagcctttttcactccagcctttttctctttcttgacacatcgatttggccacaatattcctcaatatattcacattttcttggctaatctgtatgtagttgttccaccagctttcaatcctgtaatttatggggtcaggaccaagcagatcagggagcgagtcctgagggttttctttaggacagatagctaa

SEQ ID NO: 1186 - protein, 313 aa, Canis familiaris
MATPNDTQFHPSSFLLLGIPGLEDVHFWIGFPFFFVYLVALLGNAAVLFVIQTEHSLHEPMYYFLAMLDSIDLGLSTATIPKMLGIFWFSLRDISFESCLSQMFFIHFFTAMESIVLVAMAFDRYIAICKPLRYTMILTSKIIIIIAGIAILRSLCMVIPLVFLLLRLPFCGHHIIPHTYCEHMGIARLACASIKVNILFGLGNISLLLLDVLLIILSYVRILHAVFCLPSREARLKALNTCGSHIGVILAFFTPAFFSFLTHRFGHNIPQYIHIFLANLYVVVPPAFNPVIYGVRTKQIRERVLRVFFRTDS

SEQ ID NO: 1187 - DNA, 936 bp, Canis familiaris
atgacttccatcaatgacactcagttccatccccccttctttcacctgctaggaatcccagggctggaaactgtccgcatctggattgctttcccattctgtgttgtgtatctgattgccctcgtggggaacatctccatcctgtttgcaatcaagactgaacacagtctccaccagcccatgttctacttcctggccatgttgtctatgatcgatctgggtctgtccacgtccaccatccccaaaatgctgagcatcttctggttcaacctccaagagatcagcttcaggggctgccttactcagatgttcttcatccacatgttcacaggcatggagactgttctcctggtggccatggcttatgaccgctttgttgccatctgcaaccctctccagtacaccatgatcctcaccaataaaacaatcggcatcctcgcctctgttgttgttggaagaaatttaattctggtgactccatttgtgtttctcattctgaggctgcccttctgtgggcatcacgtcatccctcatacgtactgtgagcacatgggtcttgcctggttggcctgtgcacccatcaaggtcaacattatctatgggctcatggtgatttccaatatcattgtggatgtgatcctgattgcttcgtcctatgtgcttatccttcaagctgttttccgccttccttctcaggatgcccgactaaaggctctcaatacctgtggttctcatgtctgtgtcatgctgtacttttacacaccggcatttttttctttcatgacacaccgttttggtcgaaacatcccccgctatatccatatccttttagctaatctatatgtggttgtcccacctgccctcaacccagtcatctatggagtcaggaccaagcagatccgagagacagttgtgaagatatttgtacagaaataa

SEQ ID NO: 1188 - protein, 311 aa, Canis familiaris
MTSINDTQFHPPFFHLLGIPGLETVRIWIAFPFCVVYLIALVGNISILFAIKTEHSLHQPMFYFLAMLSMIDLGLSTSTIPKMLSIFWFNLQEISFRGCLTQMFFIHMFTGMETVLLVAMAYDRFVAICNPLQYTMILTNKTIGILASVVVGRNLILVTPFVFLILRLPFCGHHVIPHTYCEHMGLAWLACAPIKVNIIYGLMVISNIIVDVILIASSYVLILQAVFRLPSQDARLKALNTCGSHVCVMLYFYTPAFFSFMTHRFGRNIPRYIHILLANLYVVVPPALNPVIYGVRTKQIRETVVKIFVQK

SEQ ID NO: 1189 - DNA, 963 bp, Canis familiaris
atgctcctttcccactcctatgtcaacatctccttcttccagccacatgccttcctgatgattggcatcccagggctggaggctgttcatggatggatctccatccccttctctttcatgtacactgtggccctcactggaaactgcctgattctcttggctgtgaggagaactcccagcttgcaccagcccatgtactacttcctgtccatgctggccctcactgatgtgggcctcactctgtccacactgccaaccaccctggctgtgctctggtttgattatcggcacataggcttcaatgcctgcctggttcagatgttcttcctccactccttctctgtggtggagtcatcagtgctcctggccatgtcatttgaccgctttgtggccatctctaaccctcttcgctatgcagctaccctcaccaataatgtcattattaggattgggctggccattatggctagagccactgtatccctctttccagggcccttcttattgaagcgactgaacttttgccctgacaagatcctcctgtcccattccttctgtttccatgcagatgtcatgaaacgggcttgtgctgacattactgtcaacatcctttatgggctatatgtagttttatccacagtaggtgtagactctttgtttattgtcctgtcctatacccttattcttcatacagtgatgggtctggcctctcccagggagcgtgtccgagccctcaacacatgtgtgtctcatatattagctgttctgattttctacatcccagtcataggagtgtcaatgatccaccgttttgggaggcacctgcctcacattgtacatgctctggttgcctatgtgtacctggtggtgccccctgtgctcaaccccatcatctacagtgtgaaatccaagcccattagggaggctatgctcagactgctgagaaagaagaggaaaggctga

SEQ ID NO: 1190 - protein, 320 aa, Canis familiaris
MLLSHSYVNISFFQPHAFLMIGIPGLEAVHGWISIPFSFMYTVALTGNCLILLAVRRTPSLHQPMYYFLSMLALTDVGLTLSTLPTTLAVLWFDYRHIGFNACLVQMFFLHSFSVVESSVLLAMSFDRFVAISNPLRYAATLTNNVIIRIGLAIMARATVSLFPGPFLLKRLNFCPDKILLSHSFCFHADVMKRACADITVNILYGLYVVLSTVGVDSLFIVLSYTLILHTVMGLASPRERVRALNTCVSHILAVLIFYIPVIGVSMIHRFGRHLPHIVHALVAYVYLVVPPVLNPIIYSVKSKPIREAMLRLLRKKRKG

SEQ ID NO: 1191 - DNA, 945 bp, Canis familiaris
atgtcttctctcaatgtcactgaattccacccttcttcattcctattgttggggattccagggttggaaattgcacaaatctggcttggatttcccttctgtgctgtgtatctgatcgcccttattggaaatgttatcattctgtttgttatctggactgatcatagccttcaccaacccatgttctactttctggccatgctgtcagtgattgacctaagtctctctacaactaccatccccaagatgctgggtatcttctggttcaaccttcaggagctatgctttgggtgctgtgttgctcaagtcttttttgtccacttttttacagtcatggagagcattgtacttcttgccatgggttttgatcgctatgtggctatttgcaaccccctcaggtacaacatgatcctcaccaacagagtcattggtgtgattgctgtggtggtggttctaagaagcgtattcatgattgctcccatcatttttctcctcctgaggctgccttactgtggacatagaatcatccctcatacctattgtgagcacatgggagtggcacgtctagcttgtgccagcattaatgccaatgtctactatggtcttgggaatatttctatcttgtttctggatgtgtttctcatcattatctcttattttaagatcttatatgctgtcttccacctctcctcccaagatgctcgcctgaaggctctgaatacctgtagttcccatatttgtgtcatctttgccttctttggtccagctctcttttcctttcttactcaccgctttggtcataatgtcccccagtatatccacatactcctggctaatctctatgtagtcataccccctgcccttaacccagtcatttatggcatcaggaccaagcagatccaggagcgggtacagagtttctttgttgaaaaaaagattgaatga

SEQ ID NO: 1192 - protein, 314 aa, Canis familiaris
MSSLNVTEFHPSSFLLLGIPGLEIAQIWLGFPFCAVYLIALIGNVIILFVIWTDHSLHQPMFYFLAMLSVIDLSLSTTTIPKMLGIFWFNLQELCFGCCVAQVFFVHFFTVMESIVLLAMGFDRYVAICNPLRYNMILTNRVIGVIAVVVVLRSVFMIAPIIFLLLRLPYCGHRIIPHTYCEHMGVARLACASINANVYYGLGNISILFLDVFLIIISYFKILYAVFHLSSQDARLKALNTCSSHICVIFAFFGPALFSFLTHRFGHNVPQYIHILLANLYVVIPPALNPVIYGIRTKQIQERVQSFFVEKKIE

SEQ ID NO: 1193 - DNA, 936 bp, Canis familiaris
atgacttccatcaatgacactcagttccatccccccttctttcacctgctaggaatcccagggctggaaactgtccacatctggattgctttcccattctgtattgtgtatctgattgcccttgtggggaacatcaccatcctgtttgcaatcaagactgaacacagtctccaccagcccatgttctacttcctggccatgttgtctatgatcgatctgggtctgtccacgtccaccatccccaaaatgctgagcatcttctggttcaacctccaagagatcagcttcaggggctgccttactcagatgttcttcatccacatgttcacaggcatggagactgttctcctggtggccatggcttatgaccgctttgttgccatctgcaaccctctccagtacaccatgatcctcaccaataaaacaatcggcatcctcgcctctgttgttgttggaagaaacttaattctggtgactccatttgtgtttctcattctgaggctgcccttctgtgggcatcacgtcatccctcatacgtactgtgagcacatgggtcttgcccggttggcctgtgcacccatcaaggtcaacattatctatgggctcatggtgatttccaatatcattgtggatgtgatcctgattgcttcgtcctatgtgcttatccttcaagctgttttccgccttccttctcgggatgcccgactaaaggctctcaatacctgtggttctcatgtctgtgtcatgctgtgcttttacacaccggcatttttttctttcatgacacaccgttttggtcgaaacatcccccgctatatccatatccttttagctaatctatatgtggttgtcccacctgccctcaacccagtcatctatggagtcaggaccaagcagatccgagagacagttgtgaagatatttgtacagaaataa

SEQ ID NO: 1194 - protein, 311 aa, Canis familiaris
MTSINDTQFHPPFFHLLGIPGLETVHIWIAFPFCIVYLIALVGNITILFAIKTEHSLHQPMFYFLAMLSMIDLGLSTSTIPKMLSIFWFNLQEISFRGCLTQMFFIHMFTGMETVLLVAMAYDRFVAICNPLQYTMILTNKTIGILASVVVGRNLILVTPFVFLILRLPFCGHHVIPHTYCEHMGLARLACAPIKVNIIYGLMVISNIIVDVILIASSYVLILQAVFRLPSRDARLKALNTCGSHVCVMLCFYTPAFFSFMTHRFGRNIPRYIHILLANLYVVVPPALNPVIYGVRTKQIRETVVKIFVQK

SEQ ID NO: 1195 - DNA, 942 bp, Canis familiaris
atgctgcattccaacaatacacagttccatcctccctccttccttctggtggggattccaggactacaagatgtgcacatctggattggcttccccttttttgcagtgtatctgatagcccttctggggaacatcactatcctgttcgtgatccagatggaacatagcctccaccaacccatgttttacttcctggccatgttggcctgcactgaccttggcttgtccacagccaccatccccaagatgctgggcattttctggttcaatctcagggagattgggtttggtgcttgcatcacacagatgtacactatccatatatgtaccggcctggagtctgtggtgctgacagttatggccatagatcgatatattgccatctgcaaccccttgagatatagcatgatccttaccaataaggtgatagctatcctgagcatagtcatcatagtcaggactttggtgtttgtgactccattcatatttctcatcctgagattgcctttctgtggtgtccgggttatccttcatacctactgtgaacatatgggcttggcaaagttggcttgtgccaatattagggtcaatgttgtgtatggattgattgctttctcagtgggatacattgatctatctgtgattggattctcctacgtccaaatcctccgagcagtcttccacctcccctcctgggatgcccggctcaaggcactcaacacatgtggctcgcatgtctgtgtcatgttagctttctacctgccagccctcttctccttcatgacacatcgctttggccacaacattcctcattacatccacattcttctggccaatctgtacgtggttgttccccctgctcttaaccctgttatctatggggtcaggacaaaacagataagagagcgtgtactaaggatacttatccctaaagcctattga

SEQ ID NO: 1196 - protein, 313 aa, Canis familiaris
MLHSNNTQFHPPSFLLVGIPGLQDVHIWIGFPFFAVYLIALLGNITILFVIQMEHSLHQPMFYFLAMLACTDLGLSTATIPKMLGIFWFNLREIGFGACITQMYTIHICTGLESVVLTVMAIDRYIAICNPLRYSMILTNKVIAILSIVIIVRTLVFVTPFIFLILRLPFCGVRVILHTYCEHMGLAKLACANIRVNVVYGLIAFSVGYIDLSVIGFSYVQILRAVFHLPSWDARLKALNTCGSHVCVMLAFYLPALFSFMTHRFGHNIPHYIHILLANLYVVVPPALNPVIYGVRTKQIRERVLRILIPKAY

SEQ ID NO: 1197 - DNA, 942 bp, Canis familiaris
atggcttcatccagcaactactccactgctccagtctctgaattcctcctcatctgcttccctaactaccagagttggcagcattggctgtccctgcctctcagcctcctcttcctcctggccatgggggccaatgccaccctcttgatcactatcctgctggaggcctctctgcacgagcccatgtactacctactcggcctcctctccctgctggacattgtgctctgcctcactgtcatccccaaggtcctggccatcttctggtttgatctcaggtccatcagcttctcagcctgcttcctccagatgttcatcatgaacagttttttgaccatggagtcctgcacattcatggtcatggcctatgaccgctatgtggccatctgccacccactgaggtacccatccatcatcactgaccaatttgtggttagagctgccatatttattgtggccaggaatagtatcttttctcttcctgttcctgttctttcttccaggcttagatactgtgcagaaaacattatcaagaactgtatctgcactaacctgtctgtgtccaaactctcctgtgatgacatcaccttcaatcggctctaccagtttgtggcaggctggaccctactgggctctgacctcatccttattgttttgtcctactccttcatcctgaaagctgtgctaaggatcaaggctgagggtgctacagccaaggccctaagcacatgtggttcccacttcatcctcatcctcttcttcagcacagtcctgttggttctggtcatcactaacctggccaggaagagaattcccccagatgtccccatcctactcaacatcctgcaccacctcatccccccagctctgaaccccattgtttatggtgtgagaactaaggagatcaaccaaggaatccagaagctgctgagaaggttgtaa

SEQ ID NO: 1198 - protein, 313 aa, Canis familiaris
MASSSNYSTAPVSEFLLICFPNYQSWQHWLSLPLSLLFLLAMGANATLLITILLEASLHEPMYYLLGLLSLLDIVLCLTVIPKVLAIFWFDLRSISFSACFLQMFIMNSFLTMESCTFMVMAYDRYVAICHPLRYPSIITDQFVVRAAIFIVARNSIFSLPVPVLSSRLRYCAENIIKNCICTNLSVSKLSCDDITFNRLYQFVAGWTLLGSDLILIVLSYSFILKAVLRIKAEGATAKALSTCGSHFILILFFSTVLLVLVITNLARKRIPPDVPILLNILHHLIPPALNPIVYGVRTKEINQGIQKLLRRL

SEQ ID NO: 1199 - DNA, 978 bp, Canis familiaris
atgacagcacaccaaaatggcaccatctccactggggcttcagagtttctcctgaattgttttgtcaggtcccccacttggcagctctggttatccctgcccctcggcctcttgttcctcgtggccatgggggccaatggtgttctcctgatcaccatctggctggaggcctctctacaccagcccctgtactacctgctgagcctcctctccctcctggacattgttctctgcctcactgtcatccccaaggtcctggccatcttttggtttgacctcaagtccatcagctttgatgcctgcttcttacagatgttcatcatgaatttcttctatgccatggagtcctgcacattcatggtcatggcctatgaccgctatgtggccatctgccacccactgaggtacccatccatcatacccactgaggtacccatccatcatacagaacaatttgtagctaaggctgccatttttattttggccaggaatgctatttctacattgcctatccccattctctcatccagactccattattgtgggagaaatgtcattgagaattgcatctgtgccaatatgtctgtctccaagctctcctgtgatgatgtcaccatcaatcgtctctaccagtttgctggaggctggacactgctaggatctgacctcgtcctcatcttcatctcttacagcctcatacttcaaactgtgatgggattaaaggcggagggtgctatggccaaagccctgagcacatgtggttctcacttcatccttatcctcttcttcagcaccgtccttctggtctttgtgctcactcatatggtgacaaagaaggtgtctccaattgagcaagatgttccagttttgctcaatgtcctccaccatgtcatccctgcagccttgaaccccattgtttatggagtgcacacccaggagatcaaacaaggaatccagagattactgaagaagggatgg

SEQ ID NO: 1200 - protein, 326 aa, Canis familiaris
MTAHQNGTISTGASEFLLNCFVRSPTWQLWLSLPLGLLFLVAMGANGVLLITIWLEASLHQPLYYLLSLLSLLDIVLCLTVIPKVLAIFWFDLKSISFDACFLQMFIMNFFYAMESCTFMVMAYDRYVAICHPLRYPSIIPTEVPIHHTEQFVAKAAIFILARNAISTLPIPILSSRLHYCGRNVIENCICANMSVSKLSCDDVTINRLYQFAGGWTLLGSDLVLIFISYSLILQTVMGLKAEGAMAKALSTCGSHFILILFFSTVLLVFVLTHMVTKKVSPIEQDVPVLLNVLHHVIPAALNPIVYGVHTQEIKQGIQRLLKKGW

SEQ ID NO: 1201 - DNA, 960 bp, Canis familiaris
atgctaccttataacagcagctgcctctctactgaagtctcagacttcatcctgaattgctttgtcaggtctcccagctggcagcactggctatctctgcccctcagcatcctcttcctcatggccatgggggccaatgccgtcctcctgatcactatacagctagaggcctctctgcacgagcccatgtactacttgcttggcctcctttcccttttggacatcgtgctctgcctcactgtcatccccaaggtcctggctatcttctggtttgatctcaggtccatcagcttctctgcctgcttcctccagatgttcatcatgaatagcttcctgcccatggaatcatgcaccttcctggccatggcctatgaccgctatgtcgccatctgcaagcctctgtactacccaaccatcatcactgaccagtttgtggtaaaggctgttctcttcatcgtggcccggagcacatttcttactacacctactcccatcctttcggcccggctgcattactgtggaaaaaatataattgagaactgtatctgtgccaacctctctgtgtccaagctctcctgtgataatgttacccttaacaaaatataccagttaattgtggcctggactctgctgagctgtgacctcatcctcatcttcctctcctatatcctcatcctaaaaactgttcttagactcaaggcaaaaggggcagctgccaaagctctgagcacatgcggctctcacttcattctcatcctcttctttagcaccatcctgctggttttggtttttacccacattgccaaaaaaaaagtttcccctgagattcccatcttacttaatgtcctacaccatgtaattcctgcagctctcaatcccattgtctatgggatacgaacccaggagattaaagagggaattaggaagttactgaggagggtagtagagagatgcaagtaa

SEQ ID NO: 1202 - protein, 319 aa, Canis familiaris
MLPYNSSCLSTEVSDFILNCFVRSPSWQHWLSLPLSILFLMAMGANAVLLITIQLEASLHEPMYYLLGLLSLLDIVLCLTVIPKVLAIFWFDLRSISFSACFLQMFIMNSFLPMESCTFLAMAYDRYVAICKPLYYPTIITDQFVVKAVLFIVARSTFLTTPTPILSARLHYCGKNIIENCICANLSVSKLSCDNVTLNKIYQLIVAWTLLSCDLILIFLSYILILKTVLRLKAKGAAAKALSTCGSHFILILFFSTILLVLVFTHIAKKKVSPEIPILLNVLHHVIPAALNPIVYGIRTQEIKEGIRKLLRRVVERCK

SEQ ID NO: 1203 - DNA, 948 bp, Canis familiaris
atgacagcacaccaaaatggcaccatctccactggggcttcagagtttctcctgaattgttttgtcaggtcccccacttggcagctctggttatccctgcccctcggcctcttgttcctcgtggccatgggggccaatggtgttctcctgatcaccatctggctggaggcctctctacaccagcccctatactacctgctgagcctcctctccctcctggacattgttctctgcctcactgtcatccccaaggtcctggccatcttttggtttgacctcaagtccatcagctttgatgcctgcttcttacagatgttcatcatgaatttcttctatgccatggagtcctgcacattcatggtcatggcctatgaccgctatgtggccatctgccacccactgaggtacccatccatcatcacagaacaatttgtagctaaggctgccatttttattttggccaggaatgctatttctacattgcctatccccattctctcatccagactccattattgtgggagaaatgtcattgagaattgcatctgtgccaatatgtctgtctccaagctctcctgtgatgatgtcaccatcaatcgtctctaccagtttgctggaggctggacactgctaggatctgacctcgtcctcatcttcatctcttacagcctcatacttcaaactgtgatgggattaaaggcggagggtgctatggccaaagccctgagcacatgtggttctcacttcatccttatcctcttcttcagcaccgtccttctggtctttgtgctcactcatatggtgacaaagaatgtgtctcctgatgttccagtcttgctcaatgtcctccaccatgtcatccctgcagccttgaaccccattgtttatggagtgcgcacccaggagatcaaacaaggaatccagagattactgaagaagggatggtag

SEQ ID NO: 1204 - protein, 315 aa, Canis familiaris
MTAHQNGTISTGASEFLLNCFVRSPTWQLWLSLPLGLLFLVAMGANGVLLITIWLEASLHQPLYYLLSLLSLLDIVLCLTVIPKVLAIFWFDLKSISFDACFLQMFIMNFFYAMESCTFMVMAYDRYVAICHPLRYPSIITEQFVAKAAIFILARNAISTLPIPILSSRLHYCGRNVIENCICANMSVSKLSCDDVTINRLYQFAGGWTLLGSDLVLIFISYSLILQTVMGLKAEGAMAKALSTCGSHFILILFFSTVLLVFVLTHMVTKNVSPDVPVLLNVLHHVIPAALNPIVYGVRTQEIKQGIQRLLKKGW

SEQ ID NO: 1205 - DNA, 945 bp, Canis familiaris
atgctaccttataacagcagctgcctctctactgaagtctcagacttcatcctgaattgctttgtcaggtctcccagctggcagcactggctatctctgcccctcagcatcctcttcctcgtggccatgggggccaatgccgtcctcctgatcactatacagctagaggcctctctgcacgagcccatgtactacttgcttggcctcctttcccttttggacatcgtgctctgcctcactgtcatccccaaggtcctggctatcttctggtttgatctcaggtccatcagcttctctgcctgcttcctccagatgttcatcatgaataacttcctgcccatggaatcatgcaccttcctggccatggcctatgaccgctatgtcgccatctgcaacccaacgattatcactgaccagtttgtggcaaaggctgttctcttcatcttggcccggaacacatttcttactgcacctattcccatcctttcggcccggctgcattactgtggaaaaaatataattgagaactgtatctgtgccaacctctctgtgtccaagctctcctgtgataatgttgcccttaacaaaatataccagttaattgtggcctggactcttctgggctctgatcttgtcctcatatttatctcctatatcctcatcctaagagccattcttagacttaaggcaaaaggggcagctgccaaagctctgagcacatgcggctctcacttcatactcatcctcttctttagcaccatcctgctagtctttgtttttacccacatggccaagaaaaaagtttcccctgatattcccatcttacttaatgtcctacaccatgtaattcctgcagctctcaatcccattgtctatggggtacgaacccaggagattaaagagggaattaggaaattactgaggagggtagcagagagatgcaag

SEQ ID NO: 1206 - protein, 315 aa, Canis familiaris
MLPYNSSCLSTEVSDFILNCFVRSPSWQHWLSLPLSILFLVAMGANAVLLITIQLEASLHEPMYYLLGLLSLLDIVLCLTVIPKVLAIFWFDLRSISFSACFLQMFIMNNFLPMESCTFLAMAYDRYVAICNPTIITDQFVAKAVLFILARNTFLTAPIPILSARLHYCGKNIIENCICANLSVSKLSCDNVALNKIYQLIVAWTLLGSDLVLIFISYILILRAILRLKAKGAAAKALSTCGSHFILILFFSTILLVFVFTHMAKKKVSPDIPILLNVLHHVIPAALNPIVYGVRTQEIKEGIRKLLRRVAERCK

SEQ ID NO: 1207 - DNA, 939 bp, Canis familiaris
atgacaacacatcaaaatgggaccatatccattgagatttcagactttctcctgaattgttttgtcaggtctcccggctggcaactttctttctccctgcccctcagcctcctcttcctcctggccatgggggccaatggtgtcctcctgatcaccatctggctggaggcctctctgcacgagcccatgtactacctgctcagcatcctctccctattggacatcgtgctctgcctcactgtcatccccaaagtcctgaccattttctggtttgatctcaagtccatcaatttctatgcctgcttcattcagatgtacatcatgaattgcttccttgccatggagtcctgcacaatggtcatggcctatgaccgctatgtggccatctgccacccactgaggtacccatccatcatcacagaacaatttgtagcgaaggctgccatttttattttggccaggaatgctatttctacagtgcctattcccattctatcatccagactccattattgtgggggaaatgtcattgagaattgcatctgtgccaatatgtctgtctccaagctctcctgtgatgatgtcaccatcaatcgcctctaccagtttgctgcaggctggacactgctaggatctgatctcatccttatcttcctttcctacagcctcatactgcgagctgtgctgagactcaaggcagagggtgctatggccaaagccctgagcacatgtggttctcacttcatccttatcctcttcttcagcactatccttctggtctttgtgctcactcatgtggcaaagaagaaagtctcccctgatgtgccagtcttgctcaatgttctccaccatgtcattcctgcagccctcaatcccattgtttatggagtgagaactcaggagatcaagcaaggaatccagagattactaaacaaaggg

SEQ ID NO: 1208 - protein, 313 aa, Canis familiaris
MTTHQNGTISIEISDFLLNCFVRSPGWQLSFSLPLSLLFLLAMGANGVLLITIWLEASLHEPMYYLLSILSLLDIVLCLTVIPKVLTIFWFDLKSINFYACFIQMYIMNCFLAMESCTMVMAYDRYVAICHPLRYPSIITEQFVAKAAIFILARNAISTVPIPILSSRLHYCGGNVIENCICANMSVSKLSCDDVTINRLYQFAAGWTLLGSDLILIFLSYSLILRAVLRLKAEGAMAKALSTCGSHFILILFFSTILLVFVLTHVAKKKVSPDVPVLLNVLHHVIPAALNPIVYGVRTQEIKQGIQRLLNKG

SEQ ID NO: 1209 - DNA, 960 bp, Canis familiaris
atgacagcgcaccaaaatggcaccatctccattgtggtttccgacttcctcctgaattgtttagtcaggtctcccagctggaagttctggttgtccctgcccctaagcttcctcttcctcctggccatgggggccaatggtgttctcctggtcaccatccagctggaggcctctctgcatgagcccatgtactacctgctcagcatcctctctctgctggacatcgtcctctgcctgactgttatacccaaggtcctggccatcttctggtttgatctcaggtccgtcagcttctctgcctgcttcattcagatgtacatcatgaattgcttccttggcatggagtcttgcacattcatggtcatggcctatgaccgctatgtggccatctgccacccactgaggtactcttccatcatcactgatcaatttgtagctagggctgctatgtttattttggcgaggaatgcacttcttactatgttcattcctatcctctctgcccagctccattattgtggaaaaaatataattgagaactgtatctgtgccaacctctctgtgtccaagctctcctgtgataatgttgcccttaacagaatataccagttaactgtagcctggactcttctgggctctgacctcgtcctcatcttcctctcctacatcctcatcctaagagccattcttagactgaaggcaaaaggggcagctgccaaagctctgagcacatgcggctctcacttcattctcatcctgttctttagcaccatcctgctggtttttgtttttacccacatggctaagaaaagagtttcccctgatattcccatcttacttaatgtcctacaccatgtaattcctgcagctctcaatcccattgtctatggggtacgaacccaggagattaaagagggaattaggaagttactgagaagggtagtagagagatgcaagtaa

SEQ ID NO: 1210 - protein, 319 aa, Canis familiaris
MTAHQNGTISIVVSDFLLNCLVRSPSWKFWLSLPLSFLFLLAMGANGVLLVTIQLEASLHEPMYYLLSILSLLDIVLCLTVIPKVLAIFWFDLRSVSFSACFIQMYIMNCFLGMESCTFMVMAYDRYVAICHPLRYSSIITDQFVARAAMFILARNALLTMFIPILSAQLHYCGKNIIENCICANLSVSKLSCDNVALNRIYQLTVAWTLLGSDLVLIFLSYILILRAILRLKAKGAAAKALSTCGSHFILILFFSTILLVFVFTHMAKKRVSPDIPILLNVLHHVIPAALNPIVYGVRTQEIKEGIRKLLRRVVERCK

SEQ ID NO: 1211 - DNA, 972 bp, Canis familiaris
atgccagctatgagttcctgcaacttcacacataccacctttgtacttattggtatcccaggattagaagaagcccatttctggatcggcttccccctgctttcaatgtatgccgtggcactatttggaaactgcatcgttgtcttcatcgtaaggacagagcgcagcctacacgctcccatgtacctctttctctgcatgttggcagccattgacttggccttgtccacatccaccatgcccaagatcctcgccctcttctggtttgattcccgggagattacttttgatgcctgcattgcccagatgttttttattcatgctctttcagctattgagtccactatcctgctggccatggcctttgaccgttatatagccatctgtcacccactgcgccatgcagcagtgctcaacaatacagtaacagcccagattggcatggtggctgtggcccgtggatcactcttctttatcccactgcctctgctcatcaagcggctggccttctgccattccaatgtgctgtcacactcctattgtgtgcaccaggatatgatgaagttggcctatgcagatacattgcccaatgtgatctatggtcttacagccattctgttggttatgggtgtggatgtcctcttcatctccttgtcctattttctgattatacgaacagttctacaactgccttccaagtcagagcgggccaaggcttttggaacctgtgtgtcacacatcggtgtggtattagccttctatgttcctctcattggcctctcagtggtacaccgttttggaaacagccttgatcccattgtgcatgttctcatgggtgatgtctatctacttctgcctcctgtgatcaatcccatcatctacggtgccaagaccaaacagatcagaactcgggtgctagctatgttcaagatcagctgtgacaaggaccctcaggctgtgggcagcagatga

SEQ ID NO: 1212 - protein, 323 aa, Canis familiaris
MPAMSSCNFTHTTFVLIGIPGLEEAHFWIGFPLLSMYAVALFGNCIVVFIVRTERSLHAPMYLFLCMLAAIDLALSTSTMPKILALFWFDSREITFDACIAQMFFIHALSAIESTILLAMAFDRYIAICHPLRHAAVLNNTVTAQIGMVAVARGSLFFIPLPLLIKRLAFCHSNVLSHSYCVHQDMMKLAYADTLPNVIYGLTAILLVMGVDVLFISLSYFLIIRTVLQLPSKSERAKAFGTCVSHIGVVLAFYVPLIGLSVVHRFGNSLDPIVHVLMGDVYLLLPPVINPIIYGAKTKQIRTRVLAMFKISCDKDPQAVGSR

SEQ ID NO: 1213 - DNA, 945 bp, Canis familiaris
atgacaacacatcaaaatgggaccatatccattgagatttcagactttctcctgaattgttttgtcaggtctcccagctggcaactttctttctccctgcccctcagcctcctcttcctcctggccatgggggccaatggtgtcctcctgatcaccatctggctggaggcctctttgcacgagcccatgtactacctgctcagcatcctctccctattggacatcgtgctctgcctcactgtcatccccaaagtcctgaccattttctggtttgatctcaagtccatcaacttctatgcctgcttcattcagatgtacatcatgaattgcttccttgccatggagtcctgcacattcatggtcatggcctatgaccgctatgtggccatctgccacccactgaggtacccatccatcatcacagaacaatttgtagcgaaggctgccatttttattttggccaggaatgctatttctacattgcctattcccattctatcatccagactccattattgtgggggaaatgtcattgagaattgcatctgtgccaatatgtctgtctccaagctctcctgtgatgatgtcaccatcaatcgcctctaccagtttgctggaggctggacactgctaggatctgatctcatccttatcttcctctcctacagccttatactgcgagctgtgctgagactcaaggcagagggtgctatggccaaagccctgagcacatgtggttctcacttcatccttatcctcttcttcagcactatccttctggtcttcgtgctcactcatgtggcaaagaagaaagcctcccctgatgtgccagtcttgctcaatgttctccaccatgtcattcctgcagccctcaatcccattgtttatggagtgcgaactcatgagatcaagcaaggaatccagagattactaaacaaagggtga

SEQ ID NO: 1214 - protein, 314 aa, Canis familiaris
MTTHQNGTISIEISDFLLNCFVRSPSWQLSFSLPLSLLFLLAMGANGVLLITIWLEASLHEPMYYLLSILSLLDIVLCLTVIPKVLTIFWFDLKSINFYACFIQMYIMNCFLAMESCTFMVMAYDRYVAICHPLRYPSIITEQFVAKAAIFILARNAISTLPIPILSSRLHYCGGNVIENCICANMSVSKLSCDDVTINRLYQFAGGWTLLGSDLILIFLSYSLILRAVLRLKAEGAMAKALSTCGSHFILILFFSTILLVFVLTHVAKKKASPDVPVLLNVLHHVIPAALNPIVYGVRTHEIKQGIQRLLNKG

SEQ ID NO: 1215 - DNA, 960 bp, Canis familiaris
atgacagcgcaccaaaatggcaccacttcagttgtggtttcagacttcctcctgaattgtttagtcaggtctcccagctggaagttctggttgtccctgcccctaagcttcctcttcctcctggccatgggggccaatggtgttctcctggtcaccatccagctggaggcctctctgcatgagcccatgtactacctgctcagcatcctctctctgctggacatcatcctctgcctgactgttatacccaaggtcctggccatcttctggtttgatctcaggtccatcagcttctctgcctgcttcattcagatgtacatcatgaattgcttccttggcatggagtcttgcacattcatggtcatggcctatgaccgctatgtggccatctgccacccactgaggtactcttccatcatcactgatcaatttgtagctagggctgctatgtttattttggcgaggaatgcacttcttactatgttcattcctatcctctctgcccagctccattattgtggaaaaaatataattgagaactgtatctgtgccaacctctctgtgtccaagctctcctgtgataatgttttccttaacaaaatataccagttaattgtggcctggactcttctgggctctgacctagtcctcatcttcctctcgtatctcttcatcctaaaaactgttcttagacttaaggcaaaaggggcagctgccaaagctctgagcacatgcgggtcacacttcattctcatcctcttctttagcaccatcctgctggttttggtttttacccacattgccaaaaaaaaagtttcccctgatattcccatcttacttaatgtcctacaccatgtaattcctgcagctctcaatcccattgtctatgggatacgaacccaggagattaaagagggaattaggaaattactgaggagggtaacagagagattcaagtaa

SEQ ID NO: 1216 - protein, 319 aa, Canis familiaris
MTAHQNGTTSVVVSDFLLNCLVRSPSWKFWLSLPLSFLFLLAMGANGVLLVTIQLEASLHEPMYYLLSILSLLDIILCLTVIPKVLAIFWFDLRSISFSACFIQMYIMNCFLGMESCTFMVMAYDRYVAICHPLRYSSIITDQFVARAAMFILARNALLTMFIPILSAQLHYCGKNIIENCICANLSVSKLSCDNVFLNKIYQLIVAWTLLGSDLVLIFLSYLFILKTVLRLKAKGAAAKALSTCGSHFILILFFSTILLVLVFTHIAKKKVSPDIPILLNVLHHVIPAALNPIVYGIRTQEIKEGIRKLLRRVTERFK

SEQ ID NO: 1217 - DNA, 948 bp, Canis familiaris
atgacagcacatccaaatggtacaatctccattgaggtttcagacttcctcctgaattgttttgtcaggtctcccagctggaagctctggttgtccctgcccctaagcttcctcttcctcctggccatgggggcgaatagtgttctcttggtcaccatccagctagaggcctctcttcatgagcccatgtactacctgctgagcctcctttccctgttagacattgttgtctgcctcactgtcatccccaaggtcctggccatcttctggtttgacctcaagtccatcaacttctatgcctgctttatccagatgtacatcatgaattgcttcctttccatggagtcttgcacattcatggtcatggcctatgaccgctatgtggccatctgccacccactgaggtacccatccatcatcacagaacaatttgtagctaaggctgctgcctttattttggccagaaatgggattttaacagtgcctatcccaattctatcatcccgactcaattattgtgggagaaatgtcattgagaattgcatctgtgccaatatgtctgtctccaaactctcctgtgatgatgtcaccatcaatcgcctttaccagtttgctgtaggatggacactgctaggatctgacctcatcctcatcttcctctcctacagcctcatactgcgagctgtgctgggactcaaggcagagggtgctatggccaaggccctgagcacatgtggttctcatttcatccttatcctcttcttcagcaccatccttctggtcttcgtgctcactcttgtggtgaagaagaaagtctcccctgatgtgccagtcttgctcaatatcctccatcatgtcatcttctcagccctcaaccccattgtttatggagtgcgaactcaggagatcaagcaaggaatccagagattactgaagaaaggatggtag

SEQ ID NO: 1218 - protein, 315 aa, Canis familiaris
MTAHPNGTISIEVSDFLLNCFVRSPSWKLWLSLPLSFLFLLAMGANSVLLVTIQLEASLHEPMYYLLSLLSLLDIVVCLTVIPKVLAIFWFDLKSINFYACFIQMYIMNCFLSMESCTFMVMAYDRYVAICHPLRYPSIITEQFVAKAAAFILARNGILTVPIPILSSRLNYCGRNVIENCICANMSVSKLSCDDVTINRLYQFAVGWTLLGSDLILIFLSYSLILRAVLGLKAEGAMAKALSTCGSHFILILFFSTILLVFVLTLVVKKKVSPDVPVLLNILHHVIFSALNPIVYGVRTQEIKQGIQRLLKKGW

SEQ ID NO: 1219 - DNA, 942 bp, Canis familiaris
atgacacctcacagaaatggctccactggggtttcagagttcctcctgaattgttttgtcaggtcccccacttggcagctctggttatccctgcccctcagcatcttgttccttgtggccatgggggccaatgctgttctcctgatcaccatctggctggaggcctctctacaccagcccatgtactacctgctcagcctcctctccctcctggacattgttctctgcctcactgtcatccccaaggtcctggtcatcttctggtttgacctcaagtccatcagctttgatgcctgcttcctacagatgtacatcattaattgtttctatgccatggagtcctgcacatttatggtcatggcctatgaccgctatgtggccatctgccacccactgaggtacccatcaatcatcactgaacgatttgtagctaaggctgctgcctttattttggccagaaatgggattgtaacagtgactctccccattctatcatctcgactcaattattgtgggagaaatattattgagaattgcatttgcgccaatttgtctgtctccaagctctcctgtgatgatgtcaccatcaatcgcattctccaatttgctggaggctggacactgctaggatctgacctcatcctcatcttcctctcctacggccttatactccgagctgtgctgagactcaaggcagagggtgccatggccaaggccctgagcacatgtggttctcacttcatccttatcctcttcttcagcaccgtccttctggtcttcgtgctcactcatatgatgaagaagaaagtctcccctgatgtgccagtcttgctcaatgtcctccacaatgtcatccccgcagccctcaaccccattgtttatggagtgcgaacccaggagatcaagcaaggaatccagagattactgaagaaggggtggtag

SEQ ID NO: 1220 - protein, 313 aa, Canis familiaris
MTPHRNGSTGVSEFLLNCFVRSPTWQLWLSLPLSILFLVAMGANAVLLITIWLEASLHQPMYYLLSLLSLLDIVLCLTVIPKVLVIFWFDLKSISFDACFLQMYIINCFYAMESCTFMVMAYDRYVAICHPLRYPSIITERFVAKAAAFILARNGIVTVTLPILSSRLNYCGRNIIENCICANLSVSKLSCDDVTINRILQFAGGWTLLGSDLILIFLSYGLILRAVLRLKAEGAMAKALSTCGSHFILILFFSTVLLVFVLTHMMKKKVSPDVPVLLNVLHNVIPAALNPIVYGVRTQEIKQGIQRLLKKGW

SEQ ID NO: 1221 - DNA, 690 bp, Canis familiaris
caggtcctgctcatcttctggttcaacatgaagaccatcagctttgcaggctgctttctgcagatgttcatcatgaatacattccttcccatggagtcctccaccttcctggtcatggcctatgaccgctatgtggccatttgttatcctctccgctacccatccatcatcactgaaaaatttgtcacttatgcagctgtcttcattgtcttccgcaatttgctggccacactacccacaccagttctggctgccaggctcaactactgtgccagcaatgtggtggaaaactgtatctgtgccaacatttctgtagcaaagctctcctgtgggaatatccacctaaacaagctctaccagtttgtgagtgtttggtgtctactgggttctgacctggtgctcatcttgctatcctactgcttcatcttgagggctgttatgcgtctgcagtcaggaggtgcagccaccaaagccctgagtacttgtggttcccatctcattcttatacttttcttctatacattgctactagtcttcatctttacaaacaaggcaagaaagaaggtgcccttagaggtacccattcttcttaatgtcttacaccacctcattccaccagctctgaatcccattgtttatggagtacgaacccaggaaatcaaacaagggattatcaagctactcaagtac

SEQ ID NO: 1222 - protein, 230 aa, Canis familiaris
QVLLIFWFNMKTISFAGCFLQMFIMNTFLPMESSTFLVMAYDRYVAICYPLRYPSIITEKFVTYAAVFIVFRNLLATLPTPVLAARLNYCASNVVENCICANISVAKLSCGNIHLNKLYQFVSVWCLLGSDLVLILLSYCFILRAVMRLQSGGAATKALSTCGSHLILILFFYTLLLVFIFTNKARKKVPLEVPILLNVLHHLIPPALNPIVYGVRTQEIKQGIIKLLKY

SEQ ID NO: 1223 - DNA, 306 bp, Canis familiaris
aacaacacaggcacccaagtgactgaattcctgatgatctgcttcccaggattgcaggacacacagcattggctctctgtagtcctggctccccttctggttttggcccttggggctaactttgtgttgttactcaccatccagcaggagacatctctgcatgaacccatgtactacctgcttgccatcctttccatgctggacatcatcctttgcctcactgtcattcctaaggttagacccccctctagattcacttccaggtactcagtcatctatctctgaatagtattgttttgttgctat

SEQ ID NO: 1224 - protein, 94 aa, Canis familiaris
NNTGTQVTEFLMICFPGLQDTQHWLSVVLAPLLVLALGANFVLLLTIQQETSLHEPMYYLLAILSMLDIILCLTVIPKVRPPSRFTSRYSVIYL

SEQ ID NO: 1225 - DNA, 960 bp, Canis familiaris
atgatcagaacactttacatggcaccacccagcaactactccactgctccagtttctgaattcttcctcatctgcttccctaactaccagagttggcagcactggctgtccctgcccctcagcctcctcttcctcctggccatgggggccaacgccaccctcttgattactatccggctggaggcctctctgcatgagcccatgtactacctgcttggcctcctctccctgctggacatcgtgctctccctcactgtcatccccaaggtcctggccatcttctggtttgatctgaggtctatcagcttctctgcctgcttcctccagatgttcatcatgaacagtttcctccccatggagtcctgcacattcatggtcatggcctatgaccgctatgtggccatctgccacccattacgatactcatctatcattactgaccaatttgtagttagggctgccatctttgttgtggcccggaatggccttcttactatgcctatccccatactttcttcccggctcagatactgtgcagagaacatcatcaagaactgtatctgtactaacttgtctgtatccaaactttcctgtgatgacatcaccttcaatcaactctaccagttcgtggcaggctggactctactgggctctgacctcatcctaattattctgtcctactccttcatcctgaaagctgtgctaaggatcaaggctgagggtgctatggccaaagctctaggcacttgtggttctcacttcatcctcatcctcttctttagcacagtcctgttggttctagtcatcactaacctggccaggaagagaattcccccagatgtccccatcttgctcaacatcttgcaccacctcatccccccagctctgaaccccattgtttatggtgtgagaaccaaggatatcaagcaaggaatccagaagctacttagaagattgtaa

SEQ ID NO: 1226 - protein, 319 aa, Canis familiaris
MIRTLYMAPPSNYSTAPVSEFFLICFPNYQSWQHWLSLPLSLLFLLAMGANATLLITIRLEASLHEPMYYLLGLLSLLDIVLSLTVIPKVLAIFWFDLRSISFSACFLQMFIMNSFLPMESCTFMVMAYDRYVAICHPLRYSSIITDQFVVRAAIFVVARNGLLTMPIPILSSRLRYCAENIIKNCICTNLSVSKLSCDDITFNQLYQFVAGWTLLGSDLILIILSYSFILKAVLRIKAEGAMAKALGTCGSHFILILFFSTVLLVLVITNLARKRIPPDVPILLNILHHLIPPALNPIVYGVRTKDIKQGIQKLLRRL

SEQ ID NO: 1227 - DNA, 942 bp, Canis familiaris
atggcaccaccaagcaactactccactgctccagtctctgaattcctcctcatctgcttccctaactaccagagttggcagcactggctgtccctgcccctcagcctcctcttcctcctggccatgggggccaatgccaccctcttaatcactatccggctggaggcctctctgcacgagcccatgtactacctgctcagcctcctctccctgctggacatcgtgctctgcctcactgtcatccccaaggtcctggccatcttctggtttgatctgaggtccatcagcttctctgcctgcttcctccagatgttcatcatgaattgcttccttgccatggagtcctgcacattcatggtcatggcctatgaccgctatgtggccatctgccacccactgaggtacccatccatcatcactgaccaatttgtggttagagctaccatatttattgtggtcaggaatggcctcttttttcttcctgttccagtactttcttcccggctcagatactgtgcagagaacatcatcaagaactgtatatgcaccaacctgtctgtgtccaaactctcctgtgatgacatcaccttcaatcggctctaccagtttgtggcaggctggaccctattgggctctgacctcatcctaattattctgtcctactccttcatcctgaaagctgtgctaaggatcaaggctgagggtgctacagccaaggccctgagcacgtgtggttcccacttcatcctcattctcttcttcagcacagtcttgttggttctggtcatcactaacctggccaggaagagaattcctccagatgtccccatcctactcaacatcctgcaccacctcattcccccagctctgaaccctattgtttatggtgtgagaaccaacgagatcaagcaaggaatgcagaagctgctgagaaggttgtaa

SEQ ID NO: 1228 - protein, 313 aa, Canis familiaris
MAPPSNYSTAPVSEFLLICFPNYQSWQHWLSLPLSLLFLLAMGANATLLITIRLEASLHEPMYYLLSLLSLLDIVLCLTVIPKVLAIFWFDLRSISFSACFLQMFIMNCFLAMESCTFMVMAYDRYVAICHPLRYPSIITDQFVVRATIFIVVRNGLFFLPVPVLSSRLRYCAENIIKNCICTNLSVSKLSCDDITFNRLYQFVAGWTLLGSDLILIILSYSFILKAVLRIKAEGATAKALSTCGSHFILILFFSTVLLVLVITNLARKRIPPDVPILLNILHHLIPPALNPIVYGVRTNEIKQGMQKLLRRL

SEQ ID NO: 1229 - DNA, 945 bp, Canis familiaris
atggcttcacccagcaactactccactgctccagtctccgaattcctcctcatctgctttcctaactaccagagttggcagcactggctgtccctgcccctcagcctcctcttcctcctggccatgggggccaacgccaccctcttgatcactatccggctggaggcctctctgcatgagcccatgtactacctgctcagcctcctctccctgctggacatcgtgctctgcctcactgtcatccccaaggtcctggccatcttctggtttgatctgaggtccatcagcttctctgcctgcttcctccagatgttcatcatgaacagtttcctccccatggagtcttgcacattcatggtcatggcctatgaccgctatgtggccatctgccacccactgaggtatccatccatcatcactaaccaatttgtggccaaagctagtgctttcattgtcacccggaatgcccttctcactgcacctattcctattctcaccgcccagctccattattgtgggaaaaatgtcattgagaactgcatctgtgccaacttgtctgtgtccaggctatcctgtgacaatttcacccttaacagaatctaccaatttgtggctggttggactttactgggctcagatttcatcctcatcttcctctcctacacctttatcctaagagctgtgcttaggttcaaggctgagggggctgctgtcaaagctctgagcacatgtggctctcacttcatcctcatcctgttcttcagcaccatcctgctggttgttgtgttaacaaatgtggccagaaagagtgtccctatggacatcctcatcttgctcaatgtccttcatcacctcatacctcctgccttgaaccctattgtatatggagttcggaccaaagagataaaacaaggaatgaataaattgctgtggaaaaggatgtga

SEQ ID NO: 1230 - protein, 314 aa, Canis familiaris
MASPSNYSTAPVSEFLLICFPNYQSWQHWLSLPLSLLFLLAMGANATLLITIRLEASLHEPMYYLLSLLSLLDIVLCLTVIPKVLAIFWFDLRSISFSACFLQMFIMNSFLPMESCTFMVMAYDRYVAICHPLRYPSIITNQFVAKASAFIVTRNALLTAPIPILTAQLHYCGKNVIENCICANLSVSRLSCDNFTLNRIYQFVAGWTLLGSDFILIFLSYTFILRAVLRFKAEGAAVKALSTCGSHFILILFFSTILLVVVLTNVARKSVPMDILILLNVLHHLIPPALNPIVYGVRTKEIKQGMNKLLWKRM

SEQ ID NO: 1231 - DNA, 945 bp, Canis familiaris
atgacatcacccagcaactactctactgctccagtctccgaattcctcctcatctgctttcctaactaccagagttggcagcactggctgtctctgcccctcagcctcctcttcctcctggccatgggggccaacaccaccctcttgatcactatctggctggaggcctctctgcacgagcccatgtactacctgctcagcctcctctccctgctggacattgtgctctgcctcactgtcatccccaaggtcctggccatcttctggtttgatctgaggtccatcagcttctctgcctgcttcctccagatgttcatcatgaacagtttcctccccatggagtcctgcacattcatggtcatggcctatgaccgctatgtggccatctgccacccactgaggtatccatccatcatcactgaccaatttgtggccaaagctagtgttttcattgtgattcggaatgctttgctgctttcacctgtacccattctcaccgcccagctccattattgtgggaaaaatgtcattgagaactgcatctgtgccaacttgtctgtgtccaagctatcctgtgacaatttcacccttaacagaatctaccaatttgtggttgtttggactttactgggctcagatttcatcctcatcttcctctcctacacctttatcctaagagctgtgcttaggttcaaggatgagggggctgctgccaaagctctgagcacatgtggctctcacttcatcctcatcctgttcttcagcaccatcctgctggttgttgtgttgacaaatgtggccagaaagagtgtccccatggacatccccatcttgctcaatgtcctccatcacctcatacctcctgccttgaaccctattgtatatgggtttcgaaccaaagagttaaagcaggggtgtcagaagttattgcgatgggggctttaa

SEQ ID NO: 1232 - protein, 314 aa, Canis familiaris
MTSPSNYSTAPVSEFLLICFPNYQSWQHWLSLPLSLLFLLAMGANTTLLITIWLEASLHEPMYYLLSLLSLLDIVLCLTVIPKVLAIFWFDLRSISFSACFLQMFIMNSFLPMESCTFMVMAYDRYVAICHPLRYPSIITDQFVAKASVFIVIRNALLLSPVPILTAQLHYCGKNVIENCICANLSVSKLSCDNFTLNRIYQFVVVWTLLGSDFILIFLSYTFILRAVLRFKDEGAAAKALSTCGSHFILILFFSTILLVVVLTNVARKSVPMDIPILLNVLHHLIPPALNPIVYGFRTKELKQGCQKLLRWGL

SEQ ID NO: 1233 - DNA, 945 bp, Canis familiaris
atgccaaacttccagaataccacatctacttccatcattttcctgctaactggtgttcccgggctggaagccttccacacctggatctccattcccttctgctttctctacataaccgccctctcaggaaacagcctgatcctctttgccattgtcactcagcccagcctccacgaacccatgtattatttcctttccatgctgtctaccactgacctcggcctatccatatccaccctggtcaccatgttgggtatattctggttcaatgccagggagatcagctttaatgcttgcttgtcacagatgttctttattaaactcttcactgtcatggaatcctcggtgctgttggccatggcctttgatcgttttgtggccatctctaatccactcaggtatgccaccattttaaccgattccagaatagctcaaattggagtgacaattgtcatcaggggaacactaatgctgacaccaatggtagcacttcttaaaagactgtccttctgccgcagccacgtgctccaccactcctactgcttccaccctgatgtgatgaagctctcgtgcacagacaccaggatcaacaatgcagttgggctgacagccatgatctctactgttggtgtggactcaatcctcatcctcctttcttacattttgattattaagactgtcctcagcattgcatccccagaagagaggaagaaagccttcagcacatgtatctcccatattggggctgttgctattttctattttccattgatcagtctgtcctttgttcacagatttggaaaacgagctccagcctatgttcatacaatgattgctaacacttacctcttgatccctcctgtaatgaaccccatcatctacagcgtgaagacaaaacagatacgcagagctgtgataaaaattctctattccaaagacatgtag

SEQ ID NO: 1234 - protein, 314 aa, Canis familiaris
MPNFQNTTSTSIIFLLTGVPGLEAFHTWISIPFCFLYITALSGNSLILFAIVTQPSLHEPMYYFLSMLSTTDLGLSISTLVTMLGIFWFNAREISFNACLSQMFFIKLFTVMESSVLLAMAFDRFVAISNPLRYATILTDSRIAQIGVTIVIRGTLMLTPMVALLKRLSFCRSHVLHHSYCFHPDVMKLSCTDTRINNAVGLTAMISTVGVDSILILLSYILIIKTVLSIASPEERKKAFSTCISHIGAVAIFYFPLISLSFVHRFGKRAPAYVHTMIANTYLLIPPVMNPIIYSVKTKQIRRAVIKILYSKDM

SEQ ID NO: 1235 - DNA, 954 bp, Canis familiaris
atgatgacctttagtaattctagctggaggctactccagccttctttttttctgatgggcatccccggtttagaggaaagccagcactggatagcattgccactgtgtgtcctttatgtccttgctgtaatgggcaatgtcaccgtcatcttcatcatctggactgactcatccttgcaccagccgatgtacctctttctggccatgctatctggcattgacctggtgctggcctcctccactgcacccaaagcccttgcggtgctcctggctcatgcccatgagattgggtacactttctgcctgatccagatgttcttcatccatgcgttctcttccatggagtcaggggtacttgtggctatggctctggatcgctatgtagccatttgtcaccctctgcatcattccaccatcttgcgtccggggatcatcgggcgcattgggatggcagtgctggtgcgggggttagtcctcctcctccccttccctatcctgttgcagagactcctcttctgccgggccaccatcataggccatgcctattgtgaacatatggctgttgtaaaacttgcctgctcagaaaccacagtgaaccgagcttatgggttggcagtggccctgcttgtggttgggctagatgtcgtggccattggtatttcctatgccctcatcctgcagacagtgctgaaggtaccagggggtgaggcccgacttaaggcctttagcacatgtgggtctcatatttgtgttatcctgatcttctatgttcctggaatgttttccttcctcacacatcgctttggccaccatgtaccccaccacgtccatgttcttctggccacactctacctccttgtgccacctgcactcaatcctcttgtctatggggtgaagactcgacagatccgccagcgagtacttagagttttctccctaaaaggattgatctga

SEQ ID NO: 1236 - protein, 317 aa, Canis familiaris
MMTFSNSSWRLLQPSFFLMGIPGLEESQHWIALPLCVLYVLAVMGNVTVIFIIWTDSSLHQPMYLFLAMLSGIDLVLASSTAPKALAVLLAHAHEIGYTFCLIQMFFIHAFSSMESGVLVAMALDRYVAICHPLHHSTILRPGIIGRIGMAVLVRGLVLLLPFPILLQRLLFCRATIIGHAYCEHMAVVKLACSETTVNRAYGLAVALLVVGLDVVAIGISYALILQTVLKVPGGEARLKAFSTCGSHICVILIFYVPGMFSFLTHRFGHHVPHHVHVLLATLYLLVPPALNPLVYGVKTRQIRQRVLRVFSLKGLI

SEQ ID NO: 1237 - DNA, 966 bp, Canis familiaris
atggatatcaccctgagtataaccaatagctccaggtttcaagtacctgaattcatcctcctggggctcccaggcattcatgagtggcagcactggctctctctgcccctggctctgctctacatcttagctctttgtgccaacatcctcatcttaatcaccatccaacatgagccttccctgcaccagcccatgtattggttccttggtgtcttggctatagtggacattggcctggctaccactatcatacccaagatcctggccattctctggtttgatgccaaggccatcagcctccctgagtgctttgctcagatctatgccatccactcttttatgggcatggagtcaggcatcttcctctgcatggctatcgatagatatgtagccatttcctacccccttcggtacccctccatactcactgaggcttttgtgatcaaagtcacactgttcatggtgctcaggaatggcctgttgaccctcccagtgcctgtattggctgcccagagacactactgctccaggaacgaaattgaccactgtctatgctctaatttgggggtcactagtctggcctgtgatgacatcactattaacagattttaccagttggccttggtatgggttatggttgggggtgacatgggtctggtctttgcttcctatgctttgattattcgctcagtgctgaggctgaactctgctaaagcaacatcaaaggccctgagtacctgcagctcccatctcatcctcattctctttttctacacggctgttattgtggtgtctgtcacccagctggcaggaagaaaggtcccccttatccctgctctcttcaatgtgctgcacagtatcatgcccccagcctttaaccccatggtttatgccctccggacccaggagctgagagtgggcttccagagggtgcttggtttgggtgacaatgtgtccaggaagtga

SEQ ID NO: 1238 - protein, 321 aa, Canis familiaris
MDITLSITNSSRFQVPEFILLGLPGIHEWQHWLSLPLALLYILALCANILILITIQHEPSLHQPMYWFLGVLAIVDIGLATTIIPKILAILWFDAKAISLPECFAQIYAIHSFMGMESGIFLCMAIDRYVAISYPLRYPSILTEAFVIKVTLFMVLRNGLLTLPVPVLAAQRHYCSRNEIDHCLCSNLGVTSLACDDITINRFYQLALVWVMVGGDMGLVFASYALIIRSVLRLNSAKATSKALSTCSSHLILILFFYTAVIVVSVTQLAGRKVPLIPALFNVLHSIMPPAFNPMVYALRTQELRVGFQRVLGLGDNVSRK

SEQ ID NO: 1239 - DNA, 948 bp, Canis familiaris
atgatgacctttagtaattctagctggaggctactccagccttctttttttctgatgggcatccccggtttagaggaaagccagcactggatagcattgccactgtgtgtcctttatgtccttgctgtaatgggcaatgtcaccatcatcttcatcatctggactgactcatccttgcaccagccgatgtacctctttctggccatgctatctggcattgacctggtgctggcctcctccactgcacccaaaacccttgcggtgctcctggctcatgcccatgagattgggtacactttctgcctgatccagatgttcttcatccatgcgttctcttccatggagtcaggggtacttgtggccatggctctggatcgctatgtagccatttgtcaccctctgcatcattccaccatcttgcatccggggatcatcgggcgcattgggatggcagtgctggtgcgggggttagtcctcctcctccccttccctatcctgttgcagagactcctcttctgccgggccaccatcataggccatgcctattgtgaacatatggctgttgtaaaacttgcctgctcagaaaccacagtgaaccgagcttatgggttggcagtggccctgcttgtggttgggctagatgtcgtggccattggtatttcctatgccttcatcctgcagacagtgctgaaggtaccagggggtgaggcccgacttaaggcctttagcacatgtgggtctcatatttgtgttatcctgatcttctatgttcctggaatattctccttcctcacacatcgttttggccaccatgtaccccaccacgtccatgttcttctggccacactctacctccttgtgccacctgcactcaatcctcttgtctatggggtgaagactcaacagatccgccagcgagtacttagggttttctccctaaaaggatag

SEQ ID NO: 1240 - protein, 315 aa, Canis familiaris
MMTFSNSSWRLLQPSFFLMGIPGLEESQHWIALPLCVLYVLAVMGNVTIIFIIWTDSSLHQPMYLFLAMLSGIDLVLASSTAPKTLAVLLAHAHEIGYTFCLIQMFFIHAFSSMESGVLVAMALDRYVAICHPLHHSTILHPGIIGRIGMAVLVRGLVLLLPFPILLQRLLFCRATIIGHAYCEHMAVVKLACSETTVNRAYGLAVALLVVGLDVVAIGISYAFILQTVLKVPGGEARLKAFSTCGSHICVILIFYVPGIFSFLTHRFGHHVPHHVHVLLATLYLLVPPALNPLVYGVKTQQIRQRVLRVFSLKG

SEQ ID NO: 1241 - DNA, 960 bp, Canis familiaris
atgatcaccatgattctttccaataattctcacttcccacatactttcttcttggctggtatcccaggactgactgctgcccacatttggatctcacttcccttttgcttcatgttcttcctggcaatgactgggaattgtgtcctgctttttcttatccggacagagcgcagccttcaccagcccatgtttttctttcttgccatgctctcctttgtcgacctggttctctccctctccactctgcccaagatgctggccattttctggtttggtgctacagctatcagctcccactcctgtctttcccagatgttcttcatccatgcattctctgctatggagtcaggagtgctggtggccatggccatggaccgctttgtggccatctgtaacccactacattatgcaactattcttacaccatttgttgttgccaagattggaggcctggtggttctgcgaggtgtggggttgaccatctcctttccaaccttggcttgtcggctgccctactgtggctctcatacaattgcctatacctactgtgagcatatggcagtagtaaagttggcctgtggcgccaccactgtggataatctctatgcctttgctgtggcaatctttcttggtgtgggggatgtggcctttattgcttactcctatgggcagattgtgaggactgtgattaattttccttcacctgaggcacgtgctaaagcaggcagcacatgtacagctcatgtctgtgtcatcctcttcttctatggaccaggctttctttctgtggtcatgcagcgctttggcccacctacagcctctgctgctaaggttattcttgccaatctctacttgctctttccccctgccctggaccccattgtctatggggtcaagaccaaacagattcgtgatcagctgtttaaaatgctaaggcccaagcagattgatcccacctga

SEQ ID NO: 1242 - protein, 319 aa, Canis familiaris
MITMILSNNSHFPHTFFLAGIPGLTAAHIWISLPFCFMFFLAMTGNCVLLFLIRTERSLHQPMFFFLAMLSFVDLVLSLSTLPKMLAIFWFGATAISSHSCLSQMFFIHAFSAMESGVLVAMAMDRFVAICNPLHYATILTPFVVAKIGGLVVLRGVGLTISFPTLACRLPYCGSHTIAYTYCEHMAVVKLACGATTVDNLYAFAVAIFLGVGDVAFIAYSYGQIVRTVINFPSPEARAKAGSTCTAHVCVILFFYGPGFLSVVMQRFGPPTASAAKVILANLYLLFPPALDPIVYGVKTKQIRDQLFKMLRPKQIDPT

SEQ ID NO: 1243 - DNA, 888 bp, Canis familiaris
ggaatcccaggcattcatgagtggcagcaatggctctctctacccctgactctgctctgcatcttagctcttggtgccagtctcctcatggtgatcaccatccaacatgaagccatgctgcatgtgcttatgtaccactttctgggcatactggcagttgtggacatgggcctggccaccatgatcatgccaaaaatcctatctatcttctggtttaatgccaaggccatcagcctccctgagtgctttgctcagatttatgccatccactgcttcttgtgcatggaatcccgtacctttctctgcctggcagtggacagatatgcagccaattgtcacccacttcaatacccttccatagtcactgaagcttttgtgatcaaagccacagaatttatggtgctcaggaatggcctgtttactatcccagtgcctatactggcttcccagtcatgttattgctccaagaataaaattgaccactgcctgtgctctaatttgagagtcaccagtctggccagtgatgacatcactgtgaacaaattttaccaactggtcttagcatgaatcctgattgggagtgataagcctctggctttttcttcctacgtgttaatacttcgctctgtgctgaggttgaactcaccagaagcaatgtcaaaggctctcggtatccatagctcccacttcatcctcatcctcttcttctacacaggtatcattgtgctgtcacacaccgctgtcacacaccttgcagagaaaaagattcccctaaaacccatgctccttaatgtgctgcacaatgttatcccccctgcactcaatcccatggtctatgcactcaggatgcaggagctcagattgggcttccagacactgcttgggctg

SEQ ID NO: 1244 - protein, 188 aa, Canis familiaris
GIPGIHEWQQWLSLPLTLLCILALGASLLMVITIQHEAMLHVLMYHFLGILAVVDMGLATMIMPKILSIFWFNAKAISLPECFAQIYAIHCFLCMESRTFLCLAVDRYAANCHPLQYPSIVTEAFVIKATEFMVLRNGLFTIPVPILASQSCYCSKNKIDHCLCSNLRVTSLASDDITVNKFYQLVLA

SEQ ID NO: 1245 - DNA, 930 bp, Canis familiaris
cagtttttagtacctgaattcatcctcctggggctcccaggcattcatgagtggcagcactggctctctctgcccctggctctgctctacatcttagctctttgtgccaacatcctcatcttaatcaccatccaacatgagccttccctgcaccagcccatgtattggttccttggtgtcttggctatagtggacattggcctggctaccactatcatacccaagatcctggccattctctggtttgatgccaaggccatcagcctccctgagtgctttgctcagatctatgccatccactcttttatgggcatggagtcaggcatcttcctctgcatggctatcgatagatatgtagccatttcctacccccttcggtacccctccatactcactgaggcttttatgatcaaagtcacactgtccatggtgctcaggaatggcctgttgaccctcccagtgcctgtattggctgcccagagacactattgctccaggaacgaaattgaccactgtctatgctctaatttgggggtcactagtctggcctgtgatgacatcactattaacagattttaccagttggccttggcatgggttatgtttgggggtgacatgggtctggtctttgcttcctatgctttgattattcgctcagtgctgaggctgaactctgctaaagcaacatcaaaggccctgagtacctgcagctcccatctcatcctcattctctttttctacacggctgttattgtggtgtctgtcacccagctagcaggaagaaagttcccccttatccctgctctcttcaatgtgctgcacagtatcatgcccccagcctttaaccccatggtttatgccctccggacccaggagctgagagtgggcttccagagggtgcttggtttggatgacaatgtgtccaggaag

SEQ ID NO: 1246 - protein, 310 aa, Canis familiaris
QFLVPEFILLGLPGIHEWQHWLSLPLALLYILALCANILILITIQHEPSLHQPMYWFLGVLAIVDIGLATTIIPKILAILWFDAKAISLPECFAQIYAIHSFMGMESGIFLCMAIDRYVAISYPLRYPSILTEAFMIKVTLSMVLRNGLLTLPVPVLAAQRHYCSRNEIDHCLCSNLGVTSLACDDITINRFYQLALAWVMFGGDMGLVFASYALIIRSVLRLNSAKATSKALSTCSSHLILILFFYTAVIVVSVTQLAGRKFPLIPALFNVLHSIMPPAFNPMVYALRTQELRVGFQRVLGLDDNVSRK

SEQ ID NO: 1247 - DNA, 954 bp, Canis familiaris
gatatctcccagaatgcacccaacagctcaagatttcaagtgtctaacttcatcctgatggggcttccatgcattcatgaatggcagctctggctttccctgcccctggctgtgagatgtcttagctcttggtgccaacattcttattgtgatcactgttcaccataagtataacctctagagcccatgtatcaattccttagtgtcttggttatagtggacattggcttgtcaaaaatcatcatgcccaagattttggccatattctggtttgatgtcaaggccattagcttccctgagtgctttactcaaatttatgctgttcattgttttattagcatagagtcaggcatcttcttctgcatggctgtggatagatatgtagccatctgccaccccacttcaatactcctccatagttactgaagcttttgtggtaaaagcacagtgttcatggtgcttaggaatgtactgttgaccatcccagtgcctatagtgcccagagacactattgctcccggaatgaaattgagcactgcatgtgctccaacccaggggttactggcttggcccatgatgatattaccattaaaatgttctatcaattggctttggcatgggtcctgggtagaagtagcaaggttctagtctttatttcctatgctctaatctttcaatctgtgctggttctgcactctactgaggcaaataatcaaggctctgagcacctgccgttcccatctcatcttcatcttctttttctacacagccattgtgatggtatctatagctcatctggctggaaaagcagttcccatcttccctgttcttctaaatgtgctcaacattgtcatttccccagccctcaaccccatggtatatgctcttagggctcaggggttcagagtaggcttctggagggtatttgagttagaaaagaacgtgtccccaaaa

SEQ ID NO: 1248 - protein, 59 aa, Canis familiaris
MVSIAHLAGKAVPIFPVLLNVLNIVISPALNPMVYALRAQGFRVGFWRVFELEKNVSPK

SEQ ID NO: 1249 - DNA, 861 bp, Canis familiaris
ttccatcccactgtgttcatcctacttggcatcctgggactgggaaactaccatgccaggctttctatccccttctgccacatgtccatcactgcagtattgggaaatgaagccctcatccttgttgtcttcagtgaatgcaccctccatgaacccatgtatgtcttcctatccatgttggctggcactaatatcctgctgtccaccaccactgttcccaaggccctggctatcttttggtttcatgctggggagattgcccttgatgcctgcatcactcaggtgtttttcatacatgttgcctttgtggctgagtcaggtatcctgatggccatggcatttgaccactatgtggccatttgtactcccttgagatacataaccatcttaactcctatggcaattggaaaaatgactctggcaatcatgttcctgatcatattcctgttgaagagactgccatactgtcaaataaatatcatcccccacttataatgtgagcatatctgggtggccagattggcctgtgctgacatcactgtcaatatcttgtatggcttctcagtgccaatggcaccagttttggtagatattacactttacactttgattatccgagctgtgtttagacttccttcccaggattcctggcacaaagctctcaatacctgtggttcccacattgaaatcattctctttttcatcacatccttttttactttcttgacccattgatttggcaagaatatcccccaccatatccacatccttctggcaaatctctaagcattaatttcccccatgcttaatcccatcatctatggagcaaaaaccaagcaaatcagggacagtatggctcat

SEQ ID NO: 1250 - protein, 164 aa, Canis familiaris
FHPTVFILLGILGLGNYHARLSIPFCHMSITAVLGNEALILVVFSECTLHEPMYVFLSMLAGTNILLSTTTVPKALAIFWFHAGEIALDACITQVFFIHVAFVAESGILMAMAFDHYVAICTPLRYITILTPMAIGKMTLAIMFLIIFLLKRLPYCQINIIPHL

SEQ ID NO: 1251 - DNA, 969 bp, Canis familiaris
atgactcacaccaactttaccatcttccaccctgcagtttttgtcttactgggcatccctgggtgggaggcttaccacatttggctatcagtacccctctgcctcatgtatatcactgctgtcctggggaacaccatcctgatagtggtcatcatcacagatcgtaatcttcatgagcccatgtacttcttcctctctatgctggccatcacggacatcctgctgtctaccactactgtacccaaagctctagccatcttttggctccatgcccataatattgcttttgatgcttgtgtcacccaagttttctttgtccatgtgatgtttgtaggggagtcagccatcctattagctatggcctttgaccgctttgtggccatctgtgctcccttgcattatacaacagtgctaacatggcgagttgtgggaaggattgctctggccattgtcacccgaagcttttgcatcatcttcccagtgatcttcttattgaagcggctgcccttctgccggaccaacatcgtcccccattcctattgtgagcatattggagtggcccggttggcctgtgctgacatcaccattaacatctggtatggcttctcagtgcccattgtcatggtcatcttggatgtgatcctcattgctgtgtcttactcactgatcctccgagcagtgtttcgtttgccctcccaggatgcccggcacaaggccctcagcacttgtggctcccacctctgtgtcatcctcatgttttatgttccatccttctttacactattgacccaccgctttggacgtaacattcctcgacatgtccatatcctgctggccaatctttatgtggtggtaccacccatgctcaaccccatcgtctatggtgtgaagactaagcagatccgggagggtgtagcccaccggtttcttgacatcaagacttggtgctgtgcttcccctctgggctaa

SEQ ID NO: 1252 - protein, 322 aa, Canis familiaris
MTHTNFTIFHPAVFVLLGIPGWEAYHIWLSVPLCLMYITAVLGNTILIVVIITDRNLHEPMYFFLSMLAITDILLSTTTVPKALAIFWLHAHNIAFDACVTQVFFVHVMFVGESAILLAMAFDRFVAICAPLHYTTVLTWRVVGRIALAIVTRSFCIIFPVIFLLKRLPFCRTNIVPHSYCEHIGVARLACADITINIWYGFSVPIVMVILDVILIAVSYSLILRAVFRLPSQDARHKALSTCGSHLCVILMFYVPSFFTLLTHRFGRNIPRHVHILLANLYVVVPPMLNPIVYGVKTKQIREGVAHRFLDIKTWCCASPLG

SEQ ID NO: 1253 - DNA, 963 bp, Canis familiaris
atggcagaaggtccacatcccaactccaccttcccacgccccactttcttcatactgactggcattccagggttagggggtacccagacctggctgacactggtctttgggcccatgtatctgctggccctgctgggaaatggaacactgttggcattggtgcagatagactccacactgcagcagcccatgtttctactcctggccacactggcagccacagacctgggcttagccacatctatagccccagggttgcttgctgtgatgtggcttgggccccggcctgtgccatatggtgtctgcctggcccagatgttctttgttcatgcactgactgctgtggaatccggtgtactgttggccatggcctgtgatcgtgctgtggcagtagggcgtcccctacattaccctctcctaatcaccaaagcccgtgtaggctatgcagcactggcactggccctgaaagctgtggctattgttgtgcctttccctctgctggtggcgcgatttgagtacttccgagccaagaccatagaccatgcctactgtgcacacatggcagtggtagagctggtggtgggcaacacacaagctaacaatttgtatgggctggcactttcactggctgtgtcaggcatagatatcctgggcatcgctggctcttatggactcattgcccacactgtactgcggctgcctacctgggaggcccgggccaaggcctttggcacatgtagttcccacatctgtgtcattctggccttctatgtacctggtctcttctcatacctcacacatcgctttggtcgtcacaccatcccaaagcctgtgcacattcttctctctaacatctatttgctgctgccacctgccctcaacccactcatctatggagtccgcaccaagcaaatcagggaccggctcctggaaaccttcacattcagaaaaagccagctctaa

SEQ ID NO: 1254 - protein, 320 aa, Canis familiaris
MAEGPHPNSTFPRPTFFILTGIPGLGGTQTWLTLVFGPMYLLALLGNGTLLALVQIDSTLQQPMFLLLATLAATDLGLATSIAPGLLAVMWLGPRPVPYGVCLAQMFFVHALTAVESGVLLAMACDRAVAVGRPLHYPLLITKARVGYAALALALKAVAIVVPFPLLVARFEYFRAKTIDHAYCAHMAVVELVVGNTQANNLYGLALSLAVSGIDILGIAGSYGLIAHTVLRLPTWEARAKAFGTCSSHICVILAFYVPGLFSYLTHRFGRHTIPKPVHILLSNIYLLLPPALNPLIYGVRTKQIRDRLLETFTFRKSQL

SEQ ID NO: 1255 - DNA, 945 bp, Canis familiaris
atgccatttttcaatcaaagcattttccaccctgcagtcttccttcttactggcatccctggttttgaaagttaccatgcctggctctccatccctttctgttgtctctatgccattgccatctctgggaatggtatgatcttgtttgtcatcctcactgagtcaagccttcatgaacccatgtactatttcctctccatgctctccttcacggacctagggctgtgcctttccacattggtcaccatgctgcgtattttctggttcaatgctcaagaaatcagttttgatgcctgcattagccaaatgttctttatccatggtttcacattcatggagtcctctgtacttctggtgatggcctttgaccgcttcattgccatctgtaacccactgagatatgccacaatcttaaccaattcaaggatcatcaaagtgggctttgccattgttattagagggacaacggctctagtacctttactcctgctcttaaagcgtctatccttctgccgtagccatgttctgcaccattcatattgtttccaccctgatgtgatgaagctttcatgcacagataccaagatcaacagtgcatttggtttggctattgttatctctactgctggcatagactctgtcttgatcctcctctcctatgttctgatcatccactctgtgctcagcattgcctccccaaaggagcggaaaaaggcctttggtacttgtgtctcacacataagtgccgttgccatcttctacatccccatgatcagcttgtcactggtacacagatttgggaagcatgcccctccccttgtgcacacccttattgccaatgtttacctgctcatccctcctgtgatgaatcccataatctatagtgtgaagaccaagcaaattcgtaaggctgtgctcaaaattttcctttctaagctgatttag

SEQ ID NO: 1256 - protein, 314 aa, Canis familiaris
MPFFNQSIFHPAVFLLTGIPGFESYHAWLSIPFCCLYAIAISGNGMILFVILTESSLHEPMYYFLSMLSFTDLGLCLSTLVTMLRIFWFNAQEISFDACISQMFFIHGFTFMESSVLLVMAFDRFIAICNPLRYATILTNSRIIKVGFAIVIRGTTALVPLLLLLKRLSFCRSHVLHHSYCFHPDVMKLSCTDTKINSAFGLAIVISTAGIDSVLILLSYVLIIHSVLSIASPKERKKAFGTCVSHISAVAIFYIPMISLSLVHRFGKHAPPLVHTLIANVYLLIPPVMNPIIYSVKTKQIRKAVLKIFLSKLI

SEQ ID NO: 1257 - DNA, 903 bp, Canis familiaris
tcctcttccatcattttcctgctaactggtgttcccagcctggaagccttccacatctggatctccattccctcctgctttctctacataaccaccctctcgagaaacagtctgatcctctttgccattgtcactcagcccagcctccatgaacccatgtatgatttcctctccatgctgtctacccttggcctatccatatccaccctggtcactatgttgggtatattgtggtttgatgccagggagatcagctttaatgcctgcttgtcacagatatttttcattcaacacttcactgtcatggaatcctcagtgctgttgatcatggcctttgatcattttgtggccatctctagtcctcttaaatatccttctatcttaactgaccttaaaatagcacaggttggagtagcagtcatcaccagggggacactaatactgactcctatggtgttgcttctcaaatgattgtccttctgccacagccacgtactccaccactcctactgcttccaccctgatatgatgaagctctcatgcacagatgccaggatcaatagcgtagttgggttgacagccctgaagttcacaccattgctggagtgaactccatcttctttattttttcttatgttttaatctttaaggatgtcctcagcattgcatctccagaagagaggaagaaagccttcagcatatgcatctcacatattgaggttgttgctgtattctgtattccattgattagactgccctttgttcacaggtttgggaaatgggccccaccttatgtatgtactcttattgcctgcacttacctgctaatccccctgtgttgaactccatcctctatagcatgaagaccaacagatacgcagagctgtgttcaaagttctccat

SEQ ID NO: 1258 - protein, 156 aa, Canis familiaris
SSSIIFLLTGVPSLEAFHIWISIPSCFLYITTLSRNSLILFAIVTQPSLHEPMYDFLSMLSTLGLSISTLVTMLGILWFDAREISFNACLSQIFFIQHFTVMESSVLLIMAFDHFVAISSPLKYPSILTDLKIAQVGVAVITRGTLILTPMVLLLK

SEQ ID NO: 1259 - DNA, 945 bp, Canis familiaris
atgccaattttctataattctacttttcctactttcctcttgactggggtccctggacttgagtgggcccatgcctggatctcaatccccttctgttgcctctatttaactgctctttctgggaataccctgatcctgtttgtagtcctcactgagccaagcctccatgagcccatgtactatttcctctccatgttgtccaccactgacattggcttatgcatctctacactggtgacagtactaggaatattctggctcaatgcccgggagatcagctttaatgcttgcttatcacaaatgttcttcattcacctcttcacgttcatggaatcttcagtgctcctggctatggcttttgaccgttttgtggccatttccaaccccttgagatatgctaccattctaactcatgcaaggatcacacagattggtttggcagtcattatcagggggactgtcattctgacaccactagtcttgcttcttaagcgtctatcattctgccgaagttatgtgctccatcattcctactgcttccatcctgatgtaatgaagctctcgtgttcagacacaaagatcaacagtgcattcggactaacagcgattatctctactgctggagtggactctatctttatcctactttcctatgtcctgatcattcgctcagttctcaacattgcatccccggaggaaaggaaaaaggcctttagcacctgcatttctcatatcctggccgtggccatattctacatccctttaatcagcctgtcttttgttcatagatttggaaaacattctccaccatatgtgcccacactgattgctaatatttacttgctcattccccctgtgatgaatcccatcatctatagtgtgaaaacaaagcagattcaaaaagctgtgctcaaacttgtatgttccaagggaactcgtatttaa

SEQ ID NO: 1260 - protein, 314 aa, Canis familiaris
MPIFYNSTFPTFLLTGVPGLEWAHAWISIPFCCLYLTALSGNTLILFVVLTEPSLHEPMYYFLSMLSTTDIGLCISTLVTVLGIFWLNAREISFNACLSQMFFIHLFTFMESSVLLAMAFDRFVAISNPLRYATILTHARITQIGLAVIIRGTVILTPLVLLLKRLSFCRSYVLHHSYCFHPDVMKLSCSDTKINSAFGLTAIISTAGVDSIFILLSYVLIIRSVLNIASPEERKKAFSTCISHILAVAIFYIPLISLSFVHRFGKHSPPYVPTLIANIYLLIPPVMNPIIYSVKTKQIQKAVLKLVCSKGTRI

SEQ ID NO: 1261 - DNA, 978 bp, Canis familiaris
atgctacaaatccaggaaaacatgcagatcttaagcaacctgacatctaaatttccaaccttcttgttggctggcattcctggcctagaatctgcccatgtgtggatctctatccccttctgttgtctctataccactgccctctccgggaatagcatgatcctgtttgtcatcattacccagaagagtctccatgagcccatgtactattttctctccatgctttcagctgctgacttaggcttgactgtttctacaatgtcaacaacattaagtatcctctggtttgatgcaattgaaatcaatctggatacctgcattatccaaatgttttttcttcatggatttaccttcatagaatctggggtgctggtggctatggcctttgaccgctatgtggccatctgtgatcctctgaggtacactacccttctcactaattctagaatcattcagatgggcctgttaatgactatacgcactttagtattagtagtaccaccacttttgctccttaaacccctctatttctgtagaacaaatgtcctttcccactcctactgctaccacccagatgtgattaaattagcatgttcagatacttgggccaatagcatctgtggattaattgatctcatcctgacaacaggaatagatacaccatgcattatcttgtcttatattttgatcattcattctgtcctcagtattgcctcccctgaagagagacataaggtctttaacacttgtatctcccacattggagcagtggctgttttctatatccccatgatgagcctgtctttggttcatcgttatggtccatcagcacccaaaatagtccatttgatgatggccaatatatatctgcttttgcctcctgtgctcaaccccatcatctatagtgtaaaaacaaaacagattcgcaaggctatatactcagtcttctccttacaaaataaacagatgattgcctga

SEQ ID NO: 1262 - protein, 325 aa, Canis familiaris
MLQIQENMQILSNLTSKFPTFLLAGIPGLESAHVWISIPFCCLYTTALSGNSMILFVIITQKSLHEPMYYFLSMLSAADLGLTVSTMSTTLSILWFDAIEINLDTCIIQMFFLHGFTFIESGVLVAMAFDRYVAICDPLRYTTLLTNSRIIQMGLLMTIRTLVLVVPPLLLLKPLYFCRTNVLSHSYCYHPDVIKLACSDTWANSICGLIDLILTTGIDTPCIILSYILIIHSVLSIASPEERHKVFNTCISHIGAVAVFYIPMMSLSLVHRYGPSAPKIVHLMMANIYLLLPPVLNPIIYSVKTKQIRKAIYSVFSLQNKQMIA

SEQ ID NO: 1263 - DNA, 870 bp, Canis familiaris
ctacttggaatcccaggactggagaattaccaattttggattgcctctcctctatgtgccatgtatttcgtagctatagttggcaatatcattatccttcatataatctgaactgaccacaccctgcttgagcccatgtacctttttctagccatgctggctatcactgacctggctctatcctcttccacgcaacctaaaatgctggctatactctggtttcgtgctcatgagattgaataccatgcctgcctcatccaggtgttcttcatccatgccttttcctctgtgaagtccaggttgttcatggctatggccttggacaattatgtggctatctgtttcccactccaccactctactttcctgaccccacccagctgagtgggtaaactgggagtagctgtgatgatgagaggattgctatgggtgagccccttctgcattatggtctccaggatgcccttctgccccaaacacatcattgtccagtcatactgtgagcacatggctgtgttaaagctggtgtgtgcagacactagagtaaaccgtgcctatgggctctttccggctttctcggtggttggctttgatataattgtcatcagtacatcccatgtgatgattctgagaactgttctggggttgccctctgatgaagccaagttcaaggcttttggcacatgtgcttcccttatctgtatcatcttggctttttatatcccagccctctttactttcctcactcaccgctttggacaccatgtgcctcaagtggtacatatcatgtttaccaatttctatctcctggtacctcccatgctcaaccccatcatctatggagtcagaaccaagcagatcagggacagg

SEQ ID NO: 1264 - protein, 154 aa, Canis familiaris
MMRGLLWVSPFCIMVSRMPFCPKHIIVQSYCEHMAVLKLVCADTRVNRAYGLFPAFSVVGFDIIVISTSHVMILRTVLGLPSDEAKFKAFGTCASLICIILAFYIPALFTFLTHRFGHHVPQVVHIMFTNFYLLVPPMLNPIIYGVRTKQIRDR

SEQ ID NO: 1265 - DNA, 945 bp, Canis familiaris
atactggcttcagggaacagctcttcacatcctgtgttcttgatcctacttggaatcccaggactggagaattaccaattttggattgcctttcctctatgtgccatgtattttgttattagctatagttggcaatatcattatccttcatataatctgaactgaccacaccctgcttgagcccatgtacctttttctagccatgctggctatcactgacctggctctatcctcttccacgcaacctaaaatgctggctatactctggtttcgtgctcatgagattgaataccatgcctgcctcatccaggtgttcttcatccatgccttttcctctgtgaagtccaggttgttcatggctatggccttggacaattatgtggctatctgtttcccactccaccactctactttcctgaccccagctgagtgggtaaactgggagtagctgtgatgatgagaggattgctatgggtgagccccttctgcattatggtctccaggatgcccttctgccccaaacacatcattgtccagtcatactgtgagcacatggctgtgttaaagctggtgtgtgcagacactagagtaaaccgtgcctatgggctctttccggctttctcggtggttggctttgatataattgtcatcagtacatcccatgtgatgattctgagaactgttctggggttgccctctgatgaagcccggttcaaggcttttggcacatgtgcttcccttatctgtatcatcttggctttttatatcccagccctctttactttcctcactcaccgctttggacaccatgtgcctcaagtggtacatatcatgtttaccaatttctatctcctggtacctcccatgctcaaccccatcatctatggagtcagtaccaagcagatcagggacagggatattcaaggttgttgtggaaaagatccc

SEQ ID NO: 1266 - protein, 164 aa, Canis familiaris
MMRGLLWVSPFCIMVSRMPFCPKHIIVQSYCEHMAVLKLVCADTRVNRAYGLFPAFSVVGFDIIVISTSHVMILRTVLGLPSDEARFKAFGTCASLICIILAFYIPALFTFLTHRFGHHVPQVVHIMFTNFYLLVPPMLNPIIYGVSTKQIRDRDIQGCCGKDP

SEQ ID NO: 1267 - DNA, 216 bp, Canis familiaris
atgttacaaatccaggaaaacatgcagatcttaagcaacttgacatctaaatttccaaccttcttgttggctggcattcctggcctagaatgtgtccatgtgtggatctctatccccttctgctgtctctataccattgccctctctggaaatagcatgatcctatttgtcatcattacccagaagagtttccaagagcccatgcactattttctt

SEQ ID NO: 1268 - protein, 72 aa, Canis familiaris
MLQIQENMQILSNLTSKFPTFLLAGIPGLECVHVWISIPFCCLYTIALSGNSMILFVIITQKSFQEPMHYFL

SEQ ID NO: 1269 - DNA, 987 bp, Canis familiaris
atgctggcttcagggaacagctcttcacaacctgtatcctttatcctacttgggatcccaggactggagaattaccaattttggattgcctttccattttgtgccatgtatctcatagctatagtaggcaatgtcattgtccttcatataatccgaactgaccacaccctgcatgagcccatgtacctttttctagccatgctggctatcactgacctggctctatcctcctccacacaacctaaaatgctggctatactctggtttcgtgctcatgagattgaataccatgcctgcctcatccaggtgttcttcatccatgccttttcctccgtggagtccgggttgctcatggctatggccttggaccgttatgtggctatctgcttcccactccaccactctactttcctgaccccagctgtagtgggtaaactgggagcagctgtgatgatgagaggtttgctatgggtgagccccttctgcattatggtctccaggatgcccttctgcaacaaccacgtcattccccagtcatactgtgagcacatggctatgttaaagctggtgtgtgcagacactagagtaaaccgtgcatatgggctctttgtggccttctctgtggttggctttgatataattgtcatcagtatatcctatgtgatgattctgagaactgttctggggttgccctctgatgaagcccggttcaaggcttttggcacatgtgcttcccatatctgtgtcatcttggctttttatattccagccctctttactttcctcacccaccgctttggacatcatgtgccccgagtggtccatatcatgttcgccaatttctatctactggtacctcccatgctcaaccccatcatctatggagtcagaaccaagcagatcagggacagggttattcaaggttgttgtggaaaagtccctaagccaagggtcacagcatcacaaccaacctcgccaccccactga

SEQ ID NO: 1270 - protein, 328 aa, Canis familiaris
MLASGNSSSQPVSFILLGIPGLENYQFWIAFPFCAMYLIAIVGNVIVLHIIRTDHTLHEPMYLFLAMLAITDLALSSSTQPKMLAILWFRAHEIEYHACLIQVFFIHAFSSVESGLLMAMALDRYVAICFPLHHSTFLTPAVVGKLGAAVMMRGLLWVSPFCIMVSRMPFCNNHVIPQSYCEHMAMLKLVCADTRVNRAYGLFVAFSVVGFDIIVISISYVMILRTVLGLPSDEARFKAFGTCASHICVILAFYIPALFTFLTHRFGHHVPRVVHIMFANFYLLVPPMLNPIIYGVRTKQIRDRVIQGCCGKVPKPRVTASQPTSPPH

SEQ ID NO: 1271 - DNA, 945 bp, Canis familiaris
atgctggcatcagggaacagctcttcacatcctgtgttcttcatcctacttgggatcccaggcctggaaaattaccagttttggattgcctttcctctatgtgccatgtatctagtagctatagttggaaatttcattacccttcatataatccgaactgaccacaccctgcatgagcccatgtacctttttctagccatgctggctatcactgacctggctctatcctcctccacacaacctaaaatgctggctatactctggtttcatgctcatgagattgaataccatgcctgcctcatccaggtgttcttcatccatgccttttcctccgtggagtccgggttgctcatggctatggccttggaccgttatgtggctatctgcttcccactccaccactctactatcctgaccccaactgtagtgggtaaactgggagcagttgtgatgatgagaggtttgctatgggtgagccccttctgcattatggtctccaggatgcccttctgcaacaaccacgtcattgcccagtcatactgtgagcacatggctgtgttaaagctggtgtgtgcagacactagagtaaaccgtgcatatgggctctttgcggccttctctgtggttggctttgatataattgtcatcagtatatcctatgtgatgattctgagaactgttctggggttgccctctgatgaagcccagttcaaggcttttggcacatgtgcttcccatatctgtgtcatcttggctttttatattccagccctctttactttcctcacccaccgctttggacaccatgtgccccgagtggtccatatcatgttcgccaatttctatctacttgtacctcccatgctcaaccccatcatctatggagtcagaaccaagcagatcagggacagggttattcaaggttgttgtggaaaagatccctaa

SEQ ID NO: 1272 - protein, 314 aa, Canis familiaris
MLASGNSSSHPVFFILLGIPGLENYQFWIAFPLCAMYLVAIVGNFITLHIIRTDHTLHEPMYLFLAMLAITDLALSSSTQPKMLAILWFHAHEIEYHACLIQVFFIHAFSSVESGLLMAMALDRYVAICFPLHHSTILTPTVVGKLGAVVMMRGLLWVSPFCIMVSRMPFCNNHVIAQSYCEHMAVLKLVCADTRVNRAYGLFAAFSVVGFDIIVISISYVMILRTVLGLPSDEAQFKAFGTCASHICVILAFYIPALFTFLTHRFGHHVPRVVHIMFANFYLLVPPMLNPIIYGVRTKQIRDRVIQGCCGKDP

SEQ ID NO: 1273 - DNA, 945 bp, Canis familiaris
atgttggtcctcaataataccaatgctcaacctctgaccttcttcctgacgggtatcccaggcctgagagcagcccaggtttggatctccatccctttttgtctcctgtatgtcatcgccctctctgggaacagcatgatcctatttgtggtcttccgtgagcagaatctccatgaaccaatgtattatttcctctctatgctttcagccacagacctgagcttatccctgtgcacactttctactactcttggtgtcttctggtttgaagctcgagaaatcaccttaagtgcctgcattgcccagatgttctttctccatggatttactttcatggagtctggggttctgctggccatggcctttgatcgttttgtagccatctgtaatccactgagatacaccaccatcctcaccaatgccagaattacccagattggggtgagcatgttgataaggaacgttgctgtcatgttaccagtggtgctctttgttaagaggctgtccttctgcggtgcagtggtcctttcacattcttactgttaccatgttgacctcattcaactctcatgcacagacaacagaatcaacagcatcctcggtctgtttgcacttttctccacaacaggatttgattgtccttgcatcttgctctcctatgtactgatcatccggtctgttctcagcattgcctcctcagaggggcggcaaaaagccttcaacacctgcatatcccacatcagtgctgttgccatcttttacatcccccttgtcagcttgtctcttgtccatcgctatggccattcagcacctccatttgtccacaccatcatggccaatgtcttccttctcatccctcccgtgctcaaccccatcatctatagtgtgaagactaagcagattcgaaaggctattgtcaaggtcttaattcagaagcagcaataa

SEQ ID NO: 1274 - protein, 314 aa, Canis familiaris
MLVLNNTNAQPLTFFLTGIPGLRAAQVWISIPFCLLYVIALSGNSMILFVVFREQNLHEPMYYFLSMLSATDLSLSLCTLSTTLGVFWFEAREITLSACIAQMFFLHGFTFMESGVLLAMAFDRFVAICNPLRYTTILTNARITQIGVSMLIRNVAVMLPVVLFVKRLSFCGAVVLSHSYCYHVDLIQLSCTDNRINSILGLFALFSTTGFDCPCILLSYVLIIRSVLSIASSEGRQKAFNTCISHISAVAIFYIPLVSLSLVHRYGHSAPPFVHTIMANVFLLIPPVLNPIIYSVKTKQIRKAIVKVLIQKQQ

SEQ ID NO: 1275 - DNA, 951 bp, Canis familiaris
aatgtgtcctatagcagctttctgctggtgggcttcccagggctgcaggagtcccgcgccctcctggtgctgcccttcctcagcctctatctggtgatcgtctctgccaatgcgctggtcatccacacagtggtggcccagcggagcctgcatcagcccatgtacctgctcattgccctgctcctcgctgtgaacatctgtgttgccaccactgtgcttcccaccatgatgttcagcttctccacctacttcaaccacatctccctgcctcgctgtctgttccagatgttctgcatctacttcctcattgtctttgactgcaatatcctcctggtcatggccctagaccgctatgttgccatctgctaccctctccgctatcccaagctagtgacagcccagctgctggctggcctgctgggcgcggcagctgccaggagcacttgcatcgttgctcccgtggtggggttggcctcccaggttcgcttctgccgttcacacataatccaccactttgcctgtgagcacatggccctcatgaagctctcctgtggggacatctccctgaacaagactgtggggctcactgtccgcatcttcaacagagtcctggacatgctactacttggagcttcctactcccgcatcatccatgccgccttccggatttcatcaggtagagcacgttccaaggccctgaacacctgtggctcccacctgctggtcatcttcaccatctactcttccaccatgtcctcatccgtcgtctaccgtgtggctcgcgccgcctcataggacgtgcacaacctgctcagtgccttctacctgctgctcccgtgtctggtgaaccccttcatctatggagccaggaccaaggaaatccggcaacacctggccactctgttccaaagggcacagctaccagcgccccctgagaagccccagtctctg

SEQ ID NO: 1276 - protein, 264 aa, Canis familiaris
NVSYSSFLLVGFPGLQESRALLVLPFLSLYLVIVSANALVIHTVVAQRSLHQPMYLLIALLLAVNICVATTVLPTMMFSFSTYFNHISLPRCLFQMFCIYFLIVFDCNILLVMALDRYVAICYPLRYPKLVTAQLLAGLLGAAAARSTCIVAPVVGLASQVRFCRSHIIHHFACEHMALMKLSCGDISLNKTVGLTVRIFNRVLDMLLLGASYSRIIHAAFRISSGRARSKALNTCGSHLLVIFTIYSSTMSSSVVYRVARAAS

SEQ ID NO: 1277 - DNA, 954 bp, Canis familiaris
atgctcacttctcataatgtctgttcagtacccagctccttccagctcactggcatcccagggctggagtccctacatatctggctttccatcccctttggctccatgtacctagttgctgtggtggggaatgtcaccattctggctgtggtaaaggtggagcatagcctgcatcagcccatgtatttcttcctgtgtatgttggctgtcatcgacctggttctgtctacttctactatgcccaaactgctgggaatcttctggtttggtgctggagacattggcctggatgcctgcctagctcaaatgttcctcatccactgctttgccacagttgagtccgggatcttccttgccatggcttttgaccgctatgtagccatctgcaacccactccatcacactacagtgctcactcatactgtggtaggacgtttggggctggctgccctcctccggggtgtactctacatcggacccctgcctttgatgatccgcctgcggctgcccctttacaaatctcgtgtcatctcccactcctactgtgagcacatggctgtggtcaccttgacctgtggtgacagcagggtcaacaatgtctatgggctgagcattggctttctggtcctgatcctggactcaacagccattgctgcctcttatgtgatgattttccgggctgtgatggggctggccactccggaggccaggcttaaaaccctgggaacatgtggttctcacatctgtgccattctgatcttttatgttcctattgctgtttcttctctcattcatcgatttggtcaccaggtgcctcctccaatccacactctactggccaacttctacctcctcattcctccaatcctcaatcccattgtctatgctgtccgcaccaagcagatccgagagcggcttctccaaatcctcaagatagaaaccaaaatcaaatga

SEQ ID NO: 1278 - protein, 317 aa, Canis familiaris
MLTSHNVCSVPSSFQLTGIPGLESLHIWLSIPFGSMYLVAVVGNVTILAVVKVEHSLHQPMYFFLCMLAVIDLVLSTSTMPKLLGIFWFGAGDIGLDACLAQMFLIHCFATVESGIFLAMAFDRYVAICNPLHHTTVLTHTVVGRLGLAALLRGVLYIGPLPLMIRLRLPLYKSRVISHSYCEHMAVVTLTCGDSRVNNVYGLSIGFLVLILDSTAIAASYVMIFRAVMGLATPEARLKTLGTCGSHICAILIFYVPIAVSSLIHRFGHQVPPPIHTLLANFYLLIPPILNPIVYAVRTKQIRERLLQILKIETKIK

SEQ ID NO: 1279 - DNA, 960 bp, Canis familiaris
atgagagacctatttgtgatgtttgctctcaatacctcagaagttgaaatctccaccttcctgttgattggaatcccagggcttgagcatgtgcacatttggatctccatccccatctgcttcatgtacctcctggccatcctgggcaactgcaccatcctatttgttatcaggacagagccttctctgcatgagcctatgtactatttcctctctatgctggccctatctgacctgggcttgtctttctcttctcttccctccatgatgagaatcttcttgttcaatgccatggagatttctgctgatgcatgtattgcccaggaatttttcatccatggattcacagacatggaatcctcagtgcttctaatcatgtcctttgatcgctttctagccattcgcaaccccctgaggtatagctctattcttaccagctccagagttttgcatattggactgacatttgctattaaaagcattctactagttcttcctcttcctttcactttaaagagactccaatactgtaataaacgcctgctttcacactcctattgcctccaccaggatgtgatgaaactggcctgctctgacaatagggttaacttttactatggtctgtttgttgcactctgcatgatgtcagacagtgtgttcattgcagtttcctatgtgttcatcctgaagactgtattgggtattgcttcccatggggagcgactgaaagcccttaatacctgtgtgtcccacatctgtgctgtgctcatcttctatgtgcccatcatcaccttggctaccatgcatcgctttgccaagcataaatcccctctggctatgattctgatagctgatgcattcttgttggtaccacctttgatgaaccctattgtgtattgtgtaaaaactcggcagattagagtaaaagtcctggaaaaactgagtctaaagtctaaatga

SEQ ID NO: 1280 - protein, 319 aa, Canis familiaris
MRDLFVMFALNTSEVEISTFLLIGIPGLEHVHIWISIPICFMYLLAILGNCTILFVIRTEPSLHEPMYYFLSMLALSDLGLSFSSLPSMMRIFLFNAMEISADACIAQEFFIHGFTDMESSVLLIMSFDRFLAIRNPLRYSSILTSSRVLHIGLTFAIKSILLVLPLPFTLKRLQYCNKRLLSHSYCLHQDVMKLACSDNRVNFYYGLFVALCMMSDSVFIAVSYVFILKTVLGIASHGERLKALNTCVSHICAVLIFYVPIITLATMHRFAKHKSPLAMILIADAFLLVPPLMNPIVYCVKTRQIRVKVLEKLSLKSK

SEQ ID NO: 1281 - DNA, 966 bp, Canis familiaris
atgtcaacattcaaccaggcagtccacaataacacttcaatggcccccaccttcctgttggtgggcatgccaggtctgtcagctgtaccctcctggtggacaataccactcatcaccatctaccttctctctgccctgggcaatggtactatcctctggatcattgccctggatcccaccctgcaccgcccaatgtacttcttcctcttcctgctgagtgtgtctgatgttggcttggccacagccctgatgcccaccctgctgggtcttgcccttgctggcgtccatgctgtccctgcctcagcttgcctcctacagatgttctttgtccatgtcttttctgtcatggagtcctctgttttgcttgccatggccttagatcgagcactagccatctgccgccctctccactacccaacacttctcaccaatgatgtcattagcaagattggcctggctatagccttccgatgcttgggtctccacctgcccctgccattcctcctggctcacatgccctactgccacccacaggttctgacccattcttactgcttgcacccagatatagcccatttggcctgtccaggagcttggggtgcattctatagcctctttgtggttctgtcagccatgggattagaccccctgcttattttcttctcctatggcctaattggcagggtgttgcaaggtttgggatccagtgaggatcgctggaaggctggtcaaacctgtgctgcccatctctctgctgtgctcctcttttacatgcccatgatctttctggctctcattgaccgtctcagggtgccaatacctcagcctgcccatactcttctctcctatatccacttcctgcttcctccattgataaaccccattctctatagtgtcaagatgaaggagattagagagagaatactcaagaagttacagcccaggaaggtgggttgtgttcaatga

SEQ ID NO: 1282 - protein, 321 aa, Canis familiaris
MSTFNQAVHNNTSMAPTFLLVGMPGLSAVPSWWTIPLITIYLLSALGNGTILWIIALDPTLHRPMYFFLFLLSVSDVGLATALMPTLLGLALAGVHAVPASACLLQMFFVHVFSVMESSVLLAMALDRALAICRPLHYPTLLTNDVISKIGLAIAFRCLGLHLPLPFLLAHMPYCHPQVLTHSYCLHPDIAHLACPGAWGAFYSLFVVLSAMGLDPLLIFFSYGLIGRVLQGLGSSEDRWKAGQTCAAHLSAVLLFYMPMIFLALIDRLRVPIPQPAHTLLSYIHFLLPPLINPILYSVKMKEIRERILKKLQPRKVGCVQ

SEQ ID NO: 1283 - DNA, 957 bp, Canis familiaris
atggcagataataattattctcacttccaacatccttactttgtcttaactggaattccagggcttgaacaaaagtattattggatggcattcccactgggtgctatatatatcatcgccctttttggcaatggtgtcattatttctaccatcaagtctgaatcatccctgcatatccctatgtactattttctgttcatgctggcattggcagacatggggcttgccctttgtactttgccctctatgctaggcatattttggtttaactataagtccattgcttttgatgcctgccttgttcagatgtacttcattcataccttctctgccattgaatctggcgtgctggtggccatggcttttgatcgggttgtagccatctgggaccccctcaggtatggtaccatcttaaccaatggtgtggtcggcagaacaggggccatcatcctgataagagcagtctttgtggtcttccctgtgcctttcctcatcaagcgtcttcccttctaccgctccaacatcctctcccactccttctgcctccaccaagacgtcatgcgacttgcctgtgccagcactcgtgtcaacagtctctatggacttattgctgtcatcttcaccaagggttctgactccctctccatcctcttctcctatgtgttcatattccgaacagtaatggccattgcctcagggaagggccggctgaaggcactcaacacctgtgtttcacatatctgtgctgtacttatcttctatgttccactcattggggtatctgtcattcaccgttttggaaagcatctttcaccactgactcatgctctcatggctaatgcctaccttcttgtaccccctgtgcttaaccctatagtctatactgtgaagaccaaggagatacgaaagaaaatcatccaaatatttgttcaaaccaagattaccgcagaaggttag

SEQ ID NO: 1284 - protein, 318 aa, Canis familiaris
MADNNYSHFQHPYFVLTGIPGLEQKYYWMAFPLGAIYIIALFGNGVIISTIKSESSLHIPMYYFLFMLALADMGLALCTLPSMLGIFWFNYKSIAFDACLVQMYFIHTFSAIESGVLVAMAFDRVVAIWDPLRYGTILTNGVVGRTGAIILIRAVFVVFPVPFLIKRLPFYRSNILSHSFCLHQDVMRLACASTRVNSLYGLIAVIFTKGSDSLSILFSYVFIFRTVMAIASGKGRLKALNTCVSHICAVLIFYVPLIGVSVIHRFGKHLSPLTHALMANAYLLVPPVLNPIVYTVKTKEIRKKIIQIFVQTKITAEG

SEQ ID NO: 1285 - DNA, 954 bp, Canis familiaris
atgacaatgaactcaaacgcatcacatgtgaaccaccacagtttcattttgacgggtatccctgggatgccagataaaaatgcatggatggcctttcccctgggatttctctacacactaactctcctgggaaatggtaccatcttaactgtcatcaaggtagatgagagtctccatgagcctatgtactacttcctctccatcttggctctcactgatgttagtctctccatgtccaccttgccctccatgctcagcatcttctggtttaatgtccctgagattccttttgatgcatgcattacacagatgtttttcatccatggatttggagtggtagaatcaggagtattagtgtccatggccttcgacagatttgtggccatccgagatccattacgctatgcttccatcctcacccatggcatcattggaaagattggaatagttgtcctcacccgggcagtctgtgtggtgttccctgtgcccttccttataaagcggctacctttttgccattccaatgtcttgtctcattcttattgtctccaccaagatgcaatgaggctagcctgtgccagtacccgcatcaacagtctctacggcctcatcatagtcatcttcacattggggctggatgctattatcattctcttttcttatgtgctcatcctgaagactgtgctgggcattgcttccagagatgaaaggctcaaagctctcaacacctgcctctctcacatctgtgctgtgctcctcttctatattcctctcattggagtcaccatgatccacagatttggaaagcatttatcaccagtggtgcacacactcatggccaatatctatctgttactcccccctgtgctcaatcccattgtctacagtgtgaagaccaagcagatacgaaggcgaatcatacacatgttccagaggagaacaaacagagcctag

SEQ ID NO: 1286 - protein, 317 aa, Canis familiaris
MTMNSNASHVNHHSFILTGIPGMPDKNAWMAFPLGFLYTLTLLGNGTILTVIKVDESLHEPMYYFLSILALTDVSLSMSTLPSMLSIFWFNVPEIPFDACITQMFFIHGFGVVESGVLVSMAFDRFVAIRDPLRYASILTHGIIGKIGIVVLTRAVCVVFPVPFLIKRLPFCHSNVLSHSYCLHQDAMRLACASTRINSLYGLIIVIFTLGLDAIIILFSYVLILKTVLGIASRDERLKALNTCLSHICAVLLFYIPLIGVTMIHRFGKHLSPVVHTLMANIYLLLPPVLNPIVYSVKTKQIRRRIIHMFQRRTNRA

SEQ ID NO: 1287 - DNA, 951 bp, Canis familiaris
atgtcaccattcaaccaaactactgataaccatcagaacttcatcttgactgggattccaggaatgccagagaaagacttctggatggccttgcccctctgccttctttacagtaccacattcttaggtaatgtcatcatccttgttgtcatcaaggttgaccgaagtctccatgaacctatgtattattttttggctatgctagctgccactgacctcagcctttcattatcttccatgcccaccatgatcagtgttcactggttcaactggcgctcagtaacctttgatgcctgcatcactcagatgttcttcatccatacctttgggggagtggaatcaggtgttctggtcgctatggcctttgatcgctttgtggctattcgcttccctttgcgctatgctaccattctcactcatggaatcatcggcaagattggagcaaccgtcctgctacggagtgtgggtgcagtattccctgtgcctttcctcattaaaaggctacctttctgccactccaatatcctttcccatgcatactgcctccatcaggatgccatgaggcttgcctgcgctgacactcgtgtcaatagcatctatggcctcctggctgtgatcttcatcattgtactagatgccttgatccttttgatttcttactttctaattctccaggcagtactgggcattgcttcccgagaagagagactcaaggctctcaacacctgcttctcccatgtctgtgcagtactgctcttctacgtgcctctaattggcatgactctgattcaccgctttgggaagcatttgtcaccaatagtacacatgcttctggccaatgtctacctgcttctccctcctgtgctcaatcctgttgtgtacagtgttaggaccaagcagatacggcagcgaattgtcagagtgttctgtgggggcaggattggcccttaa

SEQ ID NO: 1288 - protein, 316 aa, Canis familiaris
MSPFNQTTDNHQNFILTGIPGMPEKDFWMALPLCLLYSTTFLGNVIILVVIKVDRSLHEPMYYFLAMLAATDLSLSLSSMPTMISVHWFNWRSVTFDACITQMFFIHTFGGVESGVLVAMAFDRFVAIRFPLRYATILTHGIIGKIGATVLLRSVGAVFPVPFLIKRLPFCHSNILSHAYCLHQDAMRLACADTRVNSIYGLLAVIFIIVLDALILLISYFLILQAVLGIASREERLKALNTCFSHVCAVLLFYVPLIGMTLIHRFGKHLSPIVHMLLANVYLLLPPVLNPVVYSVRTKQIRQRIVRVFCGGRIGP

SEQ ID NO: 1289 - DNA, 984 bp, Canis familiaris
atgataattttcaataacaccacatcatcttccccaaacttcctactcactgcatttcctggactggaacttgctcatatctggatctccatccctgtctgctgtctctacaccattgccctcttgggaaacagcatgattctgtttgtcatcatcattgagagaagtctccacaagcccatgtactatttcctctctatgctgtcagctgttgatctatgtctgaccatctcaacccttcccactgtgcttggggttctctggtttcatgcccgggagattagcctgaaagcttgcctcattcaaatgttctttgtgcatggcttctccttcctggagtcctcagtgctggtagccatggcctttgatcgctttatggctatctgtaacccaatgaagtatgccattatcttcacagacatggtaatcttggtgattggactggtcatctgcctacggcaagttattttcacctttcccatggttctaaccttgaagaatgtatctttctatgcaggcaaagaactttcccacccattttgctaccacccagatatgatcaaatactcatattccaacccctggatcagcagttttttgggcatgtttcttcagctctacctgactggcactgacttactcttcattcttttctcctacattctgattctccgaactgtcttgagcattgtggcccctaagaagcaacaaaaagctctcagcacttgtgtctgtcatatctgtgctgtcaccattttctatgtgccaatgatcagcctgtcccttacacatcgccttctcagctccaccccaagagtggtctgtagcattttggccaatgtttatttgctcttaccgcctgtactaaaccctatcatttacagcttgaagaccaagacgatccgccacgctatgctccagctgttccagtttaagggctcacggggccccaatgtgaggggtctcagaggacagtgggattga

SEQ ID NO: 1290 - protein, 327 aa, Canis familiaris
MIIFNNTTSSSPNFLLTAFPGLELAHIWISIPVCCLYTIALLGNSMILFVIIIERSLHKPMYYFLSMLSAVDLCLTISTLPTVLGVLWFHAREISLKACLIQMFFVHGFSFLESSVLVAMAFDRFMAICNPMKYAIIFTDMVILVIGLVICLRQVIFTFPMVLTLKNVSFYAGKELSHPFCYHPDMIKYSYSNPWISSFLGMFLQLYLTGTDLLFILFSYILILRTVLSIVAPKKQQKALSTCVCHICAVTIFYVPMISLSLTHRLLSSTPRVVCSILANVYLLLPPVLNPIIYSLKTKTIRHAMLQLFQFKGSRGPNVRGLRGQWD

SEQ ID NO: 1291 - DNA, 936 bp, Canis familiaris
atgtacgctctcaattcctctaaaattgagatcaccaccttcttcctgattggaatcccaggactggagcatgttcatgtttggatctctgtccctatctgcttcatgtacctagtggctatccttggcaactgcaccatcctttttgtgatcaggacagagccgtcacttcatgcccccatgtactatttcctctccatgttggctgtctctgacctgggcctctctctctcatccttccccactatgctgaggatctttgttttcaatgctacggggatttccccaaatgcctgctttgctcaagaattctttatccatggattcacagatatggagtcctcagtgctcctggtcatgtcttttgaccgttttttggccatacgcaatcctctgagatacagctctatcctcaccaatgccagagttgccaaaatgggactggtgtttctcattaaaagtatgctcttagtgctcccatttcctttcaccctcaaaaaattgacatattgtaggaaaagcctactttctcactcttattgtctgcaccaggatgttatgaagctagcctgctctgacaacaccatcaactttttctatggtttcttcgttgccctctgtatgatgtcagacagtgtgttcattgctgtgtcctacatatttatcctgaagactgtgatgggaattggatcccataaagagcggctcaaggccctcaacacctgtgtctcccacatctgtgccgtgctcatcttctatgtgcctatcattgctttggcttccatgcaccgttttggcaagcacaagtccccagtggccatgatcctcattgctgacattttcttgctagtaccacctctaatgaaccccattgtatactgtgtgaagacacggcaaattcgtgagaaggtttgggggaaattaggtctaaaataa

SEQ ID NO: 1292 - protein, 311 aa, Canis familiaris
MYALNSSKIEITTFFLIGIPGLEHVHVWISVPICFMYLVAILGNCTILFVIRTEPSLHAPMYYFLSMLAVSDLGLSLSSFPTMLRIFVFNATGISPNACFAQEFFIHGFTDMESSVLLVMSFDRFLAIRNPLRYSSILTNARVAKMGLVFLIKSMLLVLPFPFTLKKLTYCRKSLLSHSYCLHQDVMKLACSDNTINFFYGFFVALCMMSDSVFIAVSYIFILKTVMGIGSHKERLKALNTCVSHICAVLIFYVPIIALASMHRFGKHKSPVAMILIADIFLLVPPLMNPIVYCVKTRQIREKVWGKLGLK

SEQ ID NO: 1293 - DNA, 939 bp, Canis familiaris
atgtctgcttccaatagttctgaggtccagctttttcttctgattggaatcccaggtctggaacatgctcacatctggatctccattcccatttgcctcgtgtacctggttgccatcatgggcaacagcaccattctttttatcattaggacagaaccctcacttcatgagcccatgtactatttccttgccctgttggccatctctgacctgggcctatccttctcctcccttcctactatgctgagaatcttcttgttcaattccatgggaatttcacccaatgcttgctttgctcaaccaatgcttgctttgctcaaagaattcttcatccatggattcactgtcatggaatcctccatgcttctagctatgtctttggatcgctttcttgccattcataatcccctgagatacagttctctcctcactagtgacagagttgctaaaatgtgcctgatcttagccatcaggagcattctcttagtgcttccattccccttcactctaaggagattaaaatattgtcagaagaatctcctttctcactcatactgtctgcatcaggataccatgaagctagcctgctctgacaacaaaatcaatgttatctatggcttctttgttgctctctgtactatgctggacttggcattaatttttctgtcatatatgctcatcttgaagactgtattcagcattgcatctctggcagagaggctcagggctctcaatacctgtgtctcccacatctgtgctgtgctcattttctatgtacccatcatcacccttgctgccatgcaccgctttgccaagcacaaaagccctctagttgtaatccttgttgcagatatattcttgttgttcccgcctctaatgaaccccattgtgtattgtgtaaaaactcaacaaatctgggaaaaggtcttgggaaagttg

SEQ ID NO: 1294 - protein, 313 aa, Canis familiaris
MSASNSSEVQLFLLIGIPGLEHAHIWISIPICLVYLVAIMGNSTILFIIRTEPSLHEPMYYFLALLAISDLGLSFSSLPTMLRIFLFNSMGISPNACFAQPMLALLKEFFIHGFTVMESSMLLAMSLDRFLAIHNPLRYSSLLTSDRVAKMCLILAIRSILLVLPFPFTLRRLKYCQKNLLSHSYCLHQDTMKLACSDNKINVIYGFFVALCTMLDLALIFLSYMLILKTVFSIASLAERLRALNTCVSHICAVLIFYVPIITLAAMHRFAKHKSPLVVILVADIFLLFPPLMNPIVYCVKTQQIWEKVLGKL

SEQ ID NO: 1295 - DNA, 942 bp, Canis familiaris
atgactttgggatccctggaaagcagcagcaacatttcctccacctttctgctgagtggcattcctgggctagagcacatgcacatctggatctccatcccactgtgctttatatacctggtttccatcctgggtaactgtacaatcctttttatcattaaaacagagccctcactccatgagcctatgtacctcttcttgtccatgctggctgtgactgacctgggtctgtcactttgcaccctccctacagtgctgggcatcttttggattggagcacgagatattggtcatgatgcttgttttgctcagctcttttttattcactgcttgtccttcctggagtcctctgtgctactatccatggcctttgaccgctttgtggccatttgtcgccccttgcactatgcttccattctcaccaacactgtcattggcaggattggcctggcttccctaggccgcagtgtagcactcatttttccattgccttttatgctcaaaagattcccctattgtggctctccagttctctcacattcttattgtctccaccaggaagtgatgaaattggcctgtgcagacatcaaagccaacagtgtctatgggatgtttgtcattgtttcaacagtgggtatagactcactgctcattctcttctcttatgccctgatcctgcgtactgtgctgtccattgcatccagggctgagagattcaaagctcttaacacctgtgtttctcacatatgtgctgtgctcctcttctacactcccatgattggcttgtctgtcatccaccgctttgggaagcagggatctcatctggtccaggtgatcatgggctttgtataccttctattccctcctctgatgaaccccatcgtctacagtgtgaagaccaaacagatccgagatcgtgtaacccatgctttttgttgctaa

SEQ ID NO: 1296 - protein, 313 aa, Canis familiaris
MTLGSLESSSNISSTFLLSGIPGLEHMHIWISIPLCFIYLVSILGNCTILFIIKTEPSLHEPMYLFLSMLAVTDLGLSLCTLPTVLGIFWIGARDIGHDACFAQLFFIHCLSFLESSVLLSMAFDRFVAICRPLHYASILTNTVIGRIGLASLGRSVALIFPLPFMLKRFPYCGSPVLSHSYCLHQEVMKLACADIKANSVYGMFVIVSTVGIDSLLILFSYALILRTVLSIASRAERFKALNTCVSHICAVLLFYTPMIGLSVIHRFGKQGSHLVQVIMGFVYLLFPPLMNPIVYSVKTKQIRDRVTHAFCC

SEQ ID NO: 1297 - DNA, 960 bp, Canis familiaris
atgacaatctcttataatagcagcctccaaaaagccactttcttcctaacgggcttccaaggtctggaagatctccacggctggatctctattcccttctgcttcatctacttgacagttattgtaggaaaccttaccatcctccacgtcatccgtactgatgtcaccctccatgaacccatgtactatttcttggccatgctggctctgacagatttgggcctttgtctatctacactgcccactgtgttgggcatcttctggtttgatgccagagagattggcatccctgcctgtttcactcagctcttcttcatccatactttgtctctggtagagtcctcagttctattgtccatgtctattgaccgctatgtggccatctgcaacccattgcgttactccacagtcttgacccccacacgtattgtcaggatggggctgacttcaatgcttagaagtgccctgctcatcctgccattgccattcctccttaaacgcttccagtactgccgctcccatgtgctggcccatgcttattgtctgcacctagagatcatgaagctggcctgctctagcatcattgtcaatcgcatatatgggctctttgtcgtggcctgcactgttggtgtggattcactgctcatcttcctctcctatgccctcatcctccgcactgtgttaagcattgcatcccgtcaggagcgacttcgggccctcaacacctgcgtctcccacatctgtgctgtgctactcttctacattcctatgattggcttgtctcttgtgcatcgctttggtgaacatctgccccgtattgtacacctcctcatgtcttatgtgtatctgctggtaccacctctcatgaaccccattgtctacagtatcaagaccaagcaaatccgcattcgcattgctaagaagtgtgactttgtaaaatctcttaggtgttttcgatag

SEQ ID NO: 1298 - protein, 319 aa, Canis familiaris
MTISYNSSLQKATFFLTGFQGLEDLHGWISIPFCFIYLTVIVGNLTILHVIRTDVTLHEPMYYFLAMLALTDLGLCLSTLPTVLGIFWFDAREIGIPACFTQLFFIHTLSLVESSVLLSMSIDRYVAICNPLRYSTVLTPTRIVRMGLTSMLRSALLILPLPFLLKRFQYCRSHVLAHAYCLHLEIMKLACSSIIVNRIYGLFVVACTVGVDSLLIFLSYALILRTVLSIASRQERLRALNTCVSHICAVLLFYIPMIGLSLVHRFGEHLPRIVHLLMSYVYLLVPPLMNPIVYSIKTKQIRIRIAKKCDFVKSLRCFR

SEQ ID NO: 1299 - DNA, 963 bp, Canis familiaris
atgactgccttaaaccacactgctgttagccacacagtcttccacttgctgggtatccctgggctagaagaccagcacatgtggatttccattcccttcttcatttcctacgtcatcgccctgcttgggaacagcctgctcatctgcattatcctcacgaagcgcagcctccatgaacccatgtacctcttcctctgcatgctggctggagcagacattgtcctctccacctgcacagtaccacaggccttggccatcttctggttccatgctggggagatctccttggatcgctgcattactcagctcttcttcatccataccaccttcatctctgagtcagggatcttgctggtgatggcctttgaccgctacattgccatatgctacccactgagatacaccactattcttacaggtgcactgattgggaaaatcggtgtgaccatcttcctgagaagttatggtacaattttccccataatatttcttttgaaaagattgaccttctgccaaaataatattattccacatacctactgtgaacacattggtttggccaaatatgcttgtaatgacatttatgctaacatctggtacggattttccatcctaatgttaacagtagttttagatgttgtgctaatttttgtttcctatgtgatgattctccgtgctgtcttctgcatcccttctcgagatgctcgccataaagctctcaacacttgtggctcccatgtctgcattatcatcctcttttatgggcctggaatcttcacaatccttactcaacgttttggatgccacattccacctcatacccacatcttgttggctaatgtttgcatgcttgccccacctatgctcaatcccatcatttatgggatcaagaccaagcaaatccgggagcaggtggttcatgtattgtttacaaggcagaaatcactttggtttaggaactga

SEQ ID NO: 1300 - protein, 320 aa, Canis familiaris
MTALNHTAVSHTVFHLLGIPGLEDQHMWISIPFFISYVIALLGNSLLICIILTKRSLHEPMYLFLCMLAGADIVLSTCTVPQALAIFWFHAGEISLDRCITQLFFIHTTFISESGILLVMAFDRYIAICYPLRYTTILTGALIGKIGVTIFLRSYGTIFPIIFLLKRLTFCQNNIIPHTYCEHIGLAKYACNDIYANIWYGFSILMLTVVLDVVLIFVSYVMILRAVFCIPSRDARHKALNTCGSHVCIIILFYGPGIFTILTQRFGCHIPPHTHILLANVCMLAPPMLNPIIYGIKTKQIREQVVHVLFTRQKSLWFRN

SEQ ID NO: 1301 - DNA, 942 bp, Canis familiaris
atgtctattattaatacatcaaatgttgaaatcaccaccttcttcttggttgggatgccagggctggaatatgcacacatttggatctctatccccatctgcagcatgtatctttttgctattttgggaaactgcaccattctttttgtcatcaagacagagccctccttgcacgaacccatgtactacttcctttccatgttggcaatgtctgacatgggcttgtctctctcttctctacctactgtgggaaggatcttcttattcaatgcccctgaaatttctgccaatgcctgctttgcccaggaattcttcatccatggattcacagcagtggaatcctcagtgcttctgatcatgtcatttgaccgcttcctagccatccacagccctctgagatacagctccattctgactcctgtcagagttgccaaaataggaatagtattatcccttaagagtgtccttctagtactgcccttccccttcactttgagaagtttgaaatattgcagtaagagccaattatcccattcctactgtcttcaccaggatgtcatgaagttggcctgctctgacaaccgaattgatgtcatctatggcttttttggagcactttgtcttatggtagactttatgctcattgctatatcttacatcctgatcctcaagactgtgctgggaattgcatccctaaatgagcagctcaaagccctcaatacttgtgcttcacacatctgtgcagtgatcatcttctacctgcccatcatcaaccttgccattgtccatcgctttgtcagacatgtctcacctctcttcaatgttctcatggcaaatgttcttttacttgtgcctccaatgatgaatcccattgtgtactgtgtgaaaaccaggcaaataagagtgagagttttagcaaaattatgccagaagcagatgtaa

SEQ ID NO: 1302 - protein, 313 aa, Canis familiaris
MSIINTSNVEITTFFLVGMPGLEYAHIWISIPICSMYLFAILGNCTILFVIKTEPSLHEPMYYFLSMLAMSDMGLSLSSLPTVGRIFLFNAPEISANACFAQEFFIHGFTAVESSVLLIMSFDRFLAIHSPLRYSSILTPVRVAKIGIVLSLKSVLLVLPFPFTLRSLKYCSKSQLSHSYCLHQDVMKLACSDNRIDVIYGFFGALCLMVDFMLIAISYILILKTVLGIASLNEQLKALNTCASHICAVIIFYLPIINLAIVHRFVRHVSPLFNVLMANVLLLVPPMMNPIVYCVKTRQIRVRVLAKLCQKQM

SEQ ID NO: 1303 - DNA, 936 bp, Canis familiaris
tcggtctttaacacctctgaagtggaaatctctaccttcttcctcattgggatccctgggatgaagcatgctcacatttgggtttccatccccatttgcctcatgtacctccttgccatcctggggaactgcaccatcctctttttcataaaaacagagacctctctgcatgagcctatgtattatttcctctccatgctggccttttctgacctgggactgtccatctcctcccttccaaccatgctgagaatcttcttgttcaatgtcactggaatttcccctgatgcttgctttgcccaagagttcttcattcatggattctcagccatggaggcatcagtactcttcatcatgtccattgatcgcttgatagccatctgcaaccctctgagatatacttccatccccaccagtgccagagtcattaaaattggcctcatatttgctgcattatgtattatgtttgttctccctttcccctttattctgaagaggctgaaattctgtaagaaaagtcttctatcccactcctactgcctccaccaggatgtcatgaagcaggcctgttctgacaacagggtcaatgtcatctatggactatttgtggctcttatatctttattgtatttggtatgcattgctgtgtcttacatgctcatcttgaaaattgttctgggcattacctcacacaagggccgcctcaaggtcctcaacacttgcatttcccacatctgtgctgtgttcatcttctatgttcctattgtcaccttggctgcccttcaccgctttgccaaacatgtttcctcagttgttagggtcatcatagctgatatcttccttttggttcccccgttaatgaatcccattgtgtactctgtgaagagtcagcagattagaaatcggatccttacaaaactgtgtgagaaacaaggt

SEQ ID NO: 1304 - protein, 312 aa, Canis familiaris
SVFNTSEVEISTFFLIGIPGMKHAHIWVSIPICLMYLLAILGNCTILFFIKTETSLHEPMYYFLSMLAFSDLGLSISSLPTMLRIFLFNVTGISPDACFAQEFFIHGFSAMEASVLFIMSIDRLIAICNPLRYTSIPTSARVIKIGLIFAALCIMFVLPFPFILKRLKFCKKSLLSHSYCLHQDVMKQACSDNRVNVIYGLFVALISLLYLVCIAVSYMLILKIVLGITSHKGRLKVLNTCISHICAVFIFYVPIVTLAALHRFAKHVSSVVRVIIADIFLLVPPLMNPIVYSVKSQQIRNRILTKLCEKQG

SEQ ID NO: 1305 - DNA, 642 bp, Canis familiaris
ttctccaagaatttcttctgatgcttgctttgcccaagtattcacagactctcagctatggagtaatcaattcgtctcatcatgcccttcaattgctttattgccatctgccaccctctgagatacacctctgaccagtgccagagtcaccagcattgctttttctttcaaaaatgctttgttgattctccctttccctttcactgtaaaacatctaagaaactctaagaagaacctccttttccattcctattgcctccatcagggtatcataaagctggcctgctctgacaacaagtaaatgtcatctatggcttatttgtggctgtcacaggcatcctagacttaacatttattttcgtgtcctacattatgatactgaaagtaggattgagcatagcaacacagaagcaaaggctcaaagtcctcaacacctgtgtttctcacatctgtgctgtgctcatattctatgtgcccatattctctctagctgttatctactggtttgccaaacacagttccccagtcatcaagatcctcatggctgatgttttcctgttggtacctccattgatgaaccccattgattactgtgtgaaaagccaacagataaaaagtatagttttaaggaagctgtgtcag

SEQ ID NO: 1306 - protein, 90 aa, Canis familiaris
MILKVGLSIATQKQRLKVLNTCVSHICAVLIFYVPIFSLAVIYWFAKHSSPVIKILMADVFLLVPPLMNPIDYCVKSQQIKSIVLRKLCQ

SEQ ID NO: 1307 - DNA, 963 bp, Canis familiaris; identical to SEQ ID NO: 14

SEQ ID NO: 1308 - protein, 320 aa, Canis familiaris; identical to SEQ ID NO: 44

SEQ ID NO: 1309 - DNA, 942 bp, Canis familiaris
atgtctgtcttcaatagctctgtcctataccctcgcttcctcctaacaggcctctcaggccttgaaagcagatatagcttgatttctatccccatcttcttggtctatgccacctcaattgtaggaaacattaccatcctagttatcatcagaactgagtcttccctccaccaaccaatgtactactttctatcaatgctggcactgactgatctgggcctatccacgacaaccttgcctacaatgttcagtgtcttctggttccatgcccgggagatctcctttaatgcttgcctggtccagatgtacttcattcatgttttctcaattattgagtcagctgtgctgttggccatggcctttgaccgctttgtagcaatccgagagcccctgcgttatgtgaccattctaaccaatggtgtgatcattgggattgggttggcaattgctggaagggccttggctctggtttttccagcttccttcctcctaaagaggcttcaatatcgtcctgtcaatattctctcctacccattctgcctacaccaggatctgataaaaacaactgtatccagtcgttgggtcagcagcatctatggcctcatggtggtcatttgctccatgggacttgattcagtgcttctcctcctctcctatatcctcatccttggcacagtgttgagtatagcctccaagacagagaggattaaagcgctcaacacctgcatctcccacatatgtgctgtactcactttctatacaccaatgattgggctatctatgatccgtcgctatgggcagaatgcttccccaattgtccatgtgctcatggccaatgtctacttgctggttccacccctcatgaatcctattgtctacagtgtcaagaccaagcagattcgtgacagaatcctcaggaaattcaagcaacagaaagcttag

SEQ ID NO: 1310 - protein, 313 aa, Canis familiaris
MSVFNSSVLYPRFLLTGLSGLESRYSLISIPIFLVYATSIVGNITILVIIRTESSLHQPMYYFLSMLALTDLGLSTTTLPTMFSVFWFHAREISFNACLVQMYFIHVFSIIESAVLLAMAFDRFVAIREPLRYVTILTNGVIIGIGLAIAGRALALVFPASFLLKRLQYRPVNILSYPFCLHQDLIKTTVSSRWVSSIYGLMVVICSMGLDSVLLLLSYILILGTVLSIASKTERIKALNTCISHICAVLTFYTPMIGLSMIRRYGQNASPIVHVLMANVYLLVPPLMNPIVYSVKTKQIRDRILRKFKQQKA

SEQ ID NO: 1311 - DNA, 942 bp, Canis familiaris
atgtcagcctttaacacttctgaagtggaaatctctaccttcttcctcattgggatcccagggatgaagcatgctcacatttgggtctccatccccatttgcctcatgtacctccttgccatcctggggaactgcactatcctctttttcataaaaacagagacctctctgcatgagcctatgtattatttcctctccatgctggccttttctgacctgggactgtccatctcctcccttccaaccatgctgagaatcttcttgttcaatgccactggaatctcccctgatgcttgctttgcccaggagttcttcattcatggattctcagccatggagtcatcagtacttttcatcatgtctatcgatcgcttgatagccatctgcaaccctctgaaatacacctccattctgaatagtgtaagagtctttaaaattggccttgtatctgctataaaaagtctcttattggtcttccctttcccctttattctgaagaggctgagattctgtaagaaaagccttctatctcactcctactgtctccatcaggatgtcatgaaactggcctgttctgacaacagagtcaatgtcatctacggactgcttgtggctctaacagctatgttagacttggtatgcattgctgtgtcttacatgctgatcatgaagattgttctgggcatcacctcacacaagggctgtctcaaggtcctcaacacttgcatctcccacatctgtgctgtgctgatcttttacgtgcctattattaccttggctattattcaccgctttgccaaaaacgtttctccagttgttagggtcgtcatagctgataccttccttctggttccccctctaatgaatccccttgtgtactctgtgaagagtcatcagattagaaatctgattctcatgaaattatgtgagataaaaggttga

SEQ ID NO: 1312 - protein, 313 aa, Canis familiaris
MSAFNTSEVEISTFFLIGIPGMKHAHIWVSIPICLMYLLAILGNCTILFFIKTETSLHEPMYYFLSMLAFSDLGLSISSLPTMLRIFLFNATGISPDACFAQEFFIHGFSAMESSVLFIMSIDRLIAICNPLKYTSILNSVRVFKIGLVSAIKSLLLVFPFPFILKRLRFCKKSLLSHSYCLHQDVMKLACSDNRVNVIYGLLVALTAMLDLVCIAVSYMLIMKIVLGITSHKGCLKVLNTCISHICAVLIFYVPIITLAIIHRFAKNVSPVVRVVIADTFLLVPPLMNPLVYSVKSHQIRNLILMKLCEIKG

SEQ ID NO: 1313 - DNA, 456 bp, Canis familiaris
attttcattatcaataagtcatatgttgaaatcaccaccttcctcttggttggggtgccagggctggaatatacacacactctggatctctatttccatctgcagcatgtatctttttgttattctgggaaactgcacctttttgtcatcaagacaaagctttccttgaatgagtgtatgtattacttcctttccatgttggccatgtctgacctgggcttgtccctctcttctctacctaccatggggaggatcttcttattcaatcttctgaaatttctgccaaatgcctgctttccccaggaactcttcatccatggattcacagtattttagtccgcaatgctcctgatcatgtcgcttgcctgtttcctagccatccacaaccctctgagatacagcttctttctgactattgtcagagttgccaaaataggaatgatcttctttttcaga

SEQ ID NO: 1314 - protein, 111 aa, Canis familiaris
IFIINKSYVEITTFLLVGVPGLEYTHTLDLYFHLQHVSFCYSGKLHLFVIKTKLSLNECMYYFLSMLAMSDLGLSLSSLPTMGRIFLFNLLKFLPNACFPQELFIHGFTVF

SEQ ID NO: 1315 - DNA, 327 bp, Canis familiaris
tttgaagcactctgccttgtggtagactttatgcttattgctatgtcttacatcctgatcctcaagactgtgctgggaattgcatcctgaaaggatcagctcaaggtcctcaatacttgtgtttcacatttctgtgcagtgatcatcttctacttgcccatcatcaaccttgccattgtccatcactttgtctgacatgtctcacctctcttcaatatgctcatggcaagtgttcttttacttgtgcctccaatgatgaatcccatcgtgtactgtgtgaaaactaggcaaattagagtgagaattgtagtaaaattatgtcagaag

SEQ ID NO: 1316 - protein, 37 aa, Canis familiaris
MLMASVLLLVPPMMNPIVYCVKTRQIRVRIVVKLCQK

SEQ ID NO: 1317 - DNA, 309 bp, Canis familiaris
tcaattccattttgtcttgcatacttggtagcatttataggcaacatcatcatcatctctgttatctggaatgagtcttcactccaccagcccaggtattatctgctgtccatcctggcaataactgacctgggcatgtccatgtctatactccctacaatattggctatgttatggtgggaagcccaggaaatcagaggaggagcttgttttgctcagcttttcttcatccacaccttcatgttcttggagtcttcagtgctgctggccatggcctttgactgattcattgctatatgtcatccactt

SEQ ID NO: 1318 - protein, 94 aa, Canis familiaris
SIPFCLAYLVAFIGNIIIISVIWNESSLHQPRYYLLSILAITDLGMSMSILPTILAMLWWEAQEIRGGACFAQLFFIHTFMFLESSVLLAMAFD

SEQ ID NO: 1319 - DNA, 480 bp, Canis familiaris
atgcactactgaagcatcctcaccaatgatggtaatattggcttgggctgcttgctacaaagtacaggagttgtgatgcccacccctatactattgaggtgctaccatcactgtcgtgctaatgtcctcagccaccccttttgcttgcatcaagatattctgaaattatcctgctatgatgccagtgtcaacaacatctatggattgtgtgtagtcattatcacactgggcagagactcattcctcatcctcctctcttatgtcctaattttccatgctgtactaggcattgcatctaatgacaagcaactaaaggcactcaacacttgtttatttcatgtatgtgtggtgcttatctgctctgtacctctaataggggtatgcatggtccatcactttgggaagcacctgcttcccatagtccacattctcatggctgacatttgcctgcttctcccaccagtacttaatcccatcatc

SEQ ID NO: 1320 - protein, 135 aa, Canis familiaris
MPTPILLRCYHHCRANVLSHPFCLHQDILKLSCYDASVNNIYGLCVVIITLGRDSFLILLSYVLIFHAVLGIASNDKQLKALNTCLFHVCVVLICSVPLIGVCMVHHFGKHLLPIVHILMADICLLLPPVLNPII

SEQ ID NO: 1321 - DNA, 945 bp, Canis familiaris
atggctagcttcaatcacactggtgttaaccatgtagtcttctacctgctgggcattccaggccgagaagacctacacatatggatttccattcccttcctcatctcctatatctttgccctccttggaaatggtttgcttatcttcattatcctcaccaagagcagcctccatgaacctatgtatctttttctctgcatgctggctggagttgacattgtctttgccacaaccacagaacccaaggcattggccattttctggtgtaatagtaggaagatctctcttaatagctgcattgcccagctctacttccagcattcctcctttattactgagtcaggcatcttgctgattatggcatttgaccgctacattgcaatatgttacccactaaggtacaccatgatactcactcactctctgatagggaaaattggtgtggctgttttcttgagagcacattgtacaatttttcctatgatattcctattgaagaggctgactttttgcagaaataacatcctaccacatacattctgtgaacacattggcttggccaagtatgcctgtgatgatatccgagtaaacatctggtatggattttttgtcctaatgtcaacagtgattctagatattgtcctcatttttgtttcctatgctctgatcctccatgctgtcttccttttcccttcacgagatgctcgccacaaagctctcaacacctgcggttcccatgtctgtgtcatcattcttttttatgggcctgggatcttctcggttctcactcagcgctttggccatcacatcccgctacatgtccacatcctgttggccaatgtcagcatgcttgctccacctatgctgaaccccatcatttatggggtcaaaacaaaacagatacgagaccaagtgatttatgtgttgtttccaaagcagaaatga

SEQ ID NO: 1322 - protein, 314 aa, Canis familiaris
MASFNHTGVNHVVFYLLGIPGREDLHIWISIPFLISYIFALLGNGLLIFIILTKSSLHEPMYLFLCMLAGVDIVFATTTEPKALAIFWCNSRKISLNSCIAQLYFQHSSFITESGILLIMAFDRYIAICYPLRYTMILTHSLIGKIGVAVFLRAHCTIFPMIFLLKRLTFCRNNILPHTFCEHIGLAKYACDDIRVNIWYGFFVLMSTVILDIVLIFVSYALILHAVFLFPSRDARHKALNTCGSHVCVIILFYGPGIFSVLTQRFGHHIPLHVHILLANVSMLAPPMLNPIIYGVKTKQIRDQVIYVLFPKQK

SEQ ID NO: 1323 - DNA, 939 bp, Canis familiaris
atgatataccacaataggagcatttttcacccagccacattcttcctcgttggaatccctggtctggaaggggcccatgcctggatctccctgcctttctgctctgtttaccttgtggctttactgggcaatgccacaattttgctagtcatcaagatggagcagaccctgcggagggagcccatgttctattttctggctctcctttcaactattgatttggccctttccacaacctctgtgccccgaatgttgggaatcttctggtttgatgctcatgagattaactttggagcttgtgtggcccagatgtttttgatccatacttttactggcatggaggctgaggtcttgctggctatggcctttgatcgctatgtggccatctgtgctcccctccactatacaaccatcttgacatcccgagtgctggtcggcatcagcatgtgcattgtgattcgtccagttgtgctgacacttcccatggtcttcctcatctaccgcctacccttctgtcaggctcacgtgatagctcactcctactgtgagcacatgggcattgccaaactctcctgtggaaacatccgtgtcaatgccatctatgggcttttcgtggtttccttctttgtcctaaacctggtccttattggcatctcctacatgtacattctccgagctgtctttcgcctcccatcacaggatgctcggctaaaagcactcagcacatgtggttctcacgttggggtcatctgtgttttctatatcccctcagtgttctccttcctcactcaccgatttggacacaacataccacgctacattcacattcttgttgccaacctctatttggttatcccaccatcactcaaccccatcatttatggtgtaaggaccaaacagattcgagagcgagtgctccatgtctttataaaaaaataa

SEQ ID NO: 1324 - protein, 312 aa, Canis familiaris
MIYHNRSIFHPATFFLVGIPGLEGAHAWISLPFCSVYLVALLGNATILLVIKMEQTLRREPMFYFLALLSTIDLALSTTSVPRMLGIFWFDAHEINFGACVAQMFLIHTFTGMEAEVLLAMAFDRYVAICAPLHYTTILTSRVLVGISMCIVIRPVVLTLPMVFLIYRLPFCQAHVIAHSYCEHMGIAKLSCGNIRVNAIYGLFVVSFFVLNLVLIGISYMYILRAVFRLPSQDARLKALSTCGSHVGVICVFYIPSVFSFLTHRFGHNIPRYIHILVANLYLVIPPSLNPIIYGVRTKQIRERVLHVFIKK

SEQ ID NO: 1325 - DNA, 939 bp, Canis familiaris
atgctttaccccaacaggagcatttttcacccagccacattcttcctcgttggaatccctggtctggaaggggcccatgcctggatctccctgcctttctgttctgtttaccttgtggctttactgggcaatgccacgattttgctagtcatcaagatggagcagaccctgcggagggagcccatgttctattttctggccctcctttcaactattgatttggccctttccacaacctctgtgccccgaatgttgggaatcttctggtttgatgctcatgagattacctttggagcttgtgtggcccagatgtttttaatccatgccttcactggcatggaggccgaggtcctggtagccatggcctttgatcgctatgtggccatctgtgctcccctccactatacaaccatcttgacatcccgagtgctggtcggcatcagcatgtgcattgtgattcgtccagttttatttacacttcccatagtctatctcatctaccgcctacccttctgtcaggctcatgtaatagctcactcctactgtgagcacatgggcattgccaaactctcctgtggaaacatccgtgtcaatgccatctatgggctctttgtggtctctctctttctgctgaacctggtcctaattggcatctcttatgtgtacattctccgagctgtctttcgcctcccatcacaggatgctcggctaaaagcactcagcacatgtggttctcacgttggggtcatctgtgttttctatatcccctcagtgttctccttcctcactcaccgatttggacataacataccacgctacattcacattcttgttgccaacctctatttggttatcccaccatcactcaaccccatcatttatggtgtaaggaccaaacagattcgagagcgagtgctccgtgtctttgctaaaaagtag

SEQ ID NO: 1326 - protein, 312 aa, Canis familiaris
MLYPNRSIFHPATFFLVGIPGLEGAHAWISLPFCSVYLVALLGNATILLVIKMEQTLRREPMFYFLALLSTIDLALSTTSVPRMLGIFWFDAHEITFGACVAQMFLIHAFTGMEAEVLVAMAFDRYVAICAPLHYTTILTSRVLVGISMCIVIRPVLFTLPIVYLIYRLPFCQAHVIAHSYCEHMGIAKLSCGNIRVNAIYGLFVVSLFLLNLVLIGISYVYILRAVFRLPSQDARLKALSTCGSHVGVICVFYIPSVFSFLTHRFGHNIPRYIHILVANLYLVIPPSLNPIIYGVRTKQIRERVLRVFAKK

SEQ ID NO: 1327 - DNA, 732 bp, Canis familiaris
gtgttcaatttgccaacattttttttttctttctaggaatgaattggatctcctcatattccagccaaattcagaattcctcatcaacccatcattctcactttttcttttaggcatgccagggcttgagactaccaatgcctggatttccttgctcttctgttgtatttagattttagttcttatttgaatgtaacaatttaaatagtgatacaggcagacagaatccttgtgacccctgtattatttctggttctatatttggctttctccacatccttggcaccacatatcttttggttgaacactcaagagattggctttggggtctctggggcccagatgtttctcatacacaggaatggtgtcttcaggacttctgcaatgacttttgaccattcagtggccttctgtgcaccactccactacacaatcatcgtgatagtttattgcccagaaaacagtgagcacatgagcattgccaagttggcttatgccaattttcaaatcaatgctatctgtggtctcttagccacttttttccttgtcctcatcctggtactgctgggaatctcctatggctacatcctctgggttgtattccacctcaaattacaaatgcccatcacaagacactgagcaattgtagctcccatgctacagtcatgtttgttttctacacaccctctctcttcattttttaaaaaaatgtactctacatggatagaactg

SEQ ID NO: 1328 - protein, 56 aa, Canis familiaris
CSICQHFFFLSRNELDLLIFQPNSEFLINPSFSLFLLGMPGLETTNAWISLLFCCI

SEQ ID NO: 1329 - DNA, 936 bp, Canis familiaris
atgtctctttccaatcaaactcagctccacccttcctccttcttgctggtaggaatcccaggactagaaacagtccacatctggattggctttcccttttgtgccatgtatctgattgcactcataggaaacttcaccatcttgttcatcatccagactgagcacagcctccaccagcccatgttttactttctagcaatactggctaccattgacctgggactgtccacaaccactatccctaagatgctgggcatattctggtttggcctcagggagatcacttttgatgactgccttactcagatgtttttcattcacatttttactggcatggaatcaggagtccttcttgccatggcttatgaccgttatgtagctatctgtaaccctcttcgttataacacaatccttactaacaaagtagtatctcttattggttttggggtggttgcgagatcttttttcattgtactcccctttgtattcctcatcttgagactgcccttttgtgaacatcatgtcatctcccacacatactgtgagcatatgggtcttgcgcgtctggcctgtgcaagtatcagaatcaatattatatatggtctggggaccatagcaatcctggggcttgacatcatggccatttctctgtcctatgtccaaattctctgtgccgttttccatttcccctcccatgaggccaggctcaagtctctcagcacctgtggctcccatgtctgtgtaattttggctttttacaccccagccctcttctcttttttgacacatcgttttggccaaaatgttccccactacatccatatccttctggccaatctgtatgtagtgattccaccaatgctcaaccctgtcatctatggagtcagaaccaagcagattcatgaaagggtgctcagaatatttagccagaagtaa

SEQ ID NO: 1330 - protein, 311 aa, Canis familiaris
MSLSNQTQLHPSSFLLVGIPGLETVHIWIGFPFCAMYLIALIGNFTILFIIQTEHSLHQPMFYFLAILATIDLGLSTTTIPKMLGIFWFGLREITFDDCLTQMFFIHIFTGMESGVLLAMAYDRYVAICNPLRYNTILTNKVVSLIGFGVVARSFFIVLPFVFLILRLPFCEHHVISHTYCEHMGLARLACASIRINIIYGLGTIAILGLDIMAISLSYVQILCAVFHFPSHEARLKSLSTCGSHVCVILAFYTPALFSFLTHRFGQNVPHYIHILLANLYVVIPPMLNPVIYGVRTKQIHERVLRIFSQK

SEQ ID NO: 1331 - DNA, 939 bp, Canis familiaris
atgttccctcccaataacacccaattccacctcttttccttcttgttgctggggatcccagaaatggaaacactgcacctctggattggctttcccttttgtgctgtgtacacagttgcactcattgggaacttcactattctgtttgtcatccaggctgagagcagcctacaccagcctatgttctatttcctggccatgttggctactattgatttgggtctgtccacagctaccatccccaagatgcttggaatcttctggttcaacctcagagagatcatctttggagcttgcctcgtgcaaatgtttttcattcacagcttcacacttatggagtcagctgtcctgttggcaatggcttatgaccgctacgtggccatctgcaacccacttcgatatagcaccatcctcaccaacagggttgtttctgtgattggtgttggtgtgttagtgagggcatttatttttgtgattccttttgtatttctgattttgcgattgcccttctgtgggaatcgtgtcattgcccatacctattgtgaacacatgggtcttgctcgtctctcttgtgccagcatcaagatcaatattatttatggcttatgtgcaatttgtaatctagtatttgacatcataggcattgccctttcttatgttcagatactgcgagctgttttccgtcttccttctcgtgaagcccgactcaaatccctcagcacgtgcggttctcatgtttgtgtaattcttgccttctatacaccggccctcttttcctttatgacacatcgctttggacataatgttccccgctatatccacatactcctggctaatctttatgtcatagtgccaccaatgctcaaccctgtcatatatggagtcaggaccaagcagatctatgaccgggtgaagaaactattattacagaaaccatga

SEQ ID NO: 1332 - protein, 312 aa, Canis familiaris
MFPPNNTQFHLFSFLLLGIPEMETLHLWIGFPFCAVYTVALIGNFTILFVIQAESSLHQPMFYFLAMLATIDLGLSTATIPKMLGIFWFNLREIIFGACLVQMFFIHSFTLMESAVLLAMAYDRYVAICNPLRYSTILTNRVVSVIGVGVLVRAFIFVIPFVFLILRLPFCGNRVIAHTYCEHMGLARLSCASIKINIIYGLCAICNLVFDIIGIALSYVQILRAVFRLPSREARLKSLSTCGSHVCVILAFYTPALFSFMTHRFGHNVPRYIHILLANLYVIVPPMLNPVIYGVRTKQIYDRVKKLLLQKP

SEQ ID NO: 1333 - DNA, 942 bp, Canis familiaris
atgacctcacttaatactaccctatttcatccctactctttcttccttctggggattcctgggttggaacatatacatatctggattggtttccctttctttgctgtgtacctgacagctgttcttggaaatatcataattctttctgtgattgacactgagagcagcctccaccagcccatgttctacttcttggccattctgtcatctatcgatctgggcctgtcaacatccaccatccccaagatgcttggcatcttctggttcaacctgagagaaatctcctttgaaggatgcctcatccagatgttcttcatccacctatacactggcatggagtcagctgtgcttgtggctatggcctatgatcgctatgtggccatctgtaaccctcttcagtacacattggtgctgacaaacagggtggtagtcgtcattgcattgataatcctgctgagacctttgtcttttgccataccctttgttctactcatcctacggttaccattttgtggacatcaaattattcctcacacttactgtgagcacatgggcattgcccgcctgtcttgtgccagcatcaggatcaacatcatctatggcttatgtgccatctctattctggtgtttgacatcatagctattgtcatttcttatgtccagattcttcgtgctgtctttcgactgccttcccacgatgcccggctcaaagcactcagcacctgtggctctcatgtatgtgtcatgctggctttctacactcctgcatttttttcatttatgacccacaggtttggccagaatataccacgctatatccacatccttttggctaatttctacgtagtcattccacctgccctcaaccctgtaatctacggtgtcagaacaaaacagattagagaaaaggtgctgaaagtcttttccaagaaaaatacataa

SEQ ID NO: 1334 - protein, 313 aa, Canis familiaris
MTSLNTTLFHPYSFFLLGIPGLEHIHIWIGFPFFAVYLTAVLGNIIILSVIDTESSLHQPMFYFLAILSSIDLGLSTSTIPKMLGIFWFNLREISFEGCLIQMFFIHLYTGMESAVLVAMAYDRYVAICNPLQYTLVLTNRVVVVIALIILLRPLSFAIPFVLLILRLPFCGHQIIPHTYCEHMGIARLSCASIRINIIYGLCAISILVFDIIAIVISYVQILRAVFRLPSHDARLKALSTCGSHVCVMLAFYTPAFFSFMTHRFGQNIPRYIHILLANFYVVIPPALNPVIYGVRTKQIREKVLKVFSKKNT

SEQ ID NO: 1335 - DNA, 960 bp, Canis familiaris
atgctaggtatgtcagcatacaataagactgatgtccatccatcaatcttcattctcattggcattcctgggctggaggcagcccacatctggatctccatccccttttgtgtggtctaccttttggccctcctgggaaactgttctcttctgtttatcatcaagacagactccagcctccatgagccaatgtacctcttcctctgcatgctggctgtggctgatcttattgtgtgtactacagctgtaccaaaactccttagccttttctggttccatgatggagaaattcgtattgaagcctgcctcactcaagtgttcctgattcactcttgctccaccatggaatcgggcttcttcctggccatggcttttgaccgttatatagccatttgtaacccattaagacattcagctattctgacacaggctgtaataggggggatgggtctaggtatagtactccgtggcacggtacttctcagtcctcacccctttctgttacgttggcttccctactgcagaaccaatattatttcccacacctactgtgagttcatggccctcattaagattgcctgtgctgagacgagaatccgtagagcatacagcctcattgttgccttccttactggtggggtggacttcatattgattatttgttcttatgttctcatactccacacagtcttccacctcccatccaaggaggcccgactcaagaccttgggcacctgtggctcccatatctgtgtcatcttagtgtcttatactccagcattcttctctttcctcacccacaggtttgggcatcatgtggctccccatgtccacatatttgtggccaacatctatcttctggtcccacccatggtgaaccctattatctatggagtaaggaccaagaggatacgagacaggttccttaaatttttcagtttttcaaagtctgtgaactaa

SEQ ID NO: 1336 - protein, 319 aa, Canis familiaris
MLGMSAYNKTDVHPSIFILIGIPGLEAAHIWISIPFCVVYLLALLGNCSLLFIIKTDSSLHEPMYLFLCMLAVADLIVCTTAVPKLLSLFWFHDGEIRIEACLTQVFLIHSCSTMESGFFLAMAFDRYIAICNPLRHSAILTQAVIGGMGLGIVLRGTVLLSPHPFLLRWLPYCRTNIISHTYCEFMALIKIACAETRIRRAYSLIVAFLTGGVDFILIICSYVLILHTVFHLPSKEARLKTLGTCGSHICVILVSYTPAFFSFLTHRFGHHVAPHVHIFVANIYLLVPPMVNPIIYGVRTKRIRDRFLKFFSFSKSVN

SEQ ID NO: 1337 - DNA, 858 bp, Canis familiaris
atgtggattggctttcccttttgtgctgtgtacatgattgcacttctaggaaacctcactattctgtttgtcatccaggctgagagcagcctacaccaaccaatgttctacttcctagccatgttggctactattgatttgggtctgtccacaactaccatccccaagatgcttggaatcttctggtttagtctcagggagatactctttgatgcttgtctcactcagatgttttttatccacaacttcactggtatggagtcagctgtcctgttggcaatggcttatgaccgctacgtggccatctgcaacccacttcgatatagcaccatcctcaccaacagggttgtttctgtgattggtgttggtgtgttagtgagggcatttatttctgtgattccatttgtgtttctgattttgcgatcgcccttctgtgggaatcgtgtcattgcccatacctattgtgaacatatgggtcttgctcgtctctcttgtgccagcatcaagatcaatattatttatggcttatgtgcaatttgtaatctagtatttgacatcataggcattgtcctttcttatgttcagatactgcgagctgttttccgtcttccttctcgtgaagcccgactcaaatccctcagcacatgcggttctcatgtttgtgtaattcttgccttctatacaccagccctcttttcctttatgacacatcgctttggccgaaatgttccccgctatatccacatactcctggccaatctctatgtcatagtgccaccaatgctcaaccctgtcatatatggagtcaggaccaagcagatctatgaccgggtgaagaaaatattattgcaaagataa

SEQ ID NO: 1338 - protein, 285 aa, Canis familiaris
MWIGFPFCAVYMIALLGNLTILFVIQAESSLHQPMFYFLAMLATIDLGLSTTTIPKMLGIFWFSLREILFDACLTQMFFIHNFTGMESAVLLAMAYDRYVAICNPLRYSTILTNRVVSVIGVGVLVRAFISVIPFVFLILRSPFCGNRVIAHTYCEHMGLARLSCASIKINIIYGLCAICNLVFDIIGIVLSYVQILRAVFRLPSREARLKSLSTCGSHVCVILAFYTPALFSFMTHRFGRNVPRYIHILLANLYVIVPPMLNPVIYGVRTKQIYDRVKKILLQR

SEQ ID NO: 1339 - DNA, 936 bp, Canis familiaris
atgttccacacaaatacttccactttccacccagaaaccttttatcttataggcattccaggacttgagggttcccatggctggatctccctgcctttttgctccatttacttaatggctctgttgggcaatgctacaattttgctgatcatctggtctgatcgtgctctgcgggatcctatgttctactttctggccatcttatcagccatagatttggccctttccacatcctcagtgccccgaatgttgggtatcttctggtttgatgcacatgaaattggttttggaacatgtgtggctcagatgttcctgatacacacttttacaggaatggagtctgccgttctgctggctatggcttttgaccgctatgtggctatctgtgtaccactcctctacacaaccatcctgacaccccgagtgctagcaggcattggggtgggtattataatgcgccctgtcctgctcatgttgcccattctctacctaacccatcgtctgcccttctgtgagacacgaattattgcccattcctactgtgagcacatgggcattgccaagttggcctgtgccaacattagagttaatgccatttatggactctttgtggcctcttttcttattttggatgtggcgctagttggaatctcttatgcctacatccttcgagcagttttccgcctcccatctcaagatgctcgtcacaaagctttgagcacatgtgggtcacatgttggggtcatgtgtgttttctatacaccttctctcttctccttcctcacccaccgatttggcaaaaaaattccccgttatgtccacatcctagttgccaatctctatgtggtcttcccacctgccctcaatcctattatctatggtgtgaggacaaagcagattcgtgagcgtgtaatccatactttcacctcaaagtag

SEQ ID NO: 1340 - protein, 311 aa, Canis familiaris
MFHTNTSTFHPETFYLIGIPGLEGSHGWISLPFCSIYLMALLGNATILLIIWSDRALRDPMFYFLAILSAIDLALSTSSVPRMLGIFWFDAHEIGFGTCVAQMFLIHTFTGMESAVLLAMAFDRYVAICVPLLYTTILTPRVLAGIGVGIIMRPVLLMLPILYLTHRLPFCETRIIAHSYCEHMGIAKLACANIRVNAIYGLFVASFLILDVALVGISYAYILRAVFRLPSQDARHKALSTCGSHVGVMCVFYTPSLFSFLTHRFGKKIPRYVHILVANLYVVFPPALNPIIYGVRTKQIRERVIHTFTSK

SEQ ID NO: 1341 - DNA, 921 bp, Canis familiaris
atggtgccttctaatgacacacaattccatcccaatttctttctcttgctgggaattccagggctggaagacatgcatatgtggattggttttccattttgtgttatatatctgacagccttattgggaaatcttacaattctttttgtgattcagactgatcatagtctccatcatcctatgttctactttttggccattctctcctctgttgacatgggcctatccacatccaccatccccaagatggttggcattttctggttcaacttgagagaaatcacttttgagggctgcctcattcagatgttcttcatccacttatgtactggtatggagtcagctgtgctcgtggccatcgcctatgatcactacgtggctatctttaaccctcttcggtacacactggtgttgacaaacaatgtggtatccattatagcattgatcatccttctgagatccataccctttgttctgctcatcttaagattacctttctgtggacaccaaatcatctcccacacttactgtgagcacatgggcattgcccgcctgtcctgtgccagcataaaggtaaacatcatctatggcttatgtgctatctctattttggtgtttgacatcatagccattatcatctcctatgtctataccctccatgctgtcttttgtctcccttccagggatgtccaaatgaaggcactcagcacttgtagctcccatgtgtatgtaatgttggctttctacactccagcatttttctccttcatgacccaccgatttggccaaaatgttcctcaatacatccacattcttcttgccaacttttatgtcatcatcccacctgctctcaaccctgtaatttatgaggtcagaactaggcagataagagaaaaagtaactagaattttaacatataaa

SEQ ID NO: 1342 - protein, 307 aa, Canis familiaris
MVPSNDTQFHPNFFLLLGIPGLEDMHMWIGFPFCVIYLTALLGNLTILFVIQTDHSLHHPMFYFLAILSSVDMGLSTSTIPKMVGIFWFNLREITFEGCLIQMFFIHLCTGMESAVLVAIAYDHYVAIFNPLRYTLVLTNNVVSIIALIILLRSIPFVLLILRLPFCGHQIISHTYCEHMGIARLSCASIKVNIIYGLCAISILVFDIIAIIISYVYTLHAVFCLPSRDVQMKALSTCSSHVYVMLAFYTPAFFSFMTHRFGQNVPQYIHILLANFYVIIPPALNPVIYEVRTRQIREKVTRILTYK

SEQ ID NO: 1343 - DNA, 960 bp, Canis familiaris
atggcaaccctcaaccacactattatcagccactcattcttcattctgctgggcatccctggcctggaagaccagcacacatggatttctcttcctttctttatttcctacctggttgctgtccttgggaatatcctccttgtcttcatcatcatcactgaacgcagtctccatgaacctatgtacttcttcctctgcatgctagctgtggccgacctcatcctgtccactaccactgtgcccaaagcactggccatattctggttccatgcaggggagatctctcttgatggctgtgttactcaaatctttttcatccatgccacattcattgctgaatcagggattctgctggccatggcatttgaccgctatgtggccatctgtgacccattgcgctatactatggtgctcagtcatacagtaatcataagggttggcttggctgtggttctgagaagcttctctgtgatactcccagatgtgttcctggtgaagagactgtctttctgccatagcaatgtgctaccacatacctactgcgagcacatggctgttgccaagtttgcttgtgctgatattcgtgtcaatgtctggtacggcttgtctgttctcctctctactgtagtggtagatgccttgctcatcttggtttcctacaccctcatcctcaatgcagtcttccacctcccttcccgagaagcccggcaaaaggccctgggcacctgtggctgccaccttggggtcatttccatgttctacttgcctggcatttttacaataattacccagcggtttgggcaacatgttcccctccacactcacattctgctggccaatatctgcatgttagctcctcccatgctgaaccctatcatttatggggtcaagaccaaacagattcgagagcgtgtggtcagtacttttcacagtggaaccatgctgagtctgtgtgactga

SEQ ID NO: 1344 - protein, 319 aa, Canis familiaris
MATLNHTIISHSFFILLGIPGLEDQHTWISLPFFISYLVAVLGNILLVFIIITERSLHEPMYFFLCMLAVADLILSTTTVPKALAIFWFHAGEISLDGCVTQIFFIHATFIAESGILLAMAFDRYVAICDPLRYTMVLSHTVIIRVGLAVVLRSFSVILPDVFLVKRLSFCHSNVLPHTYCEHMAVAKFACADIRVNVWYGLSVLLSTVVVDALLILVSYTLILNAVFHLPSREARQKALGTCGCHLGVISMFYLPGIFTIITQRFGQHVPLHTHILLANICMLAPPMLNPIIYGVKTKQIRERVVSTFHSGTMLSLCD

SEQ ID NO: 1345 - DNA, 939 bp, Canis familiaris
atgtcttctgtcaatgacagtgcctcatatccctctgccttccttctgttgggtatacctggtttggaagctttccatatctggattgctttccctttctttgttgtttatctgatagcacttgtggggaatgtcacaatcctgtttgtgattaagactgatcagagtcttcatcaacccatgttctattttctggctctcctctcctttattgacctaggcctctccacttctaccattcccaagatgctagctatattctggctcaacttcagggagataagatttgaaggctgcctcatccagatgttctttatccatacctatactggtatggaatctgtcgtactgctggccatggcaattgaccgctttgttgctatctgttatccactgagatacaccactattctcaccaacagagtggtagccatcatggcctcctttgtagtggggaggccagtcctccttgtcatccccttctgccctcttctcaaacgattgcccttttgtggacactacattattcctcacacttactgtgaacacatgggaatcgcccgtcttgcctgtgctaatataagggtcaacatcatctatggtttatttaccattgctgccctgatttttgacttgatccttattgccctttcctatgttcagatcctacgagctgttttctgtcttccttcgagggatgccagactcaaagcacttagtacatgtggttcacatgtctgtgtcatcctagccttctacacaccagcatttttctcttttatgacacaccgatttggcagaaatattcctcgctacattcacatcctcttggccaatctgtacgtggttgttcccccttgtttaaacccagtcatttatggggtcaggacaaagcaaattcgggaccgagttgtgaaaatatttgtaaagaaagagtga

SEQ ID NO: 1346 - protein, 312 aa, Canis familiaris
MSSVNDSASYPSAFLLLGIPGLEAFHIWIAFPFFVVYLIALVGNVTILFVIKTDQSLHQPMFYFLALLSFIDLGLSTSTIPKMLAIFWLNFREIRFEGCLIQMFFIHTYTGMESVVLLAMAIDRFVAICYPLRYTTILTNRVVAIMASFVVGRPVLLVIPFCPLLKRLPFCGHYIIPHTYCEHMGIARLACANIRVNIIYGLFTIAALIFDLILIALSYVQILRAVFCLPSRDARLKALSTCGSHVCVILAFYTPAFFSFMTHRFGRNIPRYIHILLANLYVVVPPCLNPVIYGVRTKQIRDRVVKIFVKKE

SEQ ID NO: 1347 - DNA, 948 bp, Canis familiaris
atggttgactttaactccactacattcaccaatcctagtaccttcttcctgatgggcatacccggtctagaagacttgcacatttggatatccatccctttttgctcaatgtatattgttgctctcctaggaaacatattcatccttttcatcatcaaaactgagactgccctccatgaacccatgttctattttctttccatgttagccatcacagacctcaccttgtcaacctccactcttcccaagatgttgggtatattctggttcagtgatcatgaaatcagcttccatgcctgcctcactcagatgtttttcatccatgctttttctggggtggagtcagggcttcttgtggccatggcacttgaccggtatgtggcaatctgcaacccactgagacactcatccattcttacaaattctgtggtggctcatgttggcatggtggcacttctacgtggattagtactaatgacaccacatcccttcctggtgaggagatggccatattgccagtccaatgtagttccccacacatactgtgagcacatggctgtggtgaaattggcttgtgctgacatttccatcaatagtctttatagtttggctgtcatcatcttaattgttgggactgatgtgacatgtatctctctgtcctatgtacaaatacttcgtactgtatttaatctcccttctaatgatgccaggttgaaaactctcagcacttgtgggtctcatgtatgtgtcatcctcaccttctacatccctgctcttttctccttcctcacccaccgttttagtaagcatataccactgcacacccacaccctgctggccaacatgtacttgttggtacctcctatgctgaaccctatcatctatggagtaaggaccagacacatccgagaatgtgttctacaattatttatgactaaaatcaactga

SEQ ID NO: 1348 - protein, 315 aa, Canis familiaris
MVDFNSTTFTNPSTFFLMGIPGLEDLHIWISIPFCSMYIVALLGNIFILFIIKTETALHEPMFYFLSMLAITDLTLSTSTLPKMLGIFWFSDHEISFHACLTQMFFIHAFSGVESGLLVAMALDRYVAICNPLRHSSILTNSVVAHVGMVALLRGLVLMTPHPFLVRRWPYCQSNVVPHTYCEHMAVVKLACADISINSLYSLAVIILIVGTDVTCISLSYVQILRTVFNLPSNDARLKTLSTCGSHVCVILTFYIPALFSFLTHRFSKHIPLHTHTLLANMYLLVPPMLNPIIYGVRTRHIRECVLQLFMTKIN

SEQ ID NO: 1349 - DNA, 957 bp, Canis familiaris
atggaatatctactgttaaattacaacaggaccagtcttcgccctaccaccttcctactacttggcattccaggattggaggctgtccacacatggatttctgtccctttttgcctcgtctacttagtatcactgatgggaaatattgctcttctattaattgtcaagacagaccacaaactgcatgaacctatgtacctctttctatgcatgttgtcagtagctgatttgatgcttacttcttctacacttcccaagatactcagcctcttctggttcaattacagagagatctactttgaagcctgcctccttcaaatgtacctcattcattctttgtctactatggaatctggatttattttggccatggcttttgaccgctacatagccatctgtcacccattaagacattccactatcctaacacctgcagtgattgtaggtttgggtttgggcattgttttcagaggagctatactcctcagtccacacccctttttactgcggtggctttcctattgcagaactaatgtcatctcccatacctactgtgagtttatggccctaataaaactggtttgcactgagaccaagattcgtagagcctacagcctaattgtggcattccttacaggggggttggatttcatattgatcatctgttcctatgtccttattcttttcactgtctttaatctcccatccaaagctgcccgcctcaagaccttaagtacatgtgtctcccatgtatgggtcatcttagtgttttatacaccagccttcttctcttttctcactcataggtttggtcaccacattgctccacatattcatatttttgtagccaatatatatcttcttattccacctatgatgaaccctattatttatggtgtgaagacaaaaagaatcagggagagattttttaaattcttaacaatcaaatgtgtttga

SEQ ID NO: 1350 - protein, 318 aa, Canis familiaris
MEYLLLNYNRTSLRPTTFLLLGIPGLEAVHTWISVPFCLVYLVSLMGNIALLLIVKTDHKLHEPMYLFLCMLSVADLMLTSSTLPKILSLFWFNYREIYFEACLLQMYLIHSLSTMESGFILAMAFDRYIAICHPLRHSTILTPAVIVGLGLGIVFRGAILLSPHPFLLRWLSYCRTNVISHTYCEFMALIKLVCTETKIRRAYSLIVAFLTGGLDFILIICSYVLILFTVFNLPSKAARLKTLSTCVSHVWVILVFYTPAFFSFLTHRFGHHIAPHIHIFVANIYLLIPPMMNPIIYGVKTKRIRERFFKFLTIKCV

SEQ ID NO: 1351 - DNA, 753 bp, Canis familiaris
atgcctcctttcaacacctcttctgtcaccttcttattgatgagcatcccaggactagaggacctgcatatctggattgggatccccttctgctccatttacatggtggctgtggtggggaacgagaccatactggccgtggtgagagcagagtgaagtctccatgagcctatgttcttctttctcagcatgctctccatcactgacctggtcttctcctcatccacgcttccctgcatgctctgtgtcttttggcttggagcccatgacattgcctttgatgttttcctggctcaaatgctttttattcacagttttactgctatggaatcgggctttttcctggccatggcctttgactgtcatgtggttatttgtcatccactgtgccataccaccattctcacccatgctcacatcaccataatgggcattattgtggtgattcgaggtgtagccttcttttctccacatcccatcctgctcaaacagctgccttactgcagaacacgaatcattgcccacacttactatgagttcatggctatagtgaagctggtgtgtgtggacataggggccaccaagagttatagcctcagtatggcttctatcattggctcatctgatgccattctcattgctatatcctatgccttcatcctccactctgtgttcagcctgacatcccgggaagctggctttaaggctttgggcacatgtgggtcacatgtctgtgttattcctgttctattc

SEQ ID NO: 1352 - protein, 194 aa, Canis familiaris
MFFFLSMLSITDLVFSSSTLPCMLCVFWLGAHDIAFDVFLAQMLFIHSFTAMESGFFLAMAFDCHVVICHPLCHTTILTHAHITIMGIIVVIRGVAFFSPHPILLKQLPYCRTRIIAHTYYEFMAIVKLVCVDIGATKSYSLSMASIIGSSDAILIAISYAFILHSVFSLTSREAGFKALGTCGSHVCVIPVLF

SEQ ID NO: 1353 - DNA, 936 bp, Canis familiaris
atgacccatcaaaatacaaccatgtttcatccacccacattttttcttttaggcattccagggcttgcaactgcccatgcctggatttcattgcccttctgttgtatttactttattgctctcataggcaatgtcacaatcttgatagtcatatggacagaaagaaccctccgggatccaatgttcttcttccttgtcattctatcagccatagacctggccctctccacaacctcagtaccacgaatgttgggtatcttttggtttaatgctcatgaaattggctttggagcttgcgtggcccagatgtttctgatacacaccttcacaggaatggagtctgctgttctgctggctatggcctttgaccgctatgttgctatctgcgtccccctccactacacaaccatcctgacagtccgagtgctgtcaggaattggagtgggtgttgtcctgagtacagttgtgctcacattgcccatgatctatctaatctaccgtctacccttctgcaatgcccacattattgcccacacctactgtgagcacatgggcattgccaagttggcttgtgccagcattcaaatcaatgctatctatggtctctttgttgcttctttcctcgttcttgtcctggtactggttggaatctcctatggctacattctgtgtgccgtattccgcctcaaatcacaagaggcccgtcacaagacactgagcacttgtacctctcatgctgcagtcatgtttgttttctatacaccctctctcttctccttccttactcaccgatttggccgaaaaatatccccttatatccacattcttgttgccaatatctatgtggtccttccaccagctctcaatcctatcatctatggagtaaggactaagcaaatcagagagtgtgtgatccgagtatttactggcaagtaa

SEQ ID NO: 1354 - protein, 311 aa, Canis familiaris
MTHQNTTMFHPPTFFLLGIPGLATAHAWISLPFCCIYFIALIGNVTILIVIWTERTLRDPMFFFLVILSAIDLALSTTSVPRMLGIFWFNAHEIGFGACVAQMFLIHTFTGMESAVLLAMAFDRYVAICVPLHYTTILTVRVLSGIGVGVVLSTVVLTLPMIYLIYRLPFCNAHIIAHTYCEHMGIAKLACASIQINAIYGLFVASFLVLVLVLVGISYGYILCAVFRLKSQEARHKTLSTCTSHAAVMFVFYTPSLFSFLTHRFGRKISPYIHILVANIYVVLPPALNPIIYGVRTKQIRECVIRVFTGK

SEQ ID NO: 1355 - DNA, 951 bp, Canis familiaris
atggcatctatcaatacatcatatttgaaccccgaaacagtaatcttgattggaattcctggactagaacatgtgcagttttggattgggtttcctttccttgctgtgtgcctagtggctcttttgggaaatatcgttttactaatcatcattcctacagaacacagcctgcatcagcccatgtacatcttcctggcagtgctggcagccaccgacataggactctgtgcagccattgctcccaagatgttggccatcttctggttcagatcttgctccatggcctttgacacctgcctaacccagttgttcttcattcatgccttgcagtgcatggagtctggcattctgttggccatggcttttgaccgctatgttgccatctgtgatccactgagacacacatccatcctcacatcttccattctgtgtcgcatgatagtaatagtggcaattcgagctacagtgctggttggtctgttacccattctaatcaaaagattgcatgtttttcattccattgtgattgctcactcttactgtgagcacatggctgtagtcaagctagctgcagaagatgcccaagtcaataaagcatgtggtctttttgtgggttttaccatactgggatttgacatgatttttatcctcatttcctatatccttattttccaggcagtttttcatctacaccaaaaggaggcacggctcaaagcatttaacacatgtacagctcatatttttgtttttcttgagttttatattcttgccttcttctccttcttcagccaccgttttggacatgttgctccccctacccacattcttctgtctactatctacctccttgtgccacctgcactcaaccctattgtctatggtgtaaaaaacaaggtaattcgtaagcgtgtggcacagatttttcttctgagtcatatatcccaccagtga

SEQ ID NO: 1356 - protein, 316 aa, Canis familiaris
MASINTSYLNPETVILIGIPGLEHVQFWIGFPFLAVCLVALLGNIVLLIIIPTEHSLHQPMYIFLAVLAATDIGLCAAIAPKMLAIFWFRSCSMAFDTCLTQLFFIHALQCMESGILLAMAFDRYVAICDPLRHTSILTSSILCRMIVIVAIRATVLVGLLPILIKRLHVFHSIVIAHSYCEHMAVVKLAAEDAQVNKACGLFVGFTILGFDMIFILISYILIFQAVFHLHQKEARLKAFNTCTAHIFVFLEFYILAFFSFFSHRFGHVAPPTHILLSTIYLLVPPALNPIVYGVKNKVIRKRVAQIFLLSHISHQ

SEQ ID NO: 1357 - DNA, 948 bp, Canis familiaris
atgggatctataaacatgtcatatttgaacccaaagacagtgaccctgattgggatccctggactagagcatgtgcagttttggattggatttcctttccttggagtgtgcctggtggctctgctggggaacatcttcttgttaatcatcatccctatagaacgttgtcttcaccaacccatgtacatcttcctggcagttttggcagccactgacctaggcctctgtgtagccattgctcccaagatgttggccatcttctggtttggctcttactccatggcttttgatgcttgcctcacccagctcttcttcatccatgccttgcagggcatggaatctggtatcctgttggccatggcctttgaccgctatgttgccatctgtgatcccttgagacacacatccattcttacacctctctttctagttcaaatggtactgatggtggccatccgggcaacggtgctagttggaattttacccattctacttaaacgcttgcaacttttccattctgtggttattgttcattcctactgtgaacacatggctgtggtcaagctggttgcagaagatgtccatattaacaaatcatatgggctctttgtagcctttgcaattctaggttttgatatgatctttgtcttcatctcctacattttgatttttcaggctgtttttcgtcttccccagaaagaggcaagactcaaagcattcaatacttgtactgcccatattgctgtcttcctggagttttatatccttgcctttttttccttcttcagccaccgttttggacatgtatcaccctatgttcatattctcttgtctaccatctatctgcttgtgccgcctgcccttaaccccattatctatggtgtgaagaccaaggagatccgcatgcgggttgctcagatttgtattctgaggtctgacaatgagtag

SEQ ID NO: 1358 - protein, 315 aa, Canis familiaris
MGSINMSYLNPKTVTLIGIPGLEHVQFWIGFPFLGVCLVALLGNIFLLIIIPIERCLHQPMYIFLAVLAATDLGLCVAIAPKMLAIFWFGSYSMAFDACLTQLFFIHALQGMESGILLAMAFDRYVAICDPLRHTSILTPLFLVQMVLMVAIRATVLVGILPILLKRLQLFHSVVIVHSYCEHMAVVKLVAEDVHINKSYGLFVAFAILGFDMIFVFISYILIFQAVFRLPQKEARLKAFNTCTAHIAVFLEFYILAFFSFFSHRFGHVSPYVHILLSTIYLLVPPALNPIIYGVKTKEIRMRVAQICILRSDNE

SEQ ID NO: 1359 - DNA, 945 bp, Canis familiaris
atgacctcttgcaacaactccattcctcaacctttgatatttgttctggctggaatccctggcctggaatcttcccatggctggttctctgtgccttttttcttggtctttgttgttacaatttttgggaataccaccatcttatgcatcatccgagtagagaagagtcttcatgagcccatgtttctcctcctggccatgctatctgttgttgacctgtccctggtcagtgtcactgtgccccgcatgctggatatcttctggatgaatgccaaagaaatcagcttcaatgcctgcctcacacaaatgtttttcatcccttccttttacgtcatggagtctgggatcctcctagccatggcttttgacagatttgtggctatctggtttcctctgagatatacaaccatccttgctaacaaggtacttgtgaagatggcactgactgtcctggcaagggcagtggcagtgctgactccagcacccatcctggcagaaagactggaaaggttccaaacccacatcatcgcttactcctactgtgcctatatggctgtggtgaagatagcctgtggagacatctccaaccacattttctatggcctcatggttcttgtagcatccgtgggacttgatctattttttatcattctgtcatatgggctgatccttcatgctgtctttcagataccctcttgggaggcacggggcaaagctctcaatacatgtggctcccacctttgtgtcatagctcttttttattctcctgttgtcttctctgtcctggcccagattttaggctaccatatggctcctcatctacaaattatcattgacaatctctacttcctagtgcctcccatggtcaatcccttgatttatggggcccgaactaagcaaatgcgggagcggatgctgcggatcttccactgtcatagaaactga

SEQ ID NO: 1360 - protein, 314 aa, Canis familiaris
MTSCNNSIPQPLIFVLAGIPGLESSHGWFSVPFFLVFVVTIFGNTTILCIIRVEKSLHEPMFLLLAMLSVVDLSLVSVTVPRMLDIFWMNAKEISFNACLTQMFFIPSFYVMESGILLAMAFDRFVAIWFPLRYTTILANKVLVKMALTVLARAVAVLTPAPILAERLERFQTHIIAYSYCAYMAVVKIACGDISNHIFYGLMVLVASVGLDLFFIILSYGLILHAVFQIPSWEARGKALNTCGSHLCVIALFYSPVVFSVLAQILGYHMAPHLQIIIDNLYFLVPPMVNPLIYGARTKQMRERMLRIFHCHRN

SEQ ID NO: 1361 - DNA, 945 bp, Canis familiaris
atgggactagccaataaatctcaaacatctccagacaccttcttgctgatgggcatcccaggactagagcacctgcatgtatggattgggatccccttctgctccatgtacgtggtggctgtggtggggaatgtgaccatcctggctgtggtgagggcagagcgaagtctccatgagcctatgttcttctttctctgcatgctctccatcaccgacctggtcctctccacatccacgctgccccgcatgctctgtctcttctggcttggagcccatgacattgcctttgatgcctgcctggctcaaatgttcttcattcatagctttactgcgatggaatcgggctttttcctagccatggcctttgaccgttatgtggccatttgtcatccactgcgccataccacgattctcacccatgctcgcattgccaaaatgggagcttctgtggtactccggggagtggccttcttttccccacatcccatcctgctcaaacagctgccctactgcagaacacgaatcattgcccacacctactgtgagttcatggctgtggtgaagctggcgtgtgtggacacaggagctaccaaacgttacagcctcagtgtggcctctgtcattggttcctgtgatggctttttcatcgctgtctcttatgtcctaatcctccgtgcagtctttcgccttccatcacgggaagcaagttttaaagctctaggcacctgtggctcccatgtctgtgtcatccttgttttctactctacagctgtctttaccttcctcactcaccgctttggccacaatgtggctccccaaattcatatctttattgccaatatgtacctcctggtaccacctttccttaatcccattgtttatggtattaggaccaaaaaaattcgagaccatgtccttagttctctaaaggtaaaagtcacttga

SEQ ID NO: 1362 - protein, 314 aa, Canis familiaris
MGLANKSQTSPDTFLLMGIPGLEHLHVWIGIPFCSMYVVAVVGNVTILAVVRAERSLHEPMFFFLCMLSITDLVLSTSTLPRMLCLFWLGAHDIAFDACLAQMFFIHSFTAMESGFFLAMAFDRYVAICHPLRHTTILTHARIAKMGASVVLRGVAFFSPHPILLKQLPYCRTRIIAHTYCEFMAVVKLACVDTGATKRYSLSVASVIGSCDGFFIAVSYVLILRAVFRLPSREASFKALGTCGSHVCVILVFYSTAVFTFLTHRFGHNVAPQIHIFIANMYLLVPPFLNPIVYGIRTKKIRDHVLSSLKVKVT

SEQ ID NO: 1363 - DNA, 945 bp, Canis familiaris
atgcctcctctcaacacctctcgtccctttcctgtcaccttcttgctgatgggcatcccaggactagagcacctgcatgtatggattgggatccccttctgctccatgtacgtggtggctgtggtggggaatgtgaccatcctggctgtggtgagggcagagcgaagtctccatgagcctatgttcttctttctctgcatgctctccatcaccgacctggtcctctccacatccacgctgccccgcatgctctgtctcttctggcttggagcccatgacattgccttcgatgcctgcctagctcaaatgttcttcattcatagctttactaccatggaatcgggctttttcctggccatggcctttgaccgttacgtggccatttgtcatccactgcaccataccacgattctcacccatgctcgcatcaccataatgggtattattgtggtgattcggggagtggccttcttttccccacatcccatcctcctcaaacagctgccctactgcagaacacgaatcattgcccacacctactgtgagttcatggctgtagtgaagctggcatgtgtagacacaggagccaccactcgttatagcctcagtgtggcttctatcattggctcgtgtgatgccattctcactgttgtatcctatgccttcattctccactctgtgttcagcctgccatcccgagaagctggctttaaggctttgggcacatgtggatcacatgtctgtgttattcttgtgttctattccacagctggtttttccattttcactcaccgttttgggaagaatgtgcctgcacacatccatatttttattgcaaatatgtaccttttggtgcccccttttctcaaccccattgtgtatggagtaaggaccaagaagatacgggagcatgttcttagagtgctaaaggtcaatgttgcctga

SEQ ID NO: 1364 - protein, 314 aa, Canis familiaris
MPPLNTSRPFPVTFLLMGIPGLEHLHVWIGIPFCSMYVVAVVGNVTILAVVRAERSLHEPMFFFLCMLSITDLVLSTSTLPRMLCLFWLGAHDIAFDACLAQMFFIHSFTTMESGFFLAMAFDRYVAICHPLHHTTILTHARITIMGIIVVIRGVAFFSPHPILLKQLPYCRTRIIAHTYCEFMAVVKLACVDTGATTRYSLSVASIIGSCDAILTVVSYAFILHSVFSLPSREAGFKALGTCGSHVCVILVFYSTAGFSIFTHRFGKNVPAHIHIFIANMYLLVPPFLNPIVYGVRTKKIREHVLRVLKVNVA

SEQ ID NO: 1365 - DNA, 954 bp, Canis familiaris
atgttctcctgcaacaccagcacttctggtcactctacgtttctcctcactggctttccaggcctggaagcctctcatcattgggtttccatccctgtcaacctcacctgtgtggtttccatcctgggtaacagtatcatccttctcctgattcgtacagatccagccttacatgaacccatgtattttttcctatctatgttggcagcctctgatctgggactcagtgcctctacctttcccacgatgatgtggctcttctggctgaatgctcgtgagcttccctttgatatctgtgcagcacaaatgttcttcatccatgccttcacctatgtggaatctggtgtgctactggccatggcctttgatcgttttgttgccatccgggaacctctgcactatgccacaattctgactcactcagctatggccagaatgggggctgccatccttgtgagggctgtcttgctcaatctcccaggacccatcctcctgcgacgtctgctttttccccagatcagcgtactctctcactgctactgcctgcactgtgaccttgtgggactggcctgctcagacacccagataaacagcttggttggcctagtctccattctcttctcactaggccttgactccttcctcattgtgctctcatatgccctgatcctacgaacagtggtgagcattgcatcacctggggaaaggctcaaggcacttaacacgtgtgtctcacatctctgcattgttctcatcttttatttgcccaaactagggctatctgtgttgcaccgggtagagaagcacaactaccctgctctggcagtgctcatggccaacctgcacttcttggtcccacctttcatgaaccctattgtttactgcatcaagtctaaacagatacgtcagggcctcctaaagcgcttcaaacggaagagggttgacgtctcctag

SEQ ID NO: 1366 - protein, 317 aa, Canis familiaris
MFSCNTSTSGHSTFLLTGFPGLEASHHWVSIPVNLTCVVSILGNSIILLLIRTDPALHEPMYFFLSMLAASDLGLSASTFPTMMWLFWLNARELPFDICAAQMFFIHAFTYVESGVLLAMAFDRFVAIREPLHYATILTHSAMARMGAAILVRAVLLNLPGPILLRRLLFPQISVLSHCYCLHCDLVGLACSDTQINSLVGLVSILFSLGLDSFLIVLSYALILRTVVSIASPGERLKALNTCVSHLCIVLIFYLPKLGLSVLHRVEKHNYPALAVLMANLHFLVPPFMNPIVYCIKSKQIRQGLLKRFKRKRVDVS

SEQ ID NO: 1367 - DNA, 951 bp, Canis familiaris
atggcatccattaacatgtcatatctggaccccacaacagtgatgctaattgggatccctggactagagcatgtgcaattttggattggattttccttctttgtagtatgtgtggtggcttttctgggaaacatcattttactgatcatcattcctgcagaacgcagcttgcatcaacccatgtacatcttcctggcagtgctggcagccactgacataggactctgtgtagctattgctcccaagatgttggccatcttctggtttggctcccgctccatggcttttgatgcttgcttagcccagcttttcttcatccattccttgcagggcatggaatctggcatcctgttggccatggcctttgaccgctatgttgccatctgtgatccactgaggcacacatccatcctcactcctttcatcttggttactttggtgctggttgtggcaattcgggcaatggtgctcgttggcattctacctgttttaatcaaaagactacactttttccattccattgtgattgctcactcttactgtgagcacatggctgtggtcaagctagctgcagaagacatccgagtcaataaaacatgtggtctccttgtaggttttacaatactggggtttgacatgatttttattattatttcttacattcttattttccaggctgttttccgtctacatcaaaaagaggctcggctcaaagcatttaatacatgtacagctcacatttttgttttccttgaattttatattcttgccttcttttccttcttcagccaccgttttggacatgttgctccccctacccatattcttctgtctaccatctacctgcttgtgccacctgcactcaaccctatcgtctatggtgtaaaaaacaaggtgattcgtagacgtgtggcacagattttttttctgaattgtcaatcccggcagtaa

SEQ ID NO: 1368 - protein, 316 aa, Canis familiaris
MASINMSYLDPTTVMLIGIPGLEHVQFWIGFSFFVVCVVAFLGNIILLIIIPAERSLHQPMYIFLAVLAATDIGLCVAIAPKMLAIFWFGSRSMAFDACLAQLFFIHSLQGMESGILLAMAFDRYVAICDPLRHTSILTPFILVTLVLVVAIRAMVLVGILPVLIKRLHFFHSIVIAHSYCEHMAVVKLAAEDIRVNKTCGLLVGFTILGFDMIFIIISYILIFQAVFRLHQKEARLKAFNTCTAHIFVFLEFYILAFFSFFSHRFGHVAPPTHILLSTIYLLVPPALNPIVYGVKNKVIRRRVAQIFFLNCQSRQ

SEQ ID NO: 1369 - DNA, 510 bp, Canis familiaris
atggggtttctgctatgggctgtggctgtgatcctcccaggaccctttctcattaaacaactcagcttttgtaaggctaatgtgctctcccactcatcctgcctacatccagatatcattaagctctcctgttctgaccaccgaataaatagcatctatggcctcatcatcattctcatcatctttggagcagactctgtactcattctcctctattatttgaagattctgatcactgtgcaaggcattgcttcccgggaagaactattcaaggcccttaacacttgtgtgtcccacatttgtgctgtgctgctggtgtctgtccctgtgctgggggtatccattatccattgctttgggaaacaggttccacccatggtgcacactatcatgggttatgtatacctattaattcctcctgttctcgaccctgttgtatactgtgtggaaacccaggggatatgcacctgtattctggataatctactgaaattattgcacagagtactt

SEQ ID NO: 1370 - protein, 170 aa, Canis familiaris
MGFLLWAVAVILPGPFLIKQLSFCKANVLSHSSCLHPDIIKLSCSDHRINSIYGLIIILIIFGADSVLILLYYLKILITVQGIASREELFKALNTCVSHICAVLLVSVPVLGVSIIHCFGKQVPPMVHTIMGYVYLLIPPVLDPVVYCVETQGICTCILDNLLKLLHRVL

SEQ ID NO: 1371 - DNA, 960 bp, Canis familiaris
atggcaaccttaaactccagtaatagcctgtcctccacattctatctcacaggtatccctggctatgaggaatttcaccactggatatccattccattctgtttcttctaccttgtaggaataatgggtaactgcaccatcctgcatattgttcggacagaccccaggctccatgagcccatgtactacttcctggccatgctttcccttactgacatgggcatgtccatgcccacaatgatatcactcttcagggtgttgtggtccatttcccgggaaatccagttcaatatctgcgtggtgcaaatgtttttcattcacactttctccttcactgaatcatctgtgctcttggccatggcctttgaccgctatgtggctatctgccaccctctacgatatgctatcattctcaccccaagacttatcattaaaattggacttgcagctctgcttaggagtgcctttgccatgattccacttttggccaggttggccttctttcctttctgccactcccacatcctttctcattcctattgtctgcaccaggacatgatttgtcttgcctgtgctgacacaaagtttaatgttatatacgggttggttcttattagtgcgctatggggcatggactctctgggtatttttgtgtcttatatgtacattctgcactcaatattaagaattgcatcacgtgaggggaggcttaaggccctcaacacatgtgcatcccacatctgtgctgtactcatcctatatgtgccgatgattgggctctctattgtccatcgttttgccaaacactcctctcccctcatccatatcttcatggctcacatctacttattggttccacccgtgcttaatccaatcatctatagtgtgaagaccaaacagattcgccaaggagttctccacctacttttccccacaaaaatcagttctactatgatgtag

SEQ ID NO: 1372 - protein, 319 aa, Canis familiaris
MATLNSSNSLSSTFYLTGIPGYEEFHHWISIPFCFFYLVGIMGNCTILHIVRTDPRLHEPMYYFLAMLSLTDMGMSMPTMISLFRVLWSISREIQFNICVVQMFFIHTFSFTESSVLLAMAFDRYVAICHPLRYAIILTPRLIIKIGLAALLRSAFAMIPLLARLAFFPFCHSHILSHSYCLHQDMICLACADTKFNVIYGLVLISALWGMDSLGIFVSYMYILHSILRIASREGRLKALNTCASHICAVLILYVPMIGLSIVHRFAKHSSPLIHIFMAHIYLLVPPVLNPIIYSVKTKQIRQGVLHLLFPTKISSTMM

SEQ ID NO: 1373 - DNA, 990 bp, Canis familiaris
atggctacatgggacagactcatgacaggctctaactccagtactgaacagtctgttttgttttacctcactgggattcctggctatgagaatataaatcactttatttccatccctttttgcatgtgctacctgattggagtagtgggcaactgcacaatcctttacatcatccgcacagacaagagtctccacaagcccatgtactacttcctggccatgctgtcccttacggacatgggcatgtccttttctaccctgcccacggtattaaaaatcttctggtttgatgccagggaaattgaggtgaatgcttgtgtggcccaaatgtattttattcatactttttctctgatggagtcagctgtgcttctagccatggcttttgaccggtatgttgccatttgccatcctttgaggtattccagcaaactcaccccacaatgcattatctatataggggtcttcattatattcagatgctccattgtcctccctgttgttcttgttcgtattcctacattttccttctgtcattcccatatcctctaccactctttctgcttgcatcaagaagtcatccatttggcctgtgctgatatctcattcaacattttatatggcttgtttgtcattgcattttattggggtgtagattctctaggaattttgttatcttatgctttcatcttccattctgtcctaggcattgcatcccagggagggaagctcaaagctctcaacacatgtgcttcccacatttgtgctgtgctcattctatatgtgcccatgatagggctatccttggtgcatcgtttcgcaaaacactcctctcccattgtccatataaccatggctaatatttacctgctaattccaccagtacttaatccaattatttatagcatcaagacaaagcagattcgtcaaggttttctaaggatattagcacccaaaaaggttgggttttctcacacttggaagggataa

SEQ ID NO: 1374 - protein, 329 aa, Canis familiaris
MATWDRLMTGSNSSTEQSVLFYLTGIPGYENINHFISIPFCMCYLIGVVGNCTILYIIRTDKSLHKPMYYFLAMLSLTDMGMSFSTLPTVLKIFWFDAREIEVNACVAQMYFIHTFSLMESAVLLAMAFDRYVAICHPLRYSSKLTPQCIIYIGVFIIFRCSIVLPVVLVRIPTFSFCHSHILYHSFCLHQEVIHLACADISFNILYGLFVIAFYWGVDSLGILLSYAFIFHSVLGIASQGGKLKALNTCASHICAVLILYVPMIGLSLVHRFAKHSSPIVHITMANIYLLIPPVLNPIIYSIKTKQIRQGFLRILAPKKVGFSHTWKG

SEQ ID NO: 1375 - DNA, 960 bp, Canis familiaris
atggcaaccttaaactccagtaatagcctgtcctccacattctatctcacaggtatccctggctatgaggaatttcaccattggatatccattccattctgtctcctctaccttgttggaataatgggtaactgcaccatcctgcatattgttcggacagaccccaggctccatgagcccatgtactacttcctggccatgctttccctcactgacatgggcatgtccatgcccacaatgatatcactcttcagggtgttgtggtccatttcccgggaaatccagttcaatatctgtgtggtccaaatgtttttcattcacactttctccttcactgaatcatctgtgctcttggccatggcctttgaccgctatgtggctatctgccaccctctacgatatgctaccattctcaccccaagacttatcattaaaattggacttgcagccctgcttaggagtgcctttgcaatgattccacttttggccaggttggccttctttcctttctgccactcccacatcctttctcattcctattgtctgcaccaggacatgattcgtcttgcctgtgctgacacaatgtttaatattatatatgggttgattctggttattgtgctgtggggcatggactctctgggtatttttgtgtcttatatgtacattctgcactcaatattaagaattgcatcacgtgaggggaggcttaaggccctcaacacatgtgcatcccacatctgtgtggtactcatcctatatgtgccgatgattgggctctctattgtccatcgttttgccaaacactcctctcccctcatccacatcttcatggctcacatctacttattagttccacccgtgcttaatccaatcatctatagtgtgaagaccaaacagattcgccaaggagttctccaccttcttttccccacaaaaatcagttctactatgatgtag

SEQ ID NO: 1376 - protein, 319 aa, Canis familiaris
MATLNSSNSLSSTFYLTGIPGYEEFHHWISIPFCLLYLVGIMGNCTILHIVRTDPRLHEPMYYFLAMLSLTDMGMSMPTMISLFRVLWSISREIQFNICVVQMFFIHTFSFTESSVLLAMAFDRYVAICHPLRYATILTPRLIIKIGLAALLRSAFAMIPLLARLAFFPFCHSHILSHSYCLHQDMIRLACADTMFNIIYGLILVIVLWGMDSLGIFVSYMYILHSILRIASREGRLKALNTCASHICVVLILYVPMIGLSIVHRFAKHSSPLIHIFMAHIYLLVPPVLNPIIYSVKTKQIRQGVLHLLFPTKISSTMM

SEQ ID NO: 1377 - DNA, 975 bp, Canis familiaris
atgtttcatataacagacttggctcacctgtctgtaagaatatccaactctacatctgctcacttcactgcctttctgctgactggagtcccaggattagaagacttccaaatctggatctccatccccttcagcttcatgtaccttttggctgtgataggcaatggtctggttatggcagtggtggcctgggacagaaacctccatgaacccatgtatctcttcctggccatgttggcactcaatgatgttttcctttgtacagtcacagtgcccaaaatgcttctcatcttctggcagggcccttccccatcaacgtttcctgcatgtctcacacagatgttttttgttcatgctctgttcctctctgagtctgctattctcttggccatggcttttgatcgctatgtggctatctgtgcaccactccattatgcaaccctacttaccggctctcttatcagcaaggtaggtctggctctggtggctcggagtgtggctgtggtcacccctggtgtcctcctcattctccggttgcatttctgccggagcaatgtcatccaccatacctactgtgagaacatgggcattgccaagttggcctgtaataacatttcccttaatagcatttatgggctcactgctgcactcctcaccacagggctagactttgtcctcatctccctgtcctactgtctaatcctgagaacagtcttccaactaccttctagagaagcccggacaaaggcctttggaacatgtggagctcatatatgtgtcatcttgatattttatactctagccttcttttccttctttacccatcgctttggaaatcacatacccaggcatgtccttatcctcctggcaaacctctacttattggtgccacctactatgaaccctattgtttatggagtaaagacaaaagagataaggatgcgtgtcttggggctctgtaaccaaccaaaatga

SEQ ID NO: 1378 - protein, 324 aa, Canis familiaris
MFHITDLAHLSVRISNSTSAHFTAFLLTGVPGLEDFQIWISIPFSFMYLLAVIGNGLVMAVVAWDRNLHEPMYLFLAMLALNDVFLCTVTVPKMLLIFWQGPSPSTFPACLTQMFFVHALFLSESAILLAMAFDRYVAICAPLHYATLLTGSLISKVGLALVARSVAVVTPGVLLILRLHFCRSNVIHHTYCENMGIAKLACNNISLNSIYGLTAALLTTGLDFVLISLSYCLILRTVFQLPSREARTKAFGTCGAHICVILIFYTLAFFSFFTHRFGNHIPRHVLILLANLYLLVPPTMNPIVYGVKTKEIRMRVLGLCNQPK

SEQ ID NO: 1379 - DNA, 945 bp, Canis familiaris
atggtctttttcaatagtagtacctacagaccctttcttctgagtggtttccctggtctggaagactcacatccagtgatttccattttgttttgtgccctctacctggttgccctaatggggaacatcatcatccttgtggttattcgggtggaacagtcacttcatgcacccatgtacttttttctctccatgctggctgctactgacctgggactctgcactgccaccctacccaccatgctccagcttttctggtttaaagtttgtgaaatagactttgatgcctgcctcacccagatgttcttcattcatgtgttttccttaatggagtcaggcatcctcctcaccatggcttttgaccgctatgtggccatctccaacccactcaggtacactactattttgactgagtccaccatcaccaagataggtgtggggcttctgctacgggctgtggctgtcatcctcccaggaccctttctcattaaacgactcagcttttgtaaggctaatgtgctctcccactcatactgcctacatccagatatcattaagctctcctgttctgaccaccgaataaatagcatctatggcctcatcatcattctcatcacctttggagcagactctgtactcatcctcttctcttatttgaagattctgatcactgttcaaggcattgcctccaaggaagaacaattcaaggcccttaacacttgtgtgtcccacatctgtgctgtgctgctggtgtatatccctatgctgggggtatccattatccatcgctttgggaaacatgttccacccatggtgcacattatcatgggttatgtatacctattgattcctcctgttctcaaccctgttgtatactgtgtgaaaacccaggggatacgcacccgtattctgggtaatctgaaattacagcagagagtactttag

SEQ ID NO: 1380 - protein, 314 aa, Canis familiaris
MVFFNSSTYRPFLLSGFPGLEDSHPVISILFCALYLVALMGNIIILVVIRVEQSLHAPMYFFLSMLAATDLGLCTATLPTMLQLFWFKVCEIDFDACLTQMFFIHVFSLMESGILLTMAFDRYVAISNPLRYTTILTESTITKIGVGLLLRAVAVILPGPFLIKRLSFCKANVLSHSYCLHPDIIKLSCSDHRINSIYGLIIILITFGADSVLILFSYLKILITVQGIASKEEQFKALNTCVSHICAVLLVYIPMLGVSIIHRFGKHVPPMVHIIMGYVYLLIPPVLNPVVYCVKTQGIRTRILGNLKLQQRVL

SEQ ID NO: 1381 - DNA, 906 bp, Canis familiaris
aataataccaatttccatcccaatacttttcttctccttggcattccaggaatggaggctatccacgcttgtctgtcaatgcctttctgttttgtctacctgagtgctctcctgggtatttttgctattctatttataatcagaacagactccaatctgcatgagcccatgttcttcttcctctgtatgctctctgtgactgacatgatcatctccactactgtcaggcccaaaatgctaagcatattttggttccatggcagtgagatctattttgaagcccttgtacaagtgtttctcattcatttcattcattcattatgcatcatggcctcagggtttatcttggccatggcctttgacaggtatgtggcaatctgtgatcctctgagacattctactatcctgacacatggaatcatcaagaacttggggctggttattgtcttccgtggggttttgctcttcagtcctcaaccatttatgcttcggtggcttccttactgtagaattaatatcatcccccacactatgaatttatggcacggatcaagcttgcttatgcagagaccagaatctacagaatctacacctgactgctgccttcttcactggaggtttagatttcttattgatcctatgttcctgttatcattctctacactgtcttccatcttccattcaaggctgctcggctcaagaccttaggcacatgtggatcccatttgtgtgatctcagtagcctacactccagcctttttcttcttccttactcacagatttggtcaccatatggctcctcatactcatatctttgtggctaacatatatcttctagttccacccatggtaaacccattgatctatggcataagaaccaagaggatcagagatcgagtccttcaa

SEQ ID NO: 1382 - protein, 235 aa, Canis familiaris
NNTNFHPNTFLLLGIPGMEAIHACLSMPFCFVYLSALLGIFAILFIIRTDSNLHEPMFFFLCMLSVTDMIISTTVRPKMLSIFWFHGSEIYFEALVQVFLIHFIHSLCIMASGFILAMAFDRYVAICDPLRHSTILTHGIIKNLGLVIVFRGVLLFSPQPFMLRWLPYCRINIIPHTMNLWHGSSLLMQRPESTESTPDCCLLHWRFRFLIDPMFLLSFSTLSSIFHSRLLGSRP

SEQ ID NO: 1383 - DNA, 525 bp, Canis familiaris
cccccagaatgcagcttgaatcaacccatgtacatcttcctagcagtgctggcagccactgacataggactctgtgtagctattgctcccaagatggtggccatcttctggtttggctgctgctccgtggcttttgaggcttgcttagcccagcttttcttcatccacgccttgcagggcatggaatctggcatcctgttggccatggcctttgactgcaatgttggcatctatgatccactgagtcacacatccatcctcacacctttcatcttggttactatggtgctgtttgtggaaattcaagcaatagtacttgttgatatttttccagttttaatcaaaagactacatattttctattccagtgtaactaccaacatggctgtggtcaagctagctgcagaagacatccaagtcaataacacatgtggtctccttgtagttttacatacagtgataaataaataaataacatacatgttattttcctcatcctatacccttattttccaggccattttt

SEQ ID NO: 1384 - protein, 156 aa, Canis familiaris
PPECSLNQPMYIFLAVLAATDIGLCVAIAPKMVAIFWFGCCSVAFEACLAQLFFIHALQGMESGILLAMAFDCNVGIYDPLSHTSILTPFILVTMVLFVEIQAIVLVDIFPVLIKRLHIFYSSVTTNMAVVKLAAEDIQVNNTCGLLVVLHTVINK

SEQ ID NO: 1385 - DNA, 942 bp, Canis familiaris
atgtctgcttcttctgcttccattatcaattcctccatattcattctcactggtttccctggcctagaccagtactacccctggttttcaattcccttttcttttgtctatgctatggtctttctgggaaactgcctggtgctgcacgtgatcaggactgagccgagcctgcaccagcccatgttctacttcctggccatgctggccctcactgacctgtgcatggggctgtccacggtgcacacggtgctgggggtcttgtgggggctcaatcaagaagtcagtcaggatgcctgcattgcccaaacttacttcatccatggtctgtcatgcatggagtctggagtccttcttgccatggcctttgatcgcttcactgcaatctgcaatcctctgcgctacacatccatcctgaccaacagtagagtcattcatttcatggtgaccattctgatgagggctgctttgtccattctcccagtcatcattcgcctgaagttcttccattactgccgcccccacatcctctcccactctttctgcctgcaccaggacctactccggctggcctgctccgacatccgcttcaacagcttctatgccctggctctggtgatttgtaccttgctgttggatgctgtgctcattctcatctcctacattctcatcttgcacacagtgctggcgattgcatcccaggaggagaggcttaagtccttgcagacctgtgtgtcccacatctgtgctgtcctggtcttttacatccccatcattggcctcaccatggtgcaccgctttggaaagcatctctcaccttctgttcatgtccttatgggcaatatctatattcttttcccacccctgatgaatcccatcatctacagtgtaaagacccagcagatccggggcaggatgaagaagtggttttccctgaaaatgtag

SEQ ID NO: 1386 - protein, 313 aa, Canis familiaris
MSASSASIINSSIFILTGFPGLDQYYPWFSIPFSFVYAMVFLGNCLVLHVIRTEPSLHQPMFYFLAMLALTDLCMGLSTVHTVLGVLWGLNQEVSQDACIAQTYFIHGLSCMESGVLLAMAFDRFTAICNPLRYTSILTNSRVIHFMVTILMRAALSILPVIIRLKFFHYCRPHILSHSFCLHQDLLRLACSDIRFNSFYALALVICTLLLDAVLILISYILILHTVLAIASQEERLKSLQTCVSHICAVLVFYIPIIGLTMVHRFGKHLSPSVHVLMGNIYILFPPLMNPIIYSVKTQQIRGRMKKWFSLKM

SEQ ID NO: 1387 - DNA, 948 bp, Canis familiaris
atgcagttcacaaactacagccagcagaacccaaactcttttctgctcatgggaattcctggcctggaggcatctcacttttggattgcatttcccttctgctccatgtatgcactagcagtgtttggcaacatggcagtgctgctggtggtgcgatcggagcctgccctgcaccagcccatgtacctattcctatgtatgctgtccatcattgacctggtactctgcacttctactgtgcccaagctccttgcacttttttggacaaatgatactgagatcaactttggggcctgtgctacccagatgttttttatccatggcttttcagctgttgaatctggtatcctgctagcaatggcctttgaccgctacttggccatctgccagccactccactatgggtcattgttgcctccagaggctgtgggcaagctggcagctgctgctgtgtttcgtggcttggggctcatgaccccactcacctgcttactggcaagactgagctactgtagccgagtggtggcccattcctactgtgagcatatggctgtggtaaagctggcatgtgggggcacacggccaaacaacatctatggcatcactgctgccacactagttgtgggcacagactcaatttgcatcgctgtctcctatgcgctcatcctccgggctgtgttaggcctctcctccaaagaagcaagggctaagacatttggtacttgtggctcccacctgggtgtcattcttctcttctatacaccaggactcttctcattctacacacaacgctttggccagcatgttccccggcacatccacatcctcctggctgacctctaccttgttgtaccacccatgctcaaccctatcatctatggcatgaagaccaaacagatccgggttggagccctccgactgctgaagcggggcattgttcagtcttaa

SEQ ID NO: 1388 - protein, 315 aa, Canis familiaris
MQFTNYSQQNPNSFLLMGIPGLEASHFWIAFPFCSMYALAVFGNMAVLLVVRSEPALHQPMYLFLCMLSIIDLVLCTSTVPKLLALFWTNDTEINFGACATQMFFIHGFSAVESGILLAMAFDRYLAICQPLHYGSLLPPEAVGKLAAAAVFRGLGLMTPLTCLLARLSYCSRVVAHSYCEHMAVVKLACGGTRPNNIYGITAATLVVGTDSICIAVSYALILRAVLGLSSKEARAKTFGTCGSHLGVILLFYTPGLFSFYTQRFGQHVPRHIHILLADLYLVVPPMLNPIIYGMKTKQIRVGALRLLKRGIVQS

SEQ ID NO: 1389 - DNA, 951 bp, Canis familiaris
atgtcagactccaaccacaccggtacctttttcttcctagcaggcctcccaggcattgaggctgtgcacaaatggctctttatccctctgtgtgccatgtatgtggcctccctggtagggaacagtctgatcctgtgggtggtgaggtcagagccctccctgcaccagcccatgtactacttcctattgatgctggcagtgaccgacctgggtctgtctgcctccacactgcccactgtgctccccatctacctgctgggtctcaggaaagtggcaatggatatgtgtctggcccagctcttcttcatccacaccttctccatcatggagtcctctgtgctgctgactatggccttggaccgttttgtggccatcagcaaccccctgcactatggcaccatcctcacaagcccccgtgttgctagcttaggcctggccagtgtggtgcgcagtgtcgggcttcacatccccgctcccatcatgctgaggaaactgccttattgccagaatcgcctgctttcccattcctactgtctgcacccggatgtcatgaagctggcctgtgtagacacccacatcaacagtgcctatggtctttttgtagtgctctctacactaggggtggactcggtgctcattgttctctcctatgtgctgatcctccaaacagcgctgtccattgcctccaaagctgagcgccttaaagccctcaacacttgtgtctcccatatctgtgctgtgctgctcttctacacaccgatgattggcctgtccatgatccacagatttgggaggtgggcttccccttccagccgggtgctgctctcctacgttcactttctcatacctccagtgctcaatccagtagtttacaccattaagaccaagcagatccggctgaggatgctacgcttattggggtcaggtggggctggcatcagagacacttag

SEQ ID NO: 1390 - protein, 316 aa, Canis familiaris
MSDSNHTGTFFFLAGLPGIEAVHKWLFIPLCAMYVASLVGNSLILWVVRSEPSLHQPMYYFLLMLAVTDLGLSASTLPTVLPIYLLGLRKVAMDMCLAQLFFIHTFSIMESSVLLTMALDRFVAISNPLHYGTILTSPRVASLGLASVVRSVGLHIPAPIMLRKLPYCQNRLLSHSYCLHPDVMKLACVDTHINSAYGLFVVLSTLGVDSVLIVLSYVLILQTALSIASKAERLKALNTCVSHICAVLLFYTPMIGLSMIHRFGRWASPSSRVLLSYVHFLIPPVLNPVVYTIKTKQIRLRMLRLLGSGGAGIRDT

SEQ ID NO: 1391 - DNA, 948 bp, Canis familiaris
atgacaattcttaacaacaataatgccagcagcttcatctttatactgatggatctcccaggactggaggctgctcattgctggacagctattcctatctgctctgtctatgctctatctttgctgggtaacatcaccataatgtacattgtcaagtctgtgcccagcctccacacacccatgtacctcttcctgtccatgctttcaatggctgacttgggcctctcagcttctacactaccttcaatggcagctgtttttctcctaggccagagaaaggtgggagctgcaacttgctttatgcaactcttcttcatccatactttctcagttattgaatcagctgtgctcttggccatggctttcgaccgctgtgtggctatccgagagcccttacgctatgccaccattcttacaaccaagcgcattggtgccattgggctagccattgtcacccgtagtgctgctctccatctgccccttcctgtgctccttagaagactgcaatttcagcctgtgaatgctctgtctcattcatactgcgttcatcctgatgttttaaggctagccagttctagcactcttgtgaacagtagctttgggctctttgtcatgctttctacactaggattggatgctgtactcattctcctctcctatgtgctaatcttaagaacagtattgagcattgcttccaacacggagcggcttaaaacccttaacacctgcatttcccatatctgtgctgtattactattttataccccactggtcagcctgtcgatgattcatcgctttggaaaaatgaagctaccagctcaggtatatatgcttctctcctatctgcactttcttgttcctccgatgctcaacccaattgtctacagtgtgaaaaccaaagagattcgggtacgcattgtaaagatgctcctcccaagaaaacactga

SEQ ID NO: 1392 - protein, 315 aa, Canis familiaris
MTILNNNNASSFIFILMDLPGLEAAHCWTAIPICSVYALSLLGNITIMYIVKSVPSLHTPMYLFLSMLSMADLGLSASTLPSMAAVFLLGQRKVGAATCFMQLFFIHTFSVIESAVLLAMAFDRCVAIREPLRYATILTTKRIGAIGLAIVTRSAALHLPLPVLLRRLQFQPVNALSHSYCVHPDVLRLASSSTLVNSSFGLFVMLSTLGLDAVLILLSYVLILRTVLSIASNTERLKTLNTCISHICAVLLFYTPLVSLSMIHRFGKMKLPAQVYMLLSYLHFLVPPMLNPIVYSVKTKEIRVRIVKMLLPRKH

SEQ ID NO: 1393 - DNA, 969 bp, Canis familiaris
atgttgtccatcaatagtaccaaagccgttttctccacctttctggtgacaggcatacctggactggaagctgtgcacatctggatctctatacccttctccaccatgttcttcattaccttggtgggcaatgtgaccattctgacagttatttgcagggaacggaccctccatgtgcctatgtacctcttcctggccatgctagcagtgtctgacctgggtctgtccctcttcactttccccacaatgctgaggatcttctggctggatactcgagagctcaccttctctgcctgcttcacccaaatgttttttattcataccttccaggattttgagtcagctattatactggcaatggcctttgaccggtatgtggccatttctcatccattgcgctattcttccattctcaccagcagcgctatttccaggataggtttggccattgtagtgcgaaccttgactgtacaggtgcctctccccatccttttgcgaaggctgtgcttctgtcattccaatgtactatctcattcctactgcctgcaccccgatattataaagctctcttgctccaacaccaggatcaatagcatctttggactgtttgtggtattatccacgatgggacttgattttctcctcattctcttttcatacatcctgatactgaaaactgtcctgagcattgcatcctctggtggccgcctcaaggctctcaacacctgtatttcccacatctgtgctgtgattctcttcttcacacccatgatatgcctatctattctgcaccgctttggcccaaaacttccctcacatatctacgtgaccatggctaacatgcattttctcattcctcctgtaatgaaccccattgtgtatgtggcgaaaaccaaacagatacgagataaaattctgaaagttttcatcaaaaaagaaccagaatcccaagtcacatttataacatga

SEQ ID NO: 1394 - protein, 322 aa, Canis familiaris
MLSINSTKAVFSTFLVTGIPGLEAVHIWISIPFSTMFFITLVGNVTILTVICRERTLHVPMYLFLAMLAVSDLGLSLFTFPTMLRIFWLDTRELTFSACFTQMFFIHTFQDFESAIILAMAFDRYVAISHPLRYSSILTSSAISRIGLAIVVRTLTVQVPLPILLRRLCFCHSNVLSHSYCLHPDIIKLSCSNTRINSIFGLFVVLSTMGLDFLLILFSYILILKTVLSIASSGGRLKALNTCISHICAVILFFTPMICLSILHRFGPKLPSHIYVTMANMHFLIPPVMNPIVYVAKTKQIRDKILKVFIKKEPESQVTFIT

SEQ ID NO: 1395 - DNA, 957 bp, Canis familiaris
atgttggcttttaatagcactgcctctaattggcccactttctccttcattggtattcctggtctggaggctgcacatatatggatctccatccccttctgtgtcctgtacatcatggcccttgggggcaatgctcttctgcttatcctagttacagcagagcagaatcttcatgaacctcagttctattttttggctgtgcttgctcttactgacctaggtctttcattgtctacaatgcctagtgtcttggctgtcttctggtttgatgcccgacacattggcctggatgcctgcttaacccaaatgttcttcattcactccctctcctcagtagaatcaggtattcttgtggccatggcttttgaccgtttggtagctatctgcgctccattaaactacaccaggatccttacccactatactgttgcctgccttagtggagctgctgtcttacgaggcgccactctgctggctcctctgccttttttccttaagacttttcctttctgtgggaccaatatcctctcacattcttattgctactacccagatatgctcaacctggcctgtggggatgtctctttcagcagtgcctatgggttggtttttgtcctttgcacatttgcagtggatgttgtcttcatcatagcttcatatatgaagatcttgggcactattatgaacctggagactcaagacagaaactggaaatcactgcacacttgtgcctgccacctgtgcacagtgcttgtgttttacctgcccctcatcagcttggcagtgctgcatcgttacagccgggatgcttctccagttctgtataccaccatgagtaatgcctacctcctcatgacaccactactcaaccctcttgtctacagtgtcaaatccaggcagatccaggctgctctgcgcaagcgattttgggtgcaacgtgtcattgctggggaatga

SEQ ID NO: 1396 - protein, 318 aa, Canis familiaris
MLAFNSTASNWPTFSFIGIPGLEAAHIWISIPFCVLYIMALGGNALLLILVTAEQNLHEPQFYFLAVLALTDLGLSLSTMPSVLAVFWFDARHIGLDACLTQMFFIHSLSSVESGILVAMAFDRLVAICAPLNYTRILTHYTVACLSGAAVLRGATLLAPLPFFLKTFPFCGTNILSHSYCYYPDMLNLACGDVSFSSAYGLVFVLCTFAVDVVFIIASYMKILGTIMNLETQDRNWKSLHTCACHLCTVLVFYLPLISLAVLHRYSRDASPVLYTTMSNAYLLMTPLLNPLVYSVKSRQIQAALRKRFWVQRVIAGE

SEQ ID NO: 1397 - DNA, 921 bp, Canis familiaris
ttctatcagccccccttcttccttctttcaggaattccagagctagaggagtctcacatctggatctccatcccactgggcatcatgtacgtaactttcatcctgggaaacagcatcattattcacataatacctaagaatcccagccttcatgagcctcaatatttgttcttatccctattggcagccactgacacaggcacatcagcatctataccaactactgtacttaatatctttctcttcaaccacagaaagatggagttccatggttgcttggctcctatgttcttcatccatatcttttcatatgttcttcatccatatcttttcatggagtcagccattctgctggccatggctgttgacccctttattgccatatgcaattcactgcactacactgtggtcctgactcaatcccatgttaatcagatgcaattggctactgtggctcgaggagaggtgctgatggcttccttgcccatcctgctcaaatggcttcccttctgtaagaacatcatcctacccactcattctgcttcccccctgatatggaagcttgcttgtgggtccattcatgtgaacatcacttacaggctggcactggatctctgctcctttggtgttgactccatctttattgttctgttttatgtgttgatcaagacagttttgggcattgtttctaggaaaggacagcttaagacagtcaacacatgtgtctcccttaatgtcactgtcctcattttctatgtcccacttattgtcttaatcctcatcctcagaataggcaaataccactcccctctcccccatgtcactatgtccaacattttccttttcctcacatctgtcctcaaccatctaatttacagtgtgaaaacaaaacagatcagaagggcactatgtagactattt

SEQ ID NO: 1398 - protein, 307 aa, Canis familiaris
FYQPPFFLLSGIPELEESHIWISIPLGIMYVTFILGNSIIIHIIPKNPSLHEPQYLFLSLLAATDTGTSASIPTTVLNIFLFNHRKMEFHGCLAPMFFIHIFSYVLHPYLFMESAILLAMAVDPFIAICNSLHYTVVLTQSHVNQMQLATVARGEVLMASLPILLKWLPFCKNIILPTHSASPLIWKLACGSIHVNITYRLALDLCSFGVDSIFIVLFYVLIKTVLGIVSRKGQLKTVNTCVSLNVTVLIFYVPLIVLILILRIGKYHSPLPHVTMSNIFLFLTSVLNHLIYSVKTKQIRRALCRLF

SEQ ID NO: 1399 - DNA, 954 bp, Canis familiaris
atggaacttataaataagagctttttccagccacccactctccttctaacaggcattcctggactggaggctatacaaatatggatctctatcccattgtgtgtcatgtatctaatttctctcctggggaactgtatcatcctctttgttatcaaaatgacctccaggcttcatgagcctcagtacatcttcctatctatgctggcaaccacagatgtgggtctgtctttatcaactctacctacagtactcatggtcttcctcttgaatcacagagaaattgagttccattcttgtctaacacagatgttcttcatccataccttctcctccatggagtcagccatcctattggccatggcctttgaccgatttgtggctatttgcaacccactgcactacaccatggtcttaacttctcctcggattattgggatggggattgcagccatggttaggggagtggtgttgatggtacccttgccaatcctgctcaagcgattgtccttctgcaaggatgttattctatcacattgttactgttatcatcctgatgttatgaaactggcctgtggccctgtcagagtcaacatcatctatgggttgtcccttgtcctctgctcctttggagttgatgctgtgttcattgtcatttcatacatccttattttgaaaacagtgctggatattgcctcagaagatggtcagctcaaggcacttaatacttgtgtttcccacatttttactgtctgcatcttttatgtgccactcattgtgctggctctaattcacaggtttgggacattcacgtctcctcttctccatgtcaccatggccaatctctttctcttcttgacccctgtccttaatcccttggtttatagcctgaaaaccaaacagataagatctgtaatatacaaggtattcaaaggcaggggaaacttgttcaagtag

SEQ ID NO: 1400 - protein, 317 aa, Canis familiaris
MELINKSFFQPPTLLLTGIPGLEAIQIWISIPLCVMYLISLLGNCIILFVIKMTSRLHEPQYIFLSMLATTDVGLSLSTLPTVLMVFLLNHREIEFHSCLTQMFFIHTFSSMESAILLAMAFDRFVAICNPLHYTMVLTSPRIIGMGIAAMVRGVVLMVPLPILLKRLSFCKDVILSHCYCYHPDVMKLACGPVRVNIIYGLSLVLCSFGVDAVFIVISYILILKTVLDIASEDGQLKALNTCVSHIFTVCIFYVPLIVLALIHRFGTFTSPLLHVTMANLFLFLTPVLNPLVYSLKTKQIRSVIYKVFKGRGNLFK

SEQ ID NO: 1401 - DNA, 837 bp, Canis familiaris
cccatctgttccatgtacatagttgctgttgtaggcaataccctcttattatttctgatcttcactgaaacgcagtcttcatgagcccatgtgcctcttcttgtccatgttgtctctggcagatatctttctctccacagtcaccacgccaaagatgctagcaatcttctggttccaagatggggtatttcttttggttgttgtgtgtcccagaggttttttatacacttcatctttgtggcagagtctgccatattgctggccatggcatttgaccactatgtagctatttgttatccactaagatatactaccattttaagcctctcaatctttggaaaaatgggcattgcatctgtgattaggagttttttcatctgtttccctttggtttttctggtttatcagcttacttactgtagaagaaatattattgatcattcatattgtgaacatttgggcattgccaggtatgcctgtgatagcatcaaagtcaacatctactatggggtgattgtggcactttctacatgcctggatgtggtatttatcatcatttcctatgcccttatactctgtatggtgtttagaatttcttctcaagatgcccaactcaaggctctgggtgcttgtgactcccatgtctgtgttattttactgttccatactccagcctttttttcattctttgctcaccaatttggaggccagaatataccactccatgtacatatcctccttgccaatctttatgtggtggtaccatccactctcaacccaatcatttatggagttaagaccaaggaaattcaggagaagtttatccagatcttttct

SEQ ID NO: 1402 - protein, 191 aa, Canis familiaris
MAFDHYVAICYPLRYTTILSLSIFGKMGIASVIRSFFICFPLVFLVYQLTYCRRNIIDHSYCEHLGIARYACDSIKVNIYYGVIVALSTCLDVVFIIISYALILCMVFRISSQDAQLKALGACDSHVCVILLFHTPAFFSFFAHQFGGQNIPLHVHILLANLYVVVPSTLNPIIYGVKTKEIQEKFIQIFS

SEQ ID NO: 1403 - DNA, 945 bp, Canis familiaris
atgtctcccatctctatcttgaatgtcagtagttccagatttattctcactggttttcctggcctcgaagttcactatctctggatctccatccctttctcctccatctatgctatggtcttcctgggaaactgcatggtgctgcatgtgatccggactgagccgagcctgcaccagcccatgttctacttcctggccatgctggccctcactgacctgtgcatggggctgtccactatgtacacggtactgggggtgctgtgggggatcattcgtgagatcagcctggattcctgcattgcccagtcctacttcatccatggtctgtcctttatggagtcctctgtcctccttgctatggcttttgaccgctacattgccatttgcaacccattacgctactcttccatcctcactaatgacaaaatcatgaaaataggggtgacaatcttatgtaggagttctttactcatacctccagttatcattcgtctaaagttcttaaattattgccacccccatatcctttctcattctttctgcctgcaccaagacttaattaggatggcctgttcagacatccgtttcaacagcatttatggtctggccctagtaatcagcaacctattgttggatgcagtgctcatacttatctcctatatcatgatcttgcatgcagtcttagctattgcatcacgggaggagagaatcaaatctttgcagacttgtgtatctcacatctgtgctgtttcagttttctacatcccaatcattggtctgactatggtgcatcgctttgggaaacacctctcaccattggttcatgtcctcatgggcaacatctatatccttttcccacccctgatgaaccccatcatttatagtatcaagacccaacaaatacgaaggagagtccagagattgttttatctgaaaagaatgtaa

SEQ ID NO: 1404 - protein, 314 aa, Canis familiaris
MSPISILNVSSSRFILTGFPGLEVHYLWISIPFSSIYAMVFLGNCMVLHVIRTEPSLHQPMFYFLAMLALTDLCMGLSTMYTVLGVLWGIIREISLDSCIAQSYFIHGLSFMESSVLLAMAFDRYIAICNPLRYSSILTNDKIMKIGVTILCRSSLLIPPVIIRLKFLNYCHPHILSHSFCLHQDLIRMACSDIRFNSIYGLALVISNLLLDAVLILISYIMILHAVLAIASREERIKSLQTCVSHICAVSVFYIPIIGLTMVHRFGKHLSPLVHVLMGNIYILFPPLMNPIIYSIKTQQIRRRVQRLFYLKRM

SEQ ID NO: 1405 - DNA, 951 bp, Canis familiaris
atgttcaagctcaatggcacaatcttcatgcccccggtgctgacactgattgggatccccagcttggagtctgtgcagttctggattggaattcctttctgtgacatgtacatcattgctctatttgggaattccctgctcctgatcatcatcaaatcagaacgcagcctccatgagcccatgtatctcttcctggcaatgcttggagcaacagacattgctctcagcacctgcatcctaccaaaaatgctaggtatcttctggtttcatttgcctgacatatactttgatgcctgtctctttcagatgtggctaatccacaccttccaaggcactaaatcaggaattctgctggccatggccctggaccgctatgtggccatctgtgatcccctgagacatgcaaccatctttacacacaaacttctcactcaaattggagtgggggtgacgctcagagcagccctccttgtagctccatgtctcatcctcatcaaatgtcggctgaaacacttccggaccactgtggtctcccattcatactgtgagcacatggccattgtgaagttggcagcagaagacattcgagtcaacaagatctgtggtctctttgtggccttcactctacttggatttgacataatcttcatcaccctctcctacatccgaatatttataactgtcttcaatctgcctcagagggaagctaggctcaaagccgtcaacacctgcattgcccatatttgcgtcttccttgagttttatctccttggtttcttctccttctttacacacaggtttgggttccatattccaccctacattcatattcttctgtccaacctttacctgcttgtccctcctttgctcaatcctatagtgtatggggtgaagaccaaacagattcgagatcgagtgtccaaggttttccactctaaagattcatcttga

SEQ ID NO: 1406 - protein, 316 aa, Canis familiaris
MFKLNGTIFMPPVLTLIGIPSLESVQFWIGIPFCDMYIIALFGNSLLLIIIKSERSLHEPMYLFLAMLGATDIALSTCILPKMLGIFWFHLPDIYFDACLFQMWLIHTFQGTKSGILLAMALDRYVAICDPLRHATIFTHKLLTQIGVGVTLRAALLVAPCLILIKCRLKHFRTTVVSHSYCEHMAIVKLAAEDIRVNKICGLFVAFTLLGFDIIFITLSYIRIFITVFNLPQREARLKAVNTCIAHICVFLEFYLLGFFSFFTHRFGFHIPPYIHILLSNLYLLVPPLLNPIVYGVKTKQIRDRVSKVFHSKDSS

SEQ ID NO: 1407 - DNA, 951 bp, Canis familiaris
atgttcaagctcaatggcacaatcttcatgcccccggtgctgacactgattgggatccccggcttggagtctgtgcagttctggattggaattcctttctgtgccatgtacatcattgctctgtttgggaattccttgatcttggtcatcatcaaatcagaacgcagcctccatgagcccatgtatctcttcttggcaatgcttggagcaacagacattgctctcagcacctgcatcctaccaaaaatgctaggcatcttctggtttcatctgcctgacatatactttgatgcctgtctctttcagatgtggctcatacataccttccaaggcattgaatcaggaattctgctggccatggccctggaccgctatgtggccatctgtgatcccctgagacacgcaaccatctttacacacaaacttctcactcaaattggagtgggagtgatgctcagagcagccctccttggagctccatgtctcatcctcatcaaatgtcggctgaaacacttccggaccactgtggtctcccattcatactgtgagcacatggccattgtgaagttggcagcagaagacattcgggtcaacaagatctatggtctctttgtggctttcattatacttggtttagacataatttttataacaatctcctacatccgaatatttataactgtcttcaatctgcctcagagggaagctaggctcaaagccttcaacacctgcattgcccatatttgtgtcttccttgagttttatctccttggtttcttctccttctttacacacaggtttgggttccatattccaccctacattcatattcttctgtccaacctttacctgcttgtccctcctttgctcaatcctatagtgtatggggtgaagaccaaacagattcgagatagggtgtccaagattttccactctaaaattccatcttga

SEQ ID NO: 1408 - protein, 316 aa, Canis familiaris
MFKLNGTIFMPPVLTLIGIPGLESVQFWIGIPFCAMYIIALFGNSLILVIIKSERSLHEPMYLFLAMLGATDIALSTCILPKMLGIFWFHLPDIYFDACLFQMWLIHTFQGIESGILLAMALDRYVAICDPLRHATIFTHKLLTQIGVGVMLRAALLGAPCLILIKCRLKHFRTTVVSHSYCEHMAIVKLAAEDIRVNKIYGLFVAFIILGLDIIFITISYIRIFITVFNLPQREARLKAFNTCIAHICVFLEFYLLGFFSFFTHRFGFHIPPYIHILLSNLYLLVPPLLNPIVYGVKTKQIRDRVSKIFHSKIPS

SEQ ID NO: 1409 - DNA, 951 bp, Canis familiaris
atggccatgtcagcctccaatatcagctcaacctatccggcactcttcatgttgatggggatcccaggcctggagcacctgcataactggatctccattccattctgctttgcctatactctggccctgctaggcaactgcacccttctcttcattattcaggctgatgcagccctccatgagcccatgtacttctttctggccatgttggcagccattgacctggtcctctcttctacaacacttcccaaaatgctggctattttttggttcagagatcgggagatcagcttctatggctgtctggtccagatgttctttctccactccttctctatcatggagtcagcagtgctgctggccatggcctttgaccgctatgtggccatctgcaagccattgcactacaccacagtcctgactaggcccctgatcaccaagattggcatggcagctgtggctcgggctgtgacattaatgactccgctcccctttctgctcagatgcttccactactgccgaggcaccatgattgcccactgctactgtgagcatatggctgtggtgaggctggcctgtggggatactcgcttcaacaatatctatggcattgctgtggccatgtttatagtggtgttggacctgctgtttgttatcttgtcttacatcttcatccttcgggcagttttacagcttgcctctcaagaggcccgctacaaggcctttgggacatgtgtatctcacataggtgccatcttagccttttacacacctgtggtcatctcctcagtcatgcatcgtgtggctcgccgggctgcccctcatgtccacatactttttgctaatttctatctgctcttcccgcccatgatcaatcccatcatctatggtgtgaagaccaagcagattcgtgagcgggtcttaggactattccaaagaaaggatgcataa

SEQ ID NO: 1410 - protein, 316 aa, Canis familiaris
MAMSASNISSTYPALFMLMGIPGLEHLHNWISIPFCFAYTLALLGNCTLLFIIQADAALHEPMYFFLAMLAAIDLVLSSTTLPKMLAIFWFRDREISFYGCLVQMFFLHSFSIMESAVLLAMAFDRYVAICKPLHYTTVLTRPLITKIGMAAVARAVTLMTPLPFLLRCFHYCRGTMIAHCYCEHMAVVRLACGDTRFNNIYGIAVAMFIVVLDLLFVILSYIFILRAVLQLASQEARYKAFGTCVSHIGAILAFYTPVVISSVMHRVARRAAPHVHILFANFYLLFPPMINPIIYGVKTKQIRERVLGLFQRKDA

SEQ ID NO: 1411 - DNA, 951 bp, Canis familiaris
atgttcaagctcaatggcacaatcttcatgcccccggtgctgacactgattgggattcccggcttggagtctgtgcagttctggattggaattcctttctgtgccatgtacatcattgctctgtttgggaattccctgctcctggtcatcatcaaatcagaacgcagcctccatgagcccatgtatctcttcctggcaatgcttggagcaacagacattgctctcagcacctgcatcctaccaaaaatgctaggcatcttctggtttcatctgcctgacatatactttgatgcctgtctctttcagatgtggcttatccacaccttccaatgcattgaatcaggaattctgctggccatggccctggaccgctatgtggccatctgtgatcccctgagacatgcaaccatctttacacacaaacttctcactcaaattggagtgggagtgatgctcagagcagccctccttggagctccatgtctcatcctcatcaaatgtcggctgaaacacttcgggaccactgtggtctcccattcatactgtgagcacatggccattgtgaagttggcagcagaagacattcgagtcaacaagatctgtggtctctttgtggccttcactatacttggatttgacataatcttcatcaccctctcctacatccgaatatttataactgtcttcaatctgcctcagagggaagctaggctcaaagccttcaacacctacattgcccatatttgcgtcttccttgagttttatctccttggtttcttctccttctttacacacaggtttgggttccatattccaccctacattcatattcttctgtccaacctttacctgcttgtccctcctttgctcaatcctatagtgtatggggtgaagaccaaacagattcgagatcgagtgtccaaggttttccactctaaagattcctcttga

SEQ ID NO: 1412 - protein, 316 aa, Canis familiaris
MFKLNGTIFMPPVLTLIGIPGLESVQFWIGIPFCAMYIIALFGNSLLLVIIKSERSLHEPMYLFLAMLGATDIALSTCILPKMLGIFWFHLPDIYFDACLFQMWLIHTFQCIESGILLAMALDRYVAICDPLRHATIFTHKLLTQIGVGVMLRAALLGAPCLILIKCRLKHFGTTVVSHSYCEHMAIVKLAAEDIRVNKICGLFVAFTILGFDIIFITLSYIRIFITVFNLPQREARLKAFNTYIAHICVFLEFYLLGFFSFFTHRFGFHIPPYIHILLSNLYLLVPPLLNPIVYGVKTKQIRDRVSKVFHSKDSS

SEQ ID NO: 1413 - DNA, 951 bp, Canis familiaris
atggcagacaatgctacacatagctacatctcatcttttttcctggttggtattcctggtttgcaagcttttcactgctggattggcatccctgtctgcctcctgtttgccctggccctgctggggaacagtgtaatcatcatcaccatcaaaatagaacccagcctccacctgcctatgtatttcttcctttgtatgctggcagtgaatgacatggctcttgtctcttccacagcccccaagatgctgggtatcttctggttggatgctcacaagtttgactttagtatctgtctagcacaaatgtattttatccacacattctgcataattgagtcagccctcttggttgccatggccttcgaccggtatgtagctatttgtatcccactgcgttatacaaccatcttgacaacaccaattgtcactaaaatgggtctagctggtgtgatccgagctacctttatggttttgccctgtcctcttcttattaaaaggctaccgtattacactaaatatgttatcaatcatgcctactgtgaacacatggctgtggtgaagttggccagtgccaacaccctcattaacagagcatatggaatctctgtggccctttcagtgatggtgttggacctagggctcatagctacatcctatatcaagatccttcaggcagtcttccggctatcttctcagaatgcccgctctaaagctctgggcacctgtgctgcccatgtctgcactctacttgtatcgtacacacctgcactatttagtttcctaactcaccgtattggcaagaaggtaccttcaagcattcatataatttttgcaagtttgtatcttttggtgcctcccacagtcaatcccctggtgtatggtgtcaagaccaaacagattcgtgaccgagtggctagtctcttcctctcaaacaagattatttctggaaac

SEQ ID NO: 1414 - protein, 317 aa, Canis familiaris
MADNATHSYISSFFLVGIPGLQAFHCWIGIPVCLLFALALLGNSVIIITIKIEPSLHLPMYFFLCMLAVNDMALVSSTAPKMLGIFWLDAHKFDFSICLAQMYFIHTFCIIESALLVAMAFDRYVAICIPLRYTTILTTPIVTKMGLAGVIRATFMVLPCPLLIKRLPYYTKYVINHAYCEHMAVVKLASANTLINRAYGISVALSVMVLDLGLIATSYIKILQAVFRLSSQNARSKALGTCAAHVCTLLVSYTPALFSFLTHRIGKKVPSSIHIIFASLYLLVPPTVNPLVYGVKTKQIRDRVASLFLSNKIISGN

SEQ ID NO: 1415 - DNA, 945 bp, Canis familiaris
atgcctgcttttcctgcttatgacaccaattcctccacctttctactaacaggcttccctggcctggaacaggaatatccctggctgtccatccctttctcctgtatctatgctatggtactgtctgggaactgcctggtgctgcatgtgatccggactgagccgagcctgcaccagcccatgttctacttcctggccacgctggccctcactgacctgtgcatggggctgtccacggtgcacacggtgctgggcatcctgtggggacttagccaggaagtcagcctggatgcctgcattgctcaaacttatttcatccatggtctgtccctcacagagtctggagtccttctcgccatggctttggatcgctttacagcgatctgtaaccctctgaggtatacgtccatactaaccagtgccaggattaccaagattgggctgggaattttagttaggagttttgtgttcattatggctcccataatccgcctaaagtttttccactattgccattcccacatcctctcgcactctttttgccttcaccaagacttactaagactagcatgttctgacattcgctttaacagtttctatgccttggctctggtgatttgcacacttttgtttgattccatgctaattattgtatcctacattctgatcctgcattctgtcttggctattgcatcccgggaggagcggcttaagtccttgcagacctgtgtctcccatatctgtgctgtcatggttttctatatcccaataattggtctgactatggtgcatcgttttgggaaacacctctctcctatggtccatgtcctcatgggcaacatctatatcatcttcccacccttgatgaaccccatcatctacagtgtcaaaacccaacaaatccgtggcaggattcagaagtggttttccatgaaaaaggagtaa

SEQ ID NO: 1416 - protein, 314 aa, Canis familiaris
MPAFPAYDTNSSTFLLTGFPGLEQEYPWLSIPFSCIYAMVLSGNCLVLHVIRTEPSLHQPMFYFLATLALTDLCMGLSTVHTVLGILWGLSQEVSLDACIAQTYFIHGLSLTESGVLLAMALDRFTAICNPLRYTSILTSARITKIGLGILVRSFVFIMAPIIRLKFFHYCHSHILSHSFCLHQDLLRLACSDIRFNSFYALALVICTLLFDSMLIIVSYILILHSVLAIASREERLKSLQTCVSHICAVMVFYIPIIGLTMVHRFGKHLSPMVHVLMGNIYIIFPPLMNPIIYSVKTQQIRGRIQKWFSMKKE

SEQ ID NO: 1417 - DNA, 318 bp, Canis familiaris
atgtctgttcaatctgattccaaagtcagtaacttcacctttctacttacgggattccctggactggagcaagaatatccctggctgtccatccctttctcctgtatctatgctatggtactgtctgggaactgcctggtgctgcatgtgatccggactgagccgagcctgcaccagcccatgttctacttcctggccatgctggccctcactgacctgtgcatggggctgtccactatgtacacggtactgggcatcctgtgggggctcagccaggagatttggatgcctgcattgcctaaaacttctatattcatg

SEQ ID NO: 1418 - protein, 106 aa, Canis familiaris
MSVQSDSKVSNFTFLLTGFPGLEQEYPWLSIPFSCIYAMVLSGNCLVLHVIRTEPSLHQPMFYFLAMLALTDLCMGLSTMYTVLGILWGLSQEIWMPALPKTSIFM

SEQ ID NO: 1419 - DNA, 951 bp, Canis familiaris
atgtccaagctcaatggcacaatcttcatgcccccggtgctgacactgattgggatccccggcttggagtctgtgcagttctggattggaattcctttctgtgccatgtacatcattgctctgtttgggaattccctgctcctggtcatcatcaaatcagaacgcagcctccatgagcccatgtatctcttcctggcaatgcttggagtcacagacattgctctcagcacctgcatcctaccaaaaatgctaggcatcttctggtttcatctgcctgacatatactttgatgcctgtctctttcagatgtggcttatccacaccttccaatccattgaaataggaattctgttcgccatggccctgtaccgctatgtggccatctgtgatcccctgagacacgcatccatctttacacacaaacttctcactcagattggagtgggagtgacactcagagcagccctccttgtagctccatgtctcatcctcatcaaatgtcggctgaaacacttccggaccactgtggtctcccattcatactgtgagcacatggccattgtgaagttggcagcagaagacattcgagtcaacaagatctatggtctctttgtggccttcactatacttggatttgacataatcttcatcaccctctcctacatccgaatatttataactgtcttcaatctgcctcagagggaagctaggctcaaagccttcaacacctgcattgcccatatttgcgtcttccttgagttttatctccttggtttcttctccttctttacacacaggtttgggttccatattccaccctacattcatattcttctgtccaacctttacctgcttgtccctcctttgctcaatcctatagtgtatggggtgaagaccaaacagattcgagatcgagtgtccaaggttttccactctaaagattcatcttga

SEQ ID NO: 1420 - protein, 316 aa, Canis familiaris
MSKLNGTIFMPPVLTLIGIPGLESVQFWIGIPFCAMYIIALFGNSLLLVIIKSERSLHEPMYLFLAMLGVTDIALSTCILPKMLGIFWFHLPDIYFDACLFQMWLIHTFQSIEIGILFAMALYRYVAICDPLRHASIFTHKLLTQIGVGVTLRAALLVAPCLILIKCRLKHFRTTVVSHSYCEHMAIVKLAAEDIRVNKIYGLFVAFTILGFDIIFITLSYIRIFITVFNLPQREARLKAFNTCIAHICVFLEFYLLGFFSFFTHRFGFHIPPYIHILLSNLYLLVPPLLNPIVYGVKTKQIRDRVSKVFHSKDSS

SEQ ID NO: 1421 - DNA, 954 bp, Canis familiaris
atggcagacaatgctacacatagctacatctcatcttttttcctggttggtattcctggtttgcaagcttttcactgctggattggcatccctgtctgcctcctgtttgccctggccctgctggggaacagtgtaatcatcatcaccatcaaaatagaacccagcctccacctgcctgtgtatttcttcctttgtatgctggcagtgaatgacatggctcttgtctcttccacagcccccaagatgctgggtatcttctggttggatgctcacaagtttgactttagtatctgtctagcacaaatgtattttatccacacattctgcataattgagtcagccctcttggttgccatggccttcgaccggtatgtagctatttgtatcccactgcgttatacaaccatcttgacaacaccaatggtcactaaaatgggtctagctggtgtgatccgagctacctttatggttttgccctgtcctcttcttattaaaaggctaccgtattacactaaatatgttatcaatcatgcctactgtgaacacatggctgtggtgaagttggccagtgccaacaccctcattaacagagcatatggaatctctgtggccctttcagtgatggtgttggacctagggctcatagctacatcctatatcaagatccttcaggcagtcttccggctatcttctcagaatgcccgctctaaagctctgggcacctgtgctgcccatgtctgcactctacttggattctacacacctgcactatttagtttcctaactcaccgtattggcaagaaggtaccttcaagcattcatataatctttgcaagtttgtatcttttggtgcctcccacagtcaatcccctggtgtatggtgtcaagaccaaacagattcgtgaccgtgtggtcagtctcttcctctcaaacaagattatttctggaaactaa

SEQ ID NO: 1422 - protein, 317 aa, Canis familiaris
MADNATHSYISSFFLVGIPGLQAFHCWIGIPVCLLFALALLGNSVIIITIKIEPSLHLPVYFFLCMLAVNDMALVSSTAPKMLGIFWLDAHKFDFSICLAQMYFIHTFCIIESALLVAMAFDRYVAICIPLRYTTILTTPMVTKMGLAGVIRATFMVLPCPLLIKRLPYYTKYVINHAYCEHMAVVKLASANTLINRAYGISVALSVMVLDLGLIATSYIKILQAVFRLSSQNARSKALGTCAAHVCTLLGFYTPALFSFLTHRIGKKVPSSIHIIFASLYLLVPPTVNPLVYGVKTKQIRDRVVSLFLSNKIISGN

SEQ ID NO: 1423 - DNA, 939 bp, Canis familiaris
atgtccatctccaacattacaatcttcatgccttctatgttgacactaatagggatcccaggcctagagtctgtgcagtgctggattgggattccattctgtgccatgtatctcattgctatgattggaaattccttgcttctgttcatcatcaaatctgagcgcagacttcacgagcccatgtatatttttgtaggcttgctaggaatcacagatattgcacttgctaccaccattatgcccaagatgcttggcatattctggtttcatgtgccacagatttactttgattcctgtttgcttcaaatggggctcatccatatgtttcaggggatagagtcaggcatcctcctggccatggccctggaccgttatgtggccatctgttatccactcagacacagtggcatcttcacccatcagctggtggcccaaataggggctattataacactcagggctgccattctagtggccccaggcctagtactgataaagtgcaagtttcaattttatcatacaaccaccatctcccactcctactgtgagcatatggccattgtgaaactggctgcagaaaatgtgcgggtcaacaaaatctatggcttgtttgtggcattcgctgttgcagggttcgacctcaccttcatcactttgtcctacatacagatcttcttcacggtttttcgtttgccccagaaggaggcccgcttgaaagcattcaatacctgcattgcccacatctgtgtcttcctccagttctacctcctcgccttcttctccttcttcacacataggtttggtgctcatgtccctccttatatccacatcctcttttctagcctctacttgctggtccccccatttcttaatccacttgtctatggtgccaagaccaagcagatccgcattcacgtggtaaagatgttctgttcctaa

SEQ ID NO: 1424 - protein, 312 aa, Canis familiaris
MSISNITIFMPSMLTLIGIPGLESVQCWIGIPFCAMYLIAMIGNSLLLFIIKSERRLHEPMYIFVGLLGITDIALATTIMPKMLGIFWFHVPQIYFDSCLLQMGLIHMFQGIESGILLAMALDRYVAICYPLRHSGIFTHQLVAQIGAIITLRAAILVAPGLVLIKCKFQFYHTTTISHSYCEHMAIVKLAAENVRVNKIYGLFVAFAVAGFDLTFITLSYIQIFFTVFRLPQKEARLKAFNTCIAHICVFLQFYLLAFFSFFTHRFGAHVPPYIHILFSSLYLLVPPFLNPLVYGAKTKQIRIHVVKMFCS

SEQ ID NO: 1425 - DNA, 1095 bp, Canis familiaris
atgctcactcccaatgcttccatcttcatgcccgctgtgctaacactcactgggattcctgggctggagtcagtgcagcattggattgggattccattctgtgtcatgtatttcattgctgtattcgggaattccctaattttaggtataatcaaatatgagcacagcctccataagcccatgtacatatttttggccatgttgggggccacagacattgcacttagcacctgtattcttcccaaaatgttaggcatcttctggtttcatttgccagagatttcctgtgcagcctgccttctacaaatgtggcttattcactcattccaggcaattgaatcaggcatcctactggcaatggccctagatcgttatgtggccatctgtgaccccttgagacacaccaccatcttctcccaacaacttttgactcacactggagttggggtgacactcaggactgccattcttattttttaaaaagattttatttatttattcacgagggacacacagagagaggtagagacataggcagagggagaaacaggctccctgagggaagcctgatgcaggattcaatcccaggacaccagatcatgacctgaacagaaggtagatccttaaccactgagccacccaggcatcccagggctgccattcctgtagcaccatgcctagtactcctcaaatgtcatcttaaattctaccgaactacagtcaagtcccatacttattgtgagcacatggccattgtgaaggtggccactgaagagatctgtccaggtcaacaagatatatggtctttttattgccttcagtatcttggggtttgacacaatcttcatcaccttgtcttatgttcaggtctttatcactgtgtttcaattgccccagaaggaggcacgatttaaggcctttaatacctgcattgtccacatctgtgtcttcttacagttctacctccttgccttcttctccttcttcacacataggtttggttctcacataccactatatgttcatatcatcttgtcaaacctttacctgttagtccctcctttcctcaaccctatagtctatggtatgaagtcc

SEQ ID NO: 1426 - protein, 159 aa, Canis familiaris
MLTPNASIFMPAVLTLTGIPGLESVQHWIGIPFCVMYFIAVFGNSLILGIIKYEHSLHKPMYIFLAMLGATDIALSTCILPKMLGIFWFHLPEISCAACLLQMWLIHSFQAIESGILLAMALDRYVAICDPLRHTTIFSQQLLTHTGVGVTLRTAILIF

SEQ ID NO: 1427 - DNA, 942 bp, Canis familiaris
atgtctgttcaatctgtttccaaagtcaataacttcacctttctacttacgggattccctggactggagcaagaatatccctggctgtccatccctttctcctgtatctatgctatggtactgtctgggaactgcctggtgctgcatgtgatccggactgaaccgagcctgcaccagcccatgttctacttcctggccatgctggccctcactgacctgtgcatggggctgtccacagtgcacacggtgctgggcatcctgtgggggctcagccaggagataggtctggatgcctgcattgctcaaaccttctttgttcatggtctgtcatgcatggagtctggagtccttcttgccatggcctttgatcgctttactgccatctgcaatcctctgaggtatacatccatcctcaccaataccagaatcatcaacatgggcatggccatcgtagggaggagtttcctgttcatcactgctcccattgtccgcctaaagttcttccattactgccgtcctcatatcctctcccactctttctgcctgcaccaggacctacttcggctggcctgctctgacattcgcttcaacagcttctatgccttagccctggtgatctgcacactgttgttggattcagtgctcattctcatctcctacgtcttgatcctgcactcagttttgactattgcatcccgggaggagcgcttcaagtccttgcagacctgtgtctcccacatctgtgcagtgctagttttctatatcccaatcattggtctgaccatggtgcaccgctttggaaagcatctgtctcctgtggtccatgttctcatgggcaacatctatatccttttcccacccttgatgaaccccatcatctacagtgtcaaaacccaacaaatacgcagcaggttccagagatggttcaccaaacaaaactga

SEQ ID NO: 1428 - protein, 313 aa, Canis familiaris
MSVQSVSKVNNFTFLLTGFPGLEQEYPWLSIPFSCIYAMVLSGNCLVLHVIRTEPSLHQPMFYFLAMLALTDLCMGLSTVHTVLGILWGLSQEIGLDACIAQTFFVHGLSCMESGVLLAMAFDRFTAICNPLRYTSILTNTRIINMGMAIVGRSFLFITAPIVRLKFFHYCRPHILSHSFCLHQDLLRLACSDIRFNSFYALALVICTLLLDSVLILISYVLILHSVLTIASREERFKSLQTCVSHICAVLVFYIPIIGLTMVHRFGKHLSPVVHVLMGNIYILFPPLMNPIIYSVKTQQIRSRFQRWFTKQN

SEQ ID NO: 1429 - DNA, 951 bp, Canis familiaris
atgcctattacaaatggcaccatgttcatgccctctgtgctgatcttcattgggatccctggtctagaaagtatacagtgttggattgggattccattctgtgctatgtacgtcattgctttggtgggaaattctctgctattgatcatcatcatatctgaacccagtctccatgagcctatgtatatctttctggccatgttgggagccacagacattgcacttagcaccatctttgtccccaagatgcttggaactttttggttccacttgccagagatcttttttgatgtttgcctctttcagatgtggctcatccacacatttcagggtattgaatcaggagtcctgctggctatggctctggaccgctatgtagcaatctgttaccctctgaggcatgctaccatattcactcgacaactagtcactcacattggagttgcagtgacactgcggcctgccattctggtcatcccatgtctgttgctcataaagtgtcgtctgacactttatcgaaccaagttaatatcccacacttactgtgaacacatggccgtcgtgaagcttgctgctgaagacgtttacattaataaattctatggtctccttggggcttttattgttggtggcctggacttcatgttgattgccctctcctatgtacaaatatttatcactgtcttccgcctgcctcagaaagaggcacgtcttaaagcatttaatacatgtattccccacctatgtgtcttcttccaattctatctccttgcttttttttcctttttcactcacagatctggatcttatattccatcatacatacatatcaccctgtccaacctttacctactggttccacctttcttcaatcctcttgtctatggggtgaagaccaaacacatccgagagaaagtagtaaaaatgttccattgcaaagaccaggtttga

SEQ ID NO: 1430 - protein, 316 aa, Canis familiaris
MPITNGTMFMPSVLIFIGIPGLESIQCWIGIPFCAMYVIALVGNSLLLIIIISEPSLHEPMYIFLAMLGATDIALSTIFVPKMLGTFWFHLPEIFFDVCLFQMWLIHTFQGIESGVLLAMALDRYVAICYPLRHATIFTRQLVTHIGVAVTLRPAILVIPCLLLIKCRLTLYRTKLISHTYCEHMAVVKLAAEDVYINKFYGLLGAFIVGGLDFMLIALSYVQIFITVFRLPQKEARLKAFNTCIPHLCVFFQFYLLAFFSFFTHRSGSYIPSYIHITLSNLYLLVPPFFNPLVYGVKTKHIREKVVKMFHCKDQV

SEQ ID NO: 1431 - DNA, 924 bp, Canis familiaris
atgggagaaggaaaccaaactactgtggctgaatttatcttgctgggtctttcacaggatccaaagatccagatcttgctgttctgtgttttcctgatcatttacctcctctctatgtttggaaacctgctcataataatccttattcagactgactctcgacttcacactcccatgtacttcttcctcaaaaacttgtcctttgctgacctctgtttctctacaagcattgtgcctcagatgttggtccacttccttgtaaaaaggaaaagcatttcctttgctggatgctcactacagatcattgtcttccttcttgcagggtgtacagagtgtgcacttctggcagtgatgtcttatgaccgctatgtggctgtctgcaagcccctgcattattccactgtcatgacccaaaaagtttgtgtccagtttgctatagtgtcttgggtcagtggggcatttgtatgttcagtggacagtgcatttacactgtgtctcccttaccagggacagaatgtaattagtcattatttttgtgaacctcctgcactcctgaagctggcttcagcagacacctacaaggctgagatggccctcttttcaatgggtgtcattatcctcttagcacctctctccctcatccttgtctcctactggcatattatctccacagtgattcagatgcagtctgtagaagggaggctcaaggtcttctctacttgtggctcccatctcactgttgtggttctctactatgggtctgggatatttgcctatatgagaccgaattccaagacaatgaatgaaaaggatcaggtcatctctgtgttctattcagttatgacttccatgttgaaccccatcatttacagcttgaggaacaaggatgtgaagggggctctcaggaacctgtttagaagatag

SEQ ID NO: 1432 - protein, 307 aa, Canis familiaris
MGEGNQTTVAEFILLGLSQDPKIQILLFCVFLIIYLLSMFGNLLIIILIQTDSRLHTPMYFFLKNLSFADLCFSTSIVPQMLVHFLVKRKSISFAGCSLQIIVFLLAGCTECALLAVMSYDRYVAVCKPLHYSTVMTQKVCVQFAIVSWVSGAFVCSVDSAFTLCLPYQGQNVISHYFCEPPALLKLASADTYKAEMALFSMGVIILLAPLSLILVSYWHIISTVIQMQSVEGRLKVFSTCGSHLTVVVLYYGSGIFAYMRPNSKTMNEKDQVISVFYSVMTSMLNPIIYSLRNKDVKGALRNLFRR

SEQ ID NO: 1433 - DNA, 957 bp, Canis familiaris
atgtcaaaggaaaatatcacccatattcatgaattcatcctggtgggcttccctacttccccttggctacaggttctgcttttcctcctcttcctcatcacctacctgtttgtcctattggagaatatgatcatcattctcactgtatgggtcactgggtccctgcacaagcccatgtactattttctgggcactatgtcctttctggagacttggtatgtatctgtcacagtccctaagatgttggctggattcctacttcatcccaataccatctccttcctgggatgcatgatccaactctattttttcatctcacttgcctgtactgaatgtgtgctcttggctgccatggcctatgaccgttacgtggctatatgttgtcctcttcgttatccagctatgatgaccacagaattttgtgtgcagctgaccataagttcctgggtgagtggtttcagcatctccatggcaaaggtatacttcatttcccaagttgccttctgtggcaataatatcttgaatcattttttctgtgatgtttcccccatcctcaaactggcctgcatggacttttctatggctgagatggtagactttgtgctagccattctcatccttgtgtttcctctctcagccactgttctttcctatggcttcattgtttctaccatcctgcacattccctcagccactgggcagcagaaggccttctccacctgtgcctctcacctcacagtggtgatcatcttctatacagctgtgatcttcatgtatgtccgacctcgggccattgcttcattcaattctaacaagttgatctcagccatatatgcagtttttactcccatgctcaaccctattatctactgcctgaggaacaaggaagtcaaagatgccatcagaaaaaccatgtcaagtggccaagccctttttttgagagattctttttgctaa

SEQ ID NO: 1434 - protein, 318 aa, Canis familiaris
MSKENITHIHEFILVGFPTSPWLQVLLFLLFLITYLFVLLENMIIILTVWVTGSLHKPMYYFLGTMSFLETWYVSVTVPKMLAGFLLHPNTISFLGCMIQLYFFISLACTECVLLAAMAYDRYVAICCPLRYPAMMTTEFCVQLTISSWVSGFSISMAKVYFISQVAFCGNNILNHFFCDVSPILKLACMDFSMAEMVDFVLAILILVFPLSATVLSYGFIVSTILHIPSATGQQKAFSTCASHLTVVIIFYTAVIFMYVRPRAIASFNSNKLISAIYAVFTPMLNPIIYCLRNKEVKDAIRKTMSSGQALFLRDSFC

SEQ ID NO: 1435 - DNA, 945 bp, Canis familiaris
atgctggagaaaaacatcactctggtcagtgagttcatcctggtgggcttccccactgccccgtggatacaagtcctgctcttcttccttttccttgtggtctacttgctggtggtagtagagaatcttatcatcatgctcactgtttggatcactgcctccctccataaacccaagtactatttcctgagtagcttgtcttttctggaggtctggtatgtttccgtcacagttcccaagatgctggatggattccttctgcagagacgacacatctccttcacaggttgcatgacccagctctacttctttatctcattagcctgcacagagtgtgtgcttctggcagccatggcctatgaccgctatgtggccatctgccaccctctccaatacccaatcattatgaccacaggctattgtgtacagctggtggctttctcctatgtgagtggtttcatggtctctgtcatcaaggtttatttcatttcacatgttgccttttgtggttccaatgtcatgaaccactttttctgtgatatctccccaattctcaagctggcttgcaaagacatgtctacagctgagttagtggactttgctttggctatcatcattcttgtcttgccactcttcaccactatcctttcctatgtctacattgtctccaccattctgcggataccctccacccaaggaaggaagaaagccttctctacctgtgcatcacacctcactgtagtcataatttattatacagccatgatttttatgtatgttcggcccagagctattgcatcatttaattccaacaaactaatctcagctgtgtatgcagtgctcacaccaatgctaaatcctttcatctactgccttaggaaccaggaagttaaaaatgctatcaaaaagactatgggggttggacagtgcctcctgtttagctaa

SEQ ID NO: 1436 - protein, 314 aa, Canis familiaris
MLEKNITLVSEFILVGFPTAPWIQVLLFFLFLVVYLLVVVENLIIMLTVWITASLHKPKYYFLSSLSFLEVWYVSVTVPKMLDGFLLQRRHISFTGCMTQLYFFISLACTECVLLAAMAYDRYVAICHPLQYPIIMTTGYCVQLVAFSYVSGFMVSVIKVYFISHVAFCGSNVMNHFFCDISPILKLACKDMSTAELVDFALAIIILVLPLFTTILSYVYIVSTILRIPSTQGRKKAFSTCASHLTVVIIYYTAMIFMYVRPRAIASFNSNKLISAVYAVLTPMLNPFIYCLRNQEVKNAIKKTMGVGQCLLFS

SEQ ID NO: 1437 - DNA, 984 bp, Canis familiaris
atggagcagagcaaccagagtggaagggtaagtgagtttgtgttgctgggcttcccagctcctgcaccactgcgggcacttttatttgccctttctctgctagcctatgtgttggtgctgactgaaaatacactcatcattgtggcaattaggagccatcccacccttcacaaacccatgtacttttttctggcgaatatgtccttcttggagatatggtatgttactgtcactattccgaagatgttagctggctttgttgggtcaaaacagagccatggacagctaatctcctttgagggctgcatgacacagctctactttttcctgggactgggctgcactgagtgtgtccttcttgctgttatggcctatgatcgttatgtggccatctgtcatcctctccactatggtgtcattgtcagtggccggctgtgtgtgcagctagcaactggctcctggactggaggctttggcatctccatggtcaaagtttttctcatttctcgcctctcctactgtggacccaacatcatcaaccactttttctgtgatgtctccccattgctcaatctttcatgcactgacatgtcaacagcagagcttacagactttgttctggccatttttatcctgctggggccactctctgtcactggggcctcctacatggccatcactggtgctgtagtgcgcattccttcagctgctgggcgccataaagccttttccacctgtgcctctcaccttactgttgtgatcatcttctatgcagccagtatcttcatctacgcccggccaaaggcactctcagcttttgacaccaacaagctagtttctgtactctatgctgtcattgtaccattgcttaaccctatcatttactgcttgcgcaatcaagaggtgaagagagccctacgccgcactctgcacctctaccagggccaggatactaagcacaggaaagctagtagaggtggatag

SEQ ID NO: 1438 - protein, 327 aa, Canis familiaris
MEQSNQSGRVSEFVLLGFPAPAPLRALLFALSLLAYVLVLTENTLIIVAIRSHPTLHKPMYFFLANMSFLEIWYVTVTIPKMLAGFVGSKQSHGQLISFEGCMTQLYFFLGLGCTECVLLAVMAYDRYVAICHPLHYGVIVSGRLCVQLATGSWTGGFGISMVKVFLISRLSYCGPNIINHFFCDVSPLLNLSCTDMSTAELTDFVLAIFILLGPLSVTGASYMAITGAVVRIPSAAGRHKAFSTCASHLTVVIIFYAASIFIYARPKALSAFDTNKLVSVLYAVIVPLLNPIIYCLRNQEVKRALRRTLHLYQGQDTKHRKASRGG

SEQ ID NO: 1439 - DNA, 954 bp, Canis familiaris
atggctggaggaaactggacaagagttgaggaatttatcctcatgagcttctcttctctacctactgaaatacagtcgttactcttcctgacattcctaataatctacctggtcaccctgatgggaaacaccctcatcattctagttactttggctgaccccatgctgcacagtcccatgtacttcttcctcaggaacctgtccttcttggagattggcttcaacctagtcattgtgcccaagatgctggggaccctgcttgcctgggacacaaccatctcctttcttggctgtgccacacagatgtatttcttcttcttctttggagttgatgaatgcttcctcctggccaccatggcatatgaccgctatgtagccatctgcagtcccttgcactacccagtcatcatgaaccaaaggacacgtgccaaattggctgtcgcttcttggtttccaggctttcctgttgctactgtgcagaccacgtggctcttcagttttccattctgtggcaccaacaaggtgaaccacttcttctgtgacagcccacctgtgctgagactggtctgtgcagacacagcactgtttgaaatctatgcaattgttggaaccattctgtttgtcatgacaccttgcttgctgatcctgtgctcctatactcgcattgctgctgccatcctcaaaattccatcagctaaagggaagcataaagccttctctacatgctcctctcacctccttgttgtgtccctgttctatgtatctttaagcctcacttacttccggcctaaatccaataattctcctgaaagcaaaaagctgctgtcattgtcctacactgttgtgactcccatgttgaaccccatcatttatagcctgagaaataatgaagtgaagaatgcctttggccggaccttccgtaaggctttaggccttagaaactgcatctcatag

SEQ ID NO: 1440 - protein, 317 aa, Canis familiaris
MAGGNWTRVEEFILMSFSSLPTEIQSLLFLTFLIIYLVTLMGNTLIILVTLADPMLHSPMYFFLRNLSFLEIGFNLVIVPKMLGTLLAWDTTISFLGCATQMYFFFFFGVDECFLLATMAYDRYVAICSPLHYPVIMNQRTRAKLAVASWFPGFPVATVQTTWLFSFPFCGTNKVNHFFCDSPPVLRLVCADTALFEIYAIVGTILFVMTPCLLILCSYTRIAAAILKIPSAKGKHKAFSTCSSHLLVVSLFYVSLSLTYFRPKSNNSPESKKLLSLSYTVVTPMLNPIIYSLRNNEVKNAFGRTFRKALGLRNCIS

SEQ ID NO: 1441 - DNA, 954 bp, Canis familiaris
atggctggaggaaactggacaaaagttgaggagtttatcctcataagcttctcttctctacctactgaaatacaattgttactcttcctgacattcctaatcatctacctggccaccctgatggggaacaccctcatcattctggttactttggctgaccccatgctgcacagtcccatgtacttcttcctcaggaacttgtccttcttggagattggcttcaacctagtcattgtgcccaagatgctggggaccctgcttgcctgggacacaaccatctcctttcttggctgtgccacgcagatgtatttctccttcttctttggagttgatgaatgcttcctcctggccaccatggcatatgaccgctatgtagccatctgcagtcccttgcactacccagtcatcatgaaccaaaggacacgtgccaaattggctgtcgcttcttggtttccaggctttcctgttgctactgtgcagactacatggctcttcagttttccattctgtggcaccaacgaggtgaaccacttcttctgtgacagtccacctgtgctgaggctggtctgtgcagacacaacactgtttgaaatctatgcaattgttggaactattctggtcgtcatgacaccctgcttgctgatcctgtgctcctatactcgcattgctgctgccattctcaaaattccatcagctaaagggaagcataaagccttctctacatgctcctctcacctccttgttgtgtccctgttctatgtatctttaagcctcacctacttccggcctaaatccaataattctcctgaaagcaaaaagctgctgtcattgtcctacactgttgtgactcccatgttgaaccccatcatttatagcctgagaaataatgaagtgaagaatgcccttggccggaccttccacaaggctttaggccttagaaactgcattccatag

SEQ ID NO: 1442 - protein, 317 aa, Canis familiaris
MAGGNWTKVEEFILISFSSLPTEIQLLLFLTFLIIYLATLMGNTLIILVTLADPMLHSPMYFFLRNLSFLEIGFNLVIVPKMLGTLLAWDTTISFLGCATQMYFSFFFGVDECFLLATMAYDRYVAICSPLHYPVIMNQRTRAKLAVASWFPGFPVATVQTTWLFSFPFCGTNEVNHFFCDSPPVLRLVCADTTLFEIYAIVGTILVVMTPCLLILCSYTRIAAAILKIPSAKGKHKAFSTCSSHLLVVSLFYVSLSLTYFRPKSNNSPESKKLLSLSYTVVTPMLNPIIYSLRNNEVKNALGRTFHKALGLRNCIP

SEQ ID NO: 1443 - DNA, 975 bp, Canis familiaris
atgctcagtgaaatcctgggcagaagaatgacttggagaaactggacagttgtcagtgagtttgttcttgtgagcttttcaactttgtcctctgagattcaagctctgctctttttcctgtttttgactatttacttggttactctaatgggaaatgttctcatcatcctggtcactacagctgactctgctctacaaaatcccatgtacttcttcctcaggaacttgtccttcttggagataggcttcaacttagtcattgtgcccaagatgctggatactctgatcatccaggatgcaaccatctccttccttggctgtgccactcagatgtatttcttcttcttctttggggctgctgagtgctgtctcttggccactatggcatatgaccgctatgtggccatctgtgaccctttgcgttacccaatcattatgaaccgcagagcctgtgcccagctagcagctgcctcttggttctcaggatttccagtggccactgtgcaaaccacatggatttttagcttccctttttgtggccccaacagagtgaaccactttttctgtgacagcccccctgtcattgcactggtctgtgctgatacctctctgtttgaactggaggctctgacagccactgtcctatttatcctcttcccattcttgctgatcctggggtcctatgtccgcatcctctccactatcttcaggatgccctcagctgagggaaaacgtaaggccttctctacctgttcctcccacctcctggttgtctccctcttctacagcaccgccatcctcacatacttccgaccccgatcgagtacctctcctgagagcaagaaactgctatccctctcctacaccgtggtgactcccatgttgaaccccatcatttacagcttaaggaatagtgaagtgaaggctgcactgaggcgagtcctccacaggaccttgggccctcagaaaatctga

SEQ ID NO: 1444 - protein, 324 aa, Canis familiaris
MLSEILGRRMTWRNWTVVSEFVLVSFSTLSSEIQALLFFLFLTIYLVTLMGNVLIILVTTADSALQNPMYFFLRNLSFLEIGFNLVIVPKMLDTLIIQDATISFLGCATQMYFFFFFGAAECCLLATMAYDRYVAICDPLRYPIIMNRRACAQLAAASWFSGFPVATVQTTWIFSFPFCGPNRVNHFFCDSPPVIALVCADTSLFELEALTATVLFILFPFLLILGSYVRILSTIFRMPSAEGKRKAFSTCSSHLLVVSLFYSTAILTYFRPRSSTSPESKKLLSLSYTVVTPMLNPIIYSLRNSEVKAALRRVLHRTLGPQKI

SEQ ID NO: 1445 - DNA, 948 bp, Canis familiaris
atgagagaagcaaatcagacgaaggtgacagagttcctcctcctgggactctctgatgacccccacactcagaagctcctatttattttattcctgggtgtctacctggttactgtgcttgcaaatctgcttctcatgcaccttgttcaggctgactctcggcttcacacacccatgtattttttcctctgcaacttatctttggctgacctctgtttttctaccaacatcgttcctcaggcgctggttcatctgctatccaggaagaaaatcatttcattcacacgttgtgcagctcagcttttactcttcctcatttttgggggtacacagtgtgccttgctggcggtgatgtcctatgatcgatatgtggccatttgcaaccctttgcattaccctagaatcatgacttggagggtgtgtgttcagctggctgtgggatcatggaccagcggcattctggtgtctgtggtagattccacttttacactaaggctaccctaccgaggcagcaatagtattgctcatttcttttgtgaggcccctgcactgttgatgctggcatccacagacacccacacttcagagatggccattttcctcatgggtgttgtgattctcctcatacctgtatccctaattctggtatcctatggccacatcatagtgactgtgttcaggatgaagtcagccattggtaggcgcaaggcattctctacctgtggttcccacctcatggtggtcatcctcttttacgggtcagcaattttcacttacatgataccaaagtcttccaaagaacaggaaaaactggtgtctgtgttctatgcaatgatgacacccatgctcaatcccctcatctatagcttgaggaacaaggatgtgaagggagctctgaggaaagtggccacaaggaatttcccatgcaggcttgaaatctgccactga

SEQ ID NO: 1446 - protein, 315 aa, Canis familiaris
MREANQTKVTEFLLLGLSDDPHTQKLLFILFLGVYLVTVLANLLLMHLVQADSRLHTPMYFFLCNLSLADLCFSTNIVPQALVHLLSRKKIISFTRCAAQLLLFLIFGGTQCALLAVMSYDRYVAICNPLHYPRIMTWRVCVQLAVGSWTSGILVSVVDSTFTLRLPYRGSNSIAHFFCEAPALLMLASTDTHTSEMAIFLMGVVILLIPVSLILVSYGHIIVTVFRMKSAIGRRKAFSTCGSHLMVVILFYGSAIFTYMIPKSSKEQEKLVSVFYAMMTPMLNPLIYSLRNKDVKGALRKVATRNFPCRLEICH

SEQ ID NO: 1447 - DNA, 948 bp, Canis familiaris
atgggagaggaaaaccaaacctctgtggctgagtttattttcctgggcctttcacaagacttgcagacccagatcctgctgtttgttcattttctcatcatttatcttttgactgtgcttgggaacctgctcatcatcattctcatcttcatggactctcgacttcacactcccatgtacttttttcttagaaacctctctttcacagatctctgtttctctaccagcatcgtccctcaagtgttggtccatttcctggtaaagaggaaaacaatttcttttcttgggtgtatggcacagatagttgtttcccttctggctgggtgtacagagtgtgctctgctggcggtgatgtcttatgactggtacgtggctgtctgcaagcccctgcactactctagcatcatgacccaacaggtgtgtctccagttggccatacgatcctgggccagtggagcacttgtgtctctgatggataccacctttactttccaactaccctatcaagggcagaacactattaatcactacttttgtgaacttcctgcccttctgaaggtggcttcagcagatacttacagcacagaaatggccatctttgcaatgagcgtggacatccttttagctcctgtctgcctgattctggtttcctactggaatattatctccactgtaatcccgatgcagtctggggaggggaggcttaaggttttctctacctgtggttcccatctcattgttgttgtcttcttctttggctcaggaatgttcaactacatgaagccaaactccaagaaaatgaatgaaagggataaaatgatctgtgtttctgtgttctatgcagtggtgactccaatgttgaaccccataatttatagcctgagaaacaaggatgttaaaggagctttcagaaacctagcaggaagaaagcccttttctgagagatgg

SEQ ID NO: 1448 - protein, 316 aa, Canis familiaris
MGEENQTSVAEFIFLGLSQDLQTQILLFVHFLIIYLLTVLGNLLIIILIFMDSRLHTPMYFFLRNLSFTDLCFSTSIVPQVLVHFLVKRKTISFLGCMAQIVVSLLAGCTECALLAVMSYDWYVAVCKPLHYSSIMTQQVCLQLAIRSWASGALVSLMDTTFTFQLPYQGQNTINHYFCELPALLKVASADTYSTEMAIFAMSVDILLAPVCLILVSYWNIISTVIPMQSGEGRLKVFSTCGSHLIVVVFFFGSGMFNYMKPNSKKMNERDKMICVSVFYAVVTPMLNPIIYSLRNKDVKGAFRNLAGRKPFSERW

SEQ ID NO: 1449 - DNA, 954 bp, Canis familiaris
atggctggaggaaactggacaagagttgaggaatttatcctcatgagcttctcttctctacctactgaaatacaattgttactcttcctgacattcctaatcatctacctggtcaccctgatgggaaacaccctcatcattctggttactttggctgatcccatgctgcacagtcccatgtacttcttcctcaggaacttgtccttcttggagattggcttcaacctagtcattgtgcccaagatgctggggaccctgcttgcctgggacacaaccatctcctttcttggctgtgccacacagatgtatttcttcttcttctttggaggtgctgaatgcttcctcctggccaccatggcatatgaccgctatgtagccatctgcagtcccttgcactacccagtcatcatgaaccaaaagacacgtgccaaattggctgtcgcttcttggtttccaggctttcctgttgctaccgtgcagaccacgtggctcttcagttttccattctgtggcaccaacaaggtgaaccacttcttctgtgacagcccacctgtgttgaggctggtctgtgcagacacagcactgtttgaaatctatgcaattgttggaaccattctggtcgtcatgacaccctgcttgctgatcctgtgctcctatactcgcattgctgctgccatcctcaaaattccatcagctaaagggaagcataaagccttctctacatgctcctctcacctccttgttgtgtccctgttctatgtatctttaagcctcacctacttccggcctaaatccaataattctcctgaaagcaaaaagctgctgtcattgtcctacactgttgtgactcccatgttgaaccccatcatttatagcctgagaaataatgaagtgaagaatgcctttagccggaccttccgtaaggctttaggccttagaaactgcatcccatag

SEQ ID NO: 1450 - protein, 317 aa, Canis familiaris
MAGGNWTRVEEFILMSFSSLPTEIQLLLFLTFLIIYLVTLMGNTLIILVTLADPMLHSPMYFFLRNLSFLEIGFNLVIVPKMLGTLLAWDTTISFLGCATQMYFFFFFGGAECFLLATMAYDRYVAICSPLHYPVIMNQKTRAKLAVASWFPGFPVATVQTTWLFSFPFCGTNKVNHFFCDSPPVLRLVCADTALFEIYAIVGTILVVMTPCLLILCSYTRIAAAILKIPSAKGKHKAFSTCSSHLLVVSLFYVSLSLTYFRPKSNNSPESKKLLSLSYTVVTPMLNPIIYSLRNNEVKNAFSRTFRKALGLRNCIP

SEQ ID NO: 1451 - DNA, 954 bp, Canis familiaris
atggctggaggaaactggacaagagttgaggaatttatcctcatgagcttctcttctctacctactgaaatacaattgttactcttcctgacattcctaatcatctacctggtcaccctgatgggaaacactctcatcattctggttactttagctgaccccatgctgcacagtcccatgtacttcttcctcaggaaactgtccttcttggagattggcttcaacctagtcattgtgcccaagatgctggggaccctgcttgcctgggacacaaccatctcctttcttggctgtgccacacagatgtatttcttcttcttctttggagttgatgaatgcttcctcctggccaccatggcatatgaccgctatgtagccatctgcagtcccttgcactacccagtcatcatgaaccaaaggacacgtgccaaattgactgtcgcttcttggttaccaggctttcctgttgctactgtgcagaccacgtggctcttcagttttccattctgtggcaccaacaaggtgaaccacttcttctgtgacagcccacctgtgctaaggctggtctgtgcagacacaacactgtttgagatttatgcaattgttggaaccattctggtcatcatgacaccctgcttgctgatcctgtgctcttacactcgcattgctgctgccatcctcaaaattccatcagctaaagggaagcataaagccttctctacatgctcctctcacctccttgttgtgtccctgttctatgtatctttaagcctcacctacttccggcctaaatccaataattctcctgaaagcaaaaagctgctgtcattgtcctacactgttgtgactcccatgttgaaccccatcatttatagcctgagaaatgatgaagtgaagaatgcccttggcccgactgtccacaaggctttaggccttagaaactgcatcccatag

SEQ ID NO: 1452 - protein, 317 aa, Canis familiaris
MAGGNWTRVEEFILMSFSSLPTEIQLLLFLTFLIIYLVTLMGNTLIILVTLADPMLHSPMYFFLRKLSFLEIGFNLVIVPKMLGTLLAWDTTISFLGCATQMYFFFFFGVDECFLLATMAYDRYVAICSPLHYPVIMNQRTRAKLTVASWLPGFPVATVQTTWLFSFPFCGTNKVNHFFCDSPPVLRLVCADTTLFEIYAIVGTILVIMTPCLLILCSYTRIAAAILKIPSAKGKHKAFSTCSSHLLVVSLFYVSLSLTYFRPKSNNSPESKKLLSLSYTVVTPMLNPIIYSLRNDEVKNALGPTVHKALGLRNCIP

SEQ ID NO: 1453 - DNA, 951 bp, Canis familiaris
atggagtactggaactccaccttgggcagtggctttatattgatggggattctgaatgacagtgggtctcctgaactgctctgtgccacaatcactgtcctatacatgttggctctgaccagcaatggcctgctgctcttggtcatcacagtggattcccggctccatgtgcccatgtacttcctgctcggccagctctcactcatggacctcctcttcacatctgttgtcactcccaaggccctcgtggatattctgcagagtgaaaacacgatctcctttggaggctgtgcccttcagatgtttctggcattgacgctgggtggtgcagaggacttgctgctggccttcatggcctatgacagatatgtggccatatgtcatcctctgaactacatggttttcatgaggccaagggtctgctcactcatggtggccacggcctggatcctggcatttctgagtgctctaggccataccttgtataccatgcactaccctttctgtaaagttcggaagatcaggcacctgctctgtgagatccctcctttgctgaagttggcctgtgcagatacctcccgatatgaactcttggtgtatgtgacaggagtgactttccttttgatgcctctttctgccattgttgcctcctatgtactaattctgtgtactgtgcttcacatgccctcaaatgaggggaagcagaaagccctagtcacctgcttctcccacctgacagtcgttgggattttctatggagctgccacattcatgtatgtcctgcccagttccctccacagccccaggcaggacaacatcatctctcttttctacacggttgtcactccagcgctgaacccccttatctatagcctgaggaatcaggaggtcatgggggccttgagaagggtcctgggaaaatatatgttgccaacacactgtaccttctaa

SEQ ID NO: 1454 - protein, 316 aa, Canis familiaris
MEYWNSTLGSGFILMGILNDSGSPELLCATITVLYMLALTSNGLLLLVITVDSRLHVPMYFLLGQLSLMDLLFTSVVTPKALVDILQSENTISFGGCALQMFLALTLGGAEDLLLAFMAYDRYVAICHPLNYMVFMRPRVCSLMVATAWILAFLSALGHTLYTMHYPFCKVRKIRHLLCEIPPLLKLACADTSRYELLVYVTGVTFLLMPLSAIVASYVLILCTVLHMPSNEGKQKALVTCFSHLTVVGIFYGAATFMYVLPSSLHSPRQDNIISLFYTVVTPALNPLIYSLRNQEVMGALRRVLGKYMLPTHCTF

SEQ ID NO: 1455 - DNA, 972 bp, Canis familiaris
atgtccagtgaaatcctgggcagaagaatgacgtggggaaactggacgattgtcagtgagtttgttcctgtgagctttttaactttgtcctttgagctccacgctctgctctttctctttttttttttttttttttttgactatttacttggttactctaatgggcaatgttatcattctggtcactacagctgactccgctctacaaaatcctatgtactgcttcctcaggaacttgtccttcttggagataggcttcaacttagtcattgtgcccaagatgctggatactctgatcatccaagacgcaaccatctccttccttggcttgccactcagatgtatttcttcttcttcgttggggctgctgagtgctgtctcctggccacaatggcatatgaccgctatgtggccatctgtgaccctttgcgttacccagtcattatgaatcacagagcctgtgcccagctagcagctgcctcttggttctcaggattaccagtggccactgtgcaaaccacatgggtttttagcttccctttttgtgcccccaacagagtgaaccactttttctgtgacagcccccctgtcattgcactggtctgtgctgattcctctctgaactggaggctctgacacccactgtcctatttatcctcttccttttcttgctgatcctagagtactatgtccgcatcctctccattttcaggatgccctcagctgaggggaaacgtaaggccttctctacctgttcctcccacctcctggttgtctccctcttctacagcactgccatcttcacatacttcctatccctatccaacacctctcctgaccaagagactgctgtccctttcctacaccgtggtgactctcatgttgaagccaatcatctacagtttaaggaatagtgaagtgaaggctacactgaggcaagtcctccacaggactctgggccctcagaaactc

SEQ ID NO: 1456 - protein, 95 aa, Canis familiaris
MSASSPFSGCPQLRGNVRPSLPVPPTSWLSPSSTALPSSHTSYPYPTPLLTKRLLSLSYTVVTLMLKPIIYSLRNSEVKATLRQVLHRTLGPQKL

SEQ ID NO: 1457 - DNA, 861 bp, Canis familiaris
atgagagcagcaaatcagacgcaggtgacagagttcctcctcctgggactctctgatgacccccacactcagaagctcctatttattttattcctgggtgtctacctggttactgtgcttgcaaatctgcttctcatgcaccttgttcaggctgactctcggcttcacaaacccatgtattttttcctctgcaacttatctttggctgacctctgtttttctaccaacatcgttcctcaggccctggtccatctgctatccaggaaaaagataatttcattcacatgatgtgcagctcagcttttactcttcctcatttttgggggtacacagtgtgcctttctggcggtgatgtcctatgatcgatatgtggccatctgcaaccatttgcattactctagcatcatgacttggtgggtgtgtattcagctggctgcaggatcatggaccagtggcattttggtgtctgtggtagataccacttttatgctaaggctaccctatcaagacagcaatagcattgctcatttcttttgtgaggcccctgcactgttgatgctggcatccacagacacccacacttcagagatggccattttcctcatgggtgttgtgattctcctcatacctgtatccctaattctggtatcctatggccacatcatagtgattgtattcaggatgaagtcagccattggtaggtgcaaggaattctctacctgtggttcccacctcatggtggtcttcctcttttatgggccagcaattttcacttacatgaccccaaagtgttccaaagaacaggaaaaacttgtgtctgtgttctatgcaatggtgacacccacagtcaatcctcttatc

SEQ ID NO: 1458 - protein, 170 aa, Canis familiaris
MSYDRYVAICNHLHYSSIMTWWVCIQLAAGSWTSGILVSVVDTTFMLRLPYQDSNSIAHFFCEAPALLMLASTDTHTSEMAIFLMGVVILLIPVSLILVSYGHIIVIVFRMKSAIGRCKEFSTCGSHLMVVFLFYGPAIFTYMTPKCSKEQEKLVSVFYAMVTPTVNPLI

SEQ ID NO: 1459 - DNA, 945 bp, Canis familiaris
atgggaaaggaaaaccaaacctttgtgactgaatttattttactgggcctttcacaagacttgcagacccagatcctgctgtttgttcttttcctcatcatttatcttttgactgtgcttgggaacctgctcatcatcattctcatcttcatggactctcgacttcacactcccatgtacttttttcttagaaacctctctttcgcagatctctgtttctctactagcatcgtccctcaagtgttgttccatttcctggtaaagaggaaaacaatttcttttcttgggtgtatgacgcagattgttgtcttccttctggctggatgtacagagtgtgcactgctggcggtgatgtcttatgaccggtacgtggctgtctgcaagcccctgcactactctagcatcatgacccaaaaggtgtgtcttcagttggccataggatcctgggccagtggagcactcgtgtctctggtggataacacctttactttccaactaccctatcaaggacagaacattattaatcactacttttgtgaacttcctgcccttctgaaggtggcttcagcagatacttacagcacagaaatggccatctttgcaatgggtgtagtcatgctcttagttcctgtctgcctgattctggtctcctactggaatattatctccactgtgatccagatgcagtctggggaagggaggctaaaggccttctctacctgtggctcccatctcattgttgttgtcctcttctatggctcaggaatattcgactacatgaggccaaactccaagaccacaaaagagcaggataaaatggtatctgtgttctatacagtggtgactccaatgttgaaccccataatatatagcctgagaaacaaggatgttaaaggggctctcagaaaactagctggaagaaagtccttttctcagaggcagtga

SEQ ID NO: 1460 - protein, 314 aa, Canis familiaris
MGKENQTFVTEFILLGLSQDLQTQILLFVLFLIIYLLTVLGNLLIIILIFMDSRLHTPMYFFLRNLSFADLCFSTSIVPQVLFHFLVKRKTISFLGCMTQIVVFLLAGCTECALLAVMSYDRYVAVCKPLHYSSIMTQKVCLQLAIGSWASGALVSLVDNTFTFQLPYQGQNIINHYFCELPALLKVASADTYSTEMAIFAMGVVMLLVPVCLILVSYWNIISTVIQMQSGEGRLKAFSTCGSHLIVVVLFYGSGIFDYMRPNSKTTKEQDKMVSVFYTVVTPMLNPIIYSLRNKDVKGALRKLAGRKSFSQRQ

SEQ ID NO: 1461 - DNA, 945 bp, Canis familiaris
atgggagaggaaaatcaaacctctgtggctgagtttattttcctgggtctttcccaggatttgcagacccagatcctgatgtttgttctttttctcatcatttatcttttgactgtacttgggaacctgctcatcatcattctcatcttcatggactctcgacttcacactcccatgtacttttttcttagaaacctctctttcgcagatctctgtctttctagcagcatcgtccctcaagtgttgttccatttcctggcaaagaggaaagctatttcttttcttgggtgtatgacacagatagttgtctctcttatgattgggtgtgcagagtgtgcactgctggcggtgatgtcttatgaccggtacgtggctgtctgcaagcccctgcactactctagcatcatgacccaaaaggtgtgtctccagttggccataggatcctgggccagtggagcactcatgtctctggtggataccacctttactttccaactaccctaccaaggacagaagattattaatcactacttttgtgaacttcctgcccttctgaaggtggcttcaggagatacttacagcacagaaatggccgtctttgcagtgggtgtggtcatgctcttagttcctgtctgcctgattctggtctcctactggaatattatctccactgtgatccagatgcagtctggggaggggaggctcaaggctttctctacctgtggttcccatctcattgttgttgtcctcttctatggatcagcgatattcaactacatgaagccaaactccaaaatagtcaatgaaagtgataaagtgatctctacattctatgcagtggtgactccaatattgaaccccataatttatagcctgagaaataaggatgttaaagatggtttcagaaaactagctggaagaaagctcttttctgagagatggtga

SEQ ID NO: 1462 - protein, 314 aa, Canis familiaris
MGEENQTSVAEFIFLGLSQDLQTQILMFVLFLIIYLLTVLGNLLIIILIFMDSRLHTPMYFFLRNLSFADLCLSSSIVPQVLFHFLAKRKAISFLGCMTQIVVSLMIGCAECALLAVMSYDRYVAVCKPLHYSSIMTQKVCLQLAIGSWASGALMSLVDTTFTFQLPYQGQKIINHYFCELPALLKVASGDTYSTEMAVFAVGVVMLLVPVCLILVSYWNIISTVIQMQSGEGRLKAFSTCGSHLIVVVLFYGSAIFNYMKPNSKIVNESDKVISTFYAVVTPILNPIIYSLRNKDVKDGFRKLAGRKLFSERW

SEQ ID NO: 1463 - DNA, 945 bp, Canis familiaris
atggaagaggaaaaccaaaccactgtggctgagtttattttcctgggcctttcacaggacttgcagactcagatcctgctgtttgttctttttctcatcatttatcttttgactgtgcttgggaacctgctcatcatcattctcatcttcatggactctcgacttcacactcccatgtacttttttcttagaaacctctcttttgcagatctctgtttctctaccagcatcgtccctcaagtcttggtccatttcctggcaaagaagaaaatgatttcttttcttgggtgtatggcacagatagttgtctcccttctgattgggtgtacagagtgtgcactgctggcggtgatgtcttatgaccggtacgtggctgtctgcaagcccctgcactactctagcatcatgacccaaaaggtgtgtctccagttggccataggatcctgggccagtggagcactcgtgtctctggtggataccacctttactttccaactaccctatcaagggcagaacattattaatcactacttttgtgaacttcctgcccttctgaaggtggcttcagcagatacttacagcacagaaatggccatctttgcaatgggtgtggtcatcctcttagctcctgtctgcctgattctggtctcctactggaatattatctccaccgtgatcccgatgcagtctggggaggggaggctcaaagctttctctacctgtggctcccatctcattgttgttgtcctcttctatggatcagcaatattcaactacatgaagccaaactccaaaataatgaatgaaagggataaagtagtctctgtgttctatgcagtggtgactccaatgttgaaccccataatttatagcctgagaaataaagatgttaaagagggtctcagaaaactagctggaagaaagcccttttctcagagatggtga

SEQ ID NO: 1464 - protein, 314 aa, Canis familiaris
MEEENQTTVAEFIFLGLSQDLQTQILLFVLFLIIYLLTVLGNLLIIILIFMDSRLHTPMYFFLRNLSFADLCFSTSIVPQVLVHFLAKKKMISFLGCMAQIVVSLLIGCTECALLAVMSYDRYVAVCKPLHYSSIMTQKVCLQLAIGSWASGALVSLVDTTFTFQLPYQGQNIINHYFCELPALLKVASADTYSTEMAIFAMGVVILLAPVCLILVSYWNIISTVIPMQSGEGRLKAFSTCGSHLIVVVLFYGSAIFNYMKPNSKIMNERDKVVSVFYAVVTPMLNPIIYSLRNKDVKEGLRKLAGRKPFSQRW

SEQ ID NO: 1465 - DNA, 858 bp, Canis familiaris
atgcctggggaattcctgagcagaaaaatgacatgggaaaactggacagttgacagtgaatttgtttctgtgaacttttcagccttgtcctctgagctccaagctctactctttctccttttttggactatttactggcaccgtagtgggcaatgttcttatcatcctgctctgctctacaaagtcttacctgcttcttccccaggaattttttaccacctggaggtaggttttaacttgattattgtgccctagatgcagcgactctgatcatccaagatacaaccaactccttccatggctatgccactcagtgtatttcttcttctttggggctgctgagtgctgcctcctggccacaatgacatatgaccgctgtgtggccaactgtgaccctttgcgttacccagtcattatgaactgcagagcctgtgcccagctagcaggtacatcttggttctcagagtttcctgtggccctgtgcaaaccacatggattttccacttccctttttgtgaccccaacagagtgaaccactttttctgtgacagcccccctgtcattgcactggtctgtgctgatacctctctgtttgaactggaggctctgacagccactgtcttatttatcctcttccctttcctgctgatcctagggtcctatgtccacatcctctctactatcttcaggatgccctcagctgaggggaaacctaaggccttttccacctattcctcccacctccttgttgtctccctcttctacagcaccgccatcctcacgtacttcaatccaccacctctcctgagatagcctaacactaacacttctccacgtcaccaccaccccattagcctg

SEQ ID NO: 1466 - protein, 84 aa, Canis familiaris
MPGEFLSRKMTWENWTVDSEFVSVNFSALSSELQALLFLLFWTIYWHRSGQCSYHPALLYKVLPASSPGIFYHLEVGFNLIIVP

SEQ ID NO: 1467 - DNA, 948 bp, Canis familiaris
atgagagcagcaaatcagacgcaggtgacagagttcctcctcctgggactctctgatgacccccacactcagaagctcctatttattttattcctgggtgtctacctggttactgtgcttgcaaatctgcttctcatgcgccttgttcaggctgactctcggcttcacacacctatgtattttttcctctgcaacttatctttggctgacctctgtttttctaccaacattgttcctcaggcgctggttcatctgctatccaggaaaaagatcatttcattcacacgttgtgcagctcagcttttactcttcctcatttttgggggtacacagtgtgccttgctggcagtgatgtcctatgatcgatacgtggccatctgcaaccctttgcattaccctagcattatgacttggagggtgtgtgttcagctggctgcgggatcatggaccagcggcattctggtgtctgtggtagataccacttttatactaaggctgccttaccgagagagcaatagtattgctcatttcttttgtgaggcccctgcactcttgatcctggcatccacagacacccacacttcagagatggccattttcctcatgggtgtcataattctcctcatacctgtctccctaattctagtatcctatggccacatcatagtgactgtggtcaggatgaagtcatctgtgaggaggctcaaggcattctctacctgtggttcccacctcatggtggtcatcctcttttatgggtcaggaattgtcacttacatgacaccaaagtcttccaaagaacagaaaaaacttgtgtctgtgttctatgcaatggtgacacccatgctcaatcccctcatctatagcttgaggaacaaggatgtgaagggagctctgaggaaagtggccacaaggaatttcccatgcaggcttgaaatctgccactga

SEQ ID NO: 1468 - protein, 315 aa, Canis familiaris
MRAANQTQVTEFLLLGLSDDPHTQKLLFILFLGVYLVTVLANLLLMRLVQADSRLHTPMYFFLCNLSLADLCFSTNIVPQALVHLLSRKKIISFTRCAAQLLLFLIFGGTQCALLAVMSYDRYVAICNPLHYPSIMTWRVCVQLAAGSWTSGILVSVVDTTFILRLPYRESNSIAHFFCEAPALLILASTDTHTSEMAIFLMGVIILLIPVSLILVSYGHIIVTVVRMKSSVRRLKAFSTCGSHLMVVILFYGSGIVTYMTPKSSKEQKKLVSVFYAMVTPMLNPLIYSLRNKDVKGALRKVATRNFPCRLEICH

SEQ ID NO: 1469 - DNA, 903 bp, Canis familiaris
  modified_base (891)..(891): a, c, t, g, unknown or other
atgggagaggaaaaccaaacctctgtggctgagtttattttcctgggcctttcacaggacttgcagacccagatcctgctgtttgttctttttctcctcatttatcttttgactgtgcttgggaacctgctcatcatcattctcatcttcatggactctcgacttcacactcccatgtacttttttcttagaaacctctctttcgcagatctctgtttctctactagcatcgtccctcaggtgttggtccatttcctggtaaaaaggaaaacgatttctcttcttgggtgtatggcacaaatagttgtcttccttctggctgggtgtacagagtgtgcactgctggcagtgatgtcttatgaccggtacgtggctgtctgcaagcccctgcactactctagcatcatgacccaacaggtgtgtctccagttggccattggatcctgggccagtggagcactcgtgtctctggtggataccacctttacttttcaactaccctatcaaggacagaagattattaatcactacttttgtgaacctcctgccctcctgaagctggcttcagcagatacctacagcacagaaatggccatctttgcaatgggcgtggtcatcctcttagctcctgtctgcctgattctggtctcctactggaatattatctccactgtgatccagatgcagtctggggaggggaggctcaaggctttctctacctgtggctcccatctcattgttgttgtcctgttctatggctcaggcatattcgcctacatgcggccaaactccaagaccacaaaagagcatgataaaatgatctctgtgttctatacagtggtgactccaatgttgaaccccattatttatagcctgagaaataaggatgtngctggtggattg

SEQ ID NO: 1470 - protein, 301 aa, Canis familiaris
MGEENQTSVAEFIFLGLSQDLQTQILLFVLFLLIYLLTVLGNLLIIILIFMDSRLHTPMYFFLRNLSFADLCFSTSIVPQVLVHFLVKRKTISLLGCMAQIVVFLLAGCTECALLAVMSYDRYVAVCKPLHYSSIMTQQVCLQLAIGSWASGALVSLVDTTFTFQLPYQGQKIINHYFCEPPALLKLASADTYSTEMAIFAMGVVILLAPVCLILVSYWNIISTVIQMQSGEGRLKAFSTCGSHLIVVVLFYGSGIFAYMRPNSKTTKEHDKMISVFYTVVTPMLNPIIYSLRNKDVAGGL

SEQ ID NO: 1471 - DNA, 951 bp, Canis familiaris
atggagtactggaactccaccttgggcagtggctttatattgatggggattctgaatgacagtgggtctcctgaactgctctgtgccacaatcactgtcctatacatgttggctctgaccagcaatggcctgctgctcttggtcatcacagtggattcccggctccatgtgcccatgtacttcctgctcggccagctctcactcatggacctcctcttcacatctgttgtcactcccaaggccctcgtggatattctgcagagtgaaaacacgatctcctttggaggctgtgcccttcagatgtttctggcattgacgctgggtggtgcagaggacttgctgctggccttcatggcctatgacagatatgtggccatatgtcatcctctgaactacatggttttcatgaggccaagggtctgctcactcatggtggccacggcctggatcctggcatttctgagtgctctaggccataccttgtataccatgcactaccctttctgtaaagttcggaagatcaggcacctgctctgtgagatccctcctttgctgaagttggcctgtgcagatacctcccgatatgaactcttggtgtatgtgacgggagtgactttccttttgatgcctctttctgccattgttgcctcctatgcactaattctgtgtactgtgcttcacatgccctcaaatgaggggaagcagaaagccctagtcacctgctcctcccacctgacagtcgttgtgatgtactatggagctgccacattcatgtatgtcctgcccagttccctccacaaccccaggcaggacaacatcatctctcttttctctacggttgtcactccagcactgaacccccttatctatagcctgaggaatcaggaggtcatgggggccttgagaagggtcctgggaaaatatatgttgccaacacactgtaccttctaa

SEQ ID NO: 1472 - protein, 316 aa, Canis familiaris
MEYWNSTLGSGFILMGILNDSGSPELLCATITVLYMLALTSNGLLLLVITVDSRLHVPMYFLLGQLSLMDLLFTSVVTPKALVDILQSENTISFGGCALQMFLALTLGGAEDLLLAFMAYDRYVAICHPLNYMVFMRPRVCSLMVATAWILAFLSALGHTLYTMHYPFCKVRKIRHLLCEIPPLLKLACADTSRYELLVYVTGVTFLLMPLSAIVASYALILCTVLHMPSNEGKQKALVTCSSHLTVVVMYYGAATFMYVLPSSLHNPRQDNIISLFSTVVTPALNPLIYSLRNQEVMGALRRVLGKYMLPTHCTF

SEQ ID NO: 1473 - DNA, 951 bp, Canis familiaris
atggagtactggaactccaccttgggcagtggctttatattgatggggattctgaatgacagtgggtctcctgaactgctctgtgccacaatcactgtcctatacatgttggctctgaccagcaatggcctgctgctcttggtcatcacagtggattcccggctccatgtgcccatgtacttcctgctcggccagctctcactcatggacctcctcttcccatctgttttcactcccaagaccctcatggattttctgcagagtgaaaacatgatatcctttggaggctgtgcccttcagatgtttctggtattgacactgggtggtacagaggacttgctgctggccttcatggcctatgacagatatgtagccatatgtcatcctctgaactacatggttttcatgaggccaagggtctgctggctcatggtggccacggcctggatcctggcatttctgagtgctctaggccataccttgtataccatgcactaccctttctgtaaagttcggaagatcaggcacctgctctgtgagatccctcctttgctgaagttggcctgtgcagatacctcccgatatgaactcttggtgtatgtgacgggagtgactttccttttgatgcctctttctgccattgttgcctcctatgcactaattctgtgtactgtgcttcacatgccctctaatgaagggaagcagaaagccctagtcacctgctcctcccacctgacagtcgttgtgatgtactatggagctgccacattcatgtatgtcctgcccagttccctccacagccccaggcaggacaacatcatctctcttttctacacggttgtcactccagcactgaacccccttatctatagcctgaggaatcaggaggtcatgggagccttgagaagggtcctgggaaaatatatgttgccaacacactgtaccttctaa

SEQ ID NO: 1474 - protein, 316 aa, Canis familiaris
MEYWNSTLGSGFILMGILNDSGSPELLCATITVLYMLALTSNGLLLLVITVDSRLHVPMYFLLGQLSLMDLLFPSVFTPKTLMDFLQSENMISFGGCALQMFLVLTLGGTEDLLLAFMAYDRYVAICHPLNYMVFMRPRVCWLMVATAWILAFLSALGHTLYTMHYPFCKVRKIRHLLCEIPPLLKLACADTSRYELLVYVTGVTFLLMPLSAIVASYALILCTVLHMPSNEGKQKALVTCSSHLTVVVMYYGAATFMYVLPSSLHSPRQDNIISLFYTVVTPALNPLIYSLRNQEVMGALRRVLGKYMLPTHCTF

SEQ ID NO: 1475 - DNA, 951 bp, Canis familiaris
atggagtactggaactccaccttgggcagtggctttatattgatggggattctgaatgacagtgggtctcctgaactgctctgtgccacaatcactgtcctatacatgttggctctgaccagcaatggcctgctgctcttggtcatcacagtggattcctggctccatgtgcccatgtacttcctgctcggccagctctcactcatggacctcctcttcacatctgttgtcactcccaaggccctcgtggattttctgcagagtgaatacacgatctcctttggaggctgtgcccttcagatgtttctggcattggcgctgggtagtgcagaggacttgctgctggccttcatggcctatgacagatacgtggccatatgtcatcctctgaactacatggttttcatgaggccaagggtctgctggctcatggtggccacggcctggatcctggcatttctgaatgctctaggccataccttgtataccatgcactaccctttctgtaaagttcggaagatcaggcacctgctctgtgagattcctcctttgctgaagttggcctgtgcagatacctcccgatatgaactcttggtgtatgtgacaggagtgactttccttttgatgcctctttctgccattgttgcctcctatgtactaatcctgtgtactgtgcttcacatgccctcaaatgaggggaagcagaaagccctagtcacctgctcctcccatctgacagtggttgtgatgtactatggagctgccacgttcatgtatgtcctgcccagttccctccacagccccaggcaggacaacatcatctctcttttctacacggttgtcactccagcactgaacccccttatctatagcctgaggaatcaggaggtcatgggggccttgagaagggtcctgggaaaatatatgttgccaacacactgtaccttctaa

SEQ ID NO: 1476 - protein, 316 aa, Canis familiaris
MEYWNSTLGSGFILMGILNDSGSPELLCATITVLYMLALTSNGLLLLVITVDSWLHVPMYFLLGQLSLMDLLFTSVVTPKALVDFLQSEYTISFGGCALQMFLALALGSAEDLLLAFMAYDRYVAICHPLNYMVFMRPRVCWLMVATAWILAFLNALGHTLYTMHYPFCKVRKIRHLLCEIPPLLKLACADTSRYELLVYVTGVTFLLMPLSAIVASYVLILCTVLHMPSNEGKQKALVTCSSHLTVVVMYYGAATFMYVLPSSLHSPRQDNIISLFYTVVTPALNPLIYSLRNQEVMGALRRVLGKYMLPTHCTF

SEQ ID NO: 1477 - DNA, 933 bp, Canis familiaris
atggagtactggaactccaccttgggcagtggctttatattgatggggattctgaatgacagtgggtctcctgaactgctctgtgccacaatcactgtcctatacatgttggctctgaccagcaatggcctgctgctcttggtcatcacagtggattcccggctccatgtgcccatgtacttcctgctcggccagctctcactcatggacctcctcttcacatctgttgtcactcccaaggccctcgtggattttctgcagagtgaatacacgatctcctttggaggctgtgcccttcagatgtttctggcattgacgctgggtagtgcagaggacttgctgctggccttcatggcctatgacagatacgtggccatatgtcatcctctgaactacatggtcttcatgaggccaagggtctgctggctcatggtggccacggcctggatcctggcatccctaagtgcctttgtttataccacatataccatgcactaccctttctgtaaagttcggaagatcaggcacctgctctgtgagatcccacctttactgaagttggcctgtgcagatacctcccgatatgaactcttggtgtatgtgatgggtgtgaccttccttatgccccctctctttactatcatttcttcatatacactaattctgtgtactgtgcttcacatgccctcaaatgaagggaagcagaaagccctagtcacctgctcctcccacctgacagtcgttgggatgttctatggagctgccacgttcatgtatgtcctgcccagttccctccacaaccccaggcaggacaacatcatctctcttttctacacggttgtcactccagcgttgaacccccttatctatagcctgcgaaataaggaggtcatgggagctttgaagagagtcctggcaaaatacatggcctga

SEQ ID NO: 1478 - protein, 310 aa, Canis familiaris
MEYWNSTLGSGFILMGILNDSGSPELLCATITVLYMLALTSNGLLLLVITVDSRLHVPMYFLLGQLSLMDLLFTSVVTPKALVDFLQSEYTISFGGCALQMFLALTLGSAEDLLLAFMAYDRYVAICHPLNYMVFMRPRVCWLMVATAWILASLSAFVYTTYTMHYPFCKVRKIRHLLCEIPPLLKLACADTSRYELLVYVMGVTFLMPPLFTIISSYTLILCTVLHMPSNEGKQKALVTCSSHLTVVGMFYGAATFMYVLPSSLHNPRQDNIISLFYTVVTPALNPLIYSLRNKEVMGALKRVLAKYMA

SEQ ID NO: 1479 - DNA, 933 bp, Canis familiaris
atgggagaagaaaaccaaacctatgtgactgaatttgtcttcctgggcctctcacaggatccagagacacaagtcctgctctttttcctttttcagataatctacctgctgactgtactgggaaatctgcttatcattgtgcttgttcatgtagactctagacttcacacaccaatgtactttttccttggaaacttgtcctttgctgatctctgtttttctaccaccacggtgccccaggtgctggtccacttcttggtaaagagtaaaaccatttcttttgctggatgctcaacacagatatttgttttacttcttgttgggtgtacagagtgtgcactgctggcagtgatgtcctatgaccgatatgtggctgtctgcaagcccctgcactactccaccatcatgacacattggttatgtgtccagctggccatagggtcctgggttagtggaacatttgtgtcactggtggacaccacattcacactgcgcctgccctacagagggaacaatatcattaaccattttttttgtgaacctcctgccctcctgaagctggcttcagcagatacctacagcacagaaatggccatctttgcaatgggtgtggtcatcctcttagctcctgtctgcctgattctggtctcctactggaatattatctccactgtgattcagatgcagtctggggaggggagactcaaggctttctctacctgtggtacccatctcattgttgttgtcctcttctatgggtcagcaatatttgcctacatgagaccaaactccaagataatgaatgaaagggataaaatgatctctgtgttctactcagcagtgacacccatgttgaaccccatcatttatagtctgagaaacaaggatgtcaaaggtgctctcaggagagtgactgcaaaattgtctttttga

SEQ ID NO: 1480 - protein, 310 aa, Canis familiaris
MGEENQTYVTEFVFLGLSQDPETQVLLFFLFQIIYLLTVLGNLLIIVLVHVDSRLHTPMYFFLGNLSFADLCFSTTTVPQVLVHFLVKSKTISFAGCSTQIFVLLLVGCTECALLAVMSYDRYVAVCKPLHYSTIMTHWLCVQLAIGSWVSGTFVSLVDTTFTLRLPYRGNNIINHFFCEPPALLKLASADTYSTEMAIFAMGVVILLAPVCLILVSYWNIISTVIQMQSGEGRLKAFSTCGTHLIVVVLFYGSAIFAYMRPNSKIMNERDKMISVFYSAVTPMLNPIIYSLRNKDVKGALRRVTAKLSF

SEQ ID NO: 1481 - DNA, 924 bp, Canis familiaris
atgggcacagaaaaccgaacttatctgactgaatttattttgctgggcctttcttcagattggcagatccagatcctactgtttgtggtgtttctcatcatctacctactaactctgtttgggaatcttatcatcatagtgctaattcatattgactctcgacttcatacaccaatgtacttcttccttaaaaacctgtcatttactgatctctgcttctctacaacgatcatcccccagatgttattccatttgctggtaataagaaagaccatttcctttgctggatgttcaattcagatgatttttttcctagtagctgggtgtacagaaagttccctcctagcagtgatgtcctatgatcgctatgtggctgtctgcaagccccttcactactccaccctcatgacccagaaggtgtgtgtacagctgaccatagggtcctgggccactggaatatttgtgtctctagtagacacatcatttactttatgtctctcataccatgggcagaacataattaatcattatttttgtgaacctcctgcactcttgaagttggcttcagaagaaacctacagagctgagatggccatctttgccatgggtgtagtaattctccttggtcctgtctccctcatccttttctcctattggaatattatctctactgtgattcagatacagtcaggtgaggggaggctcaaggtcttttctacctgtggttctcatctcatcgttgttgtcttcttctatggctcaacaatatttacctacatgcgtccaaattccaagaaaataaatgaaggggataaggtgatctctgtgttctattcagtcataacatccatgatgaacccattcatttatagcctgagaaacaaggatgtgaagaaggcatttaggaaagtatttggaagatag

SEQ ID NO: 1482 - protein, 307 aa, Canis familiaris
MGTENRTYLTEFILLGLSSDWQIQILLFVVFLIIYLLTLFGNLIIIVLIHIDSRLHTPMYFFLKNLSFTDLCFSTTIIPQMLFHLLVIRKTISFAGCSIQMIFFLVAGCTESSLLAVMSYDRYVAVCKPLHYSTLMTQKVCVQLTIGSWATGIFVSLVDTSFTLCLSYHGQNIINHYFCEPPALLKLASEETYRAEMAIFAMGVVILLGPVSLILFSYWNIISTVIQIQSGEGRLKVFSTCGSHLIVVVFFYGSTIFTYMRPNSKKINEGDKVISVFYSVITSMMNPFIYSLRNKDVKKAFRKVFGR

SEQ ID NO: 1483 - DNA, 234 bp, Canis familiaris
atggagctctggaactccaatttgggaaatggcttcatcttggtggggattctgaatgataatggagctcctaaacttctctatgccacaattgctgtcctgtacatgttggccgtaaccagtagtggccttctgctcttggtcattataatggatgcttggctctatgtacccatatacctcctgctcagccagctatctctcatggacttaatgtttgcatctgttgcatct

SEQ ID NO: 1484 - protein, 78 aa, Canis familiaris
MELWNSNLGNGFILVGILNDNGAPKLLYATIAVLYMLAVTSSGLLLLVIIMDAWLYVPIYLLLSQLSLMDLMFASVAS

SEQ ID NO: 1485 - DNA, 939 bp, Canis familiaris
atggagactgaaaaccatacaatggtgacagagttcattattttggggttaacagaggatcctacactttgtaccatcttctttgtggtttttctaggaatctatgtcgctaccctactgggcaatgtcagcataatcatgctgatccacagaagtcctcagcttcacaccccaatgtatcttttcctcagccatttagcctttgtggatatcgggtattccacgtcagtcacacccattatgattgtgggtttcttaagagagagaactactatccctgttgctggctgcatagctcagcttggctctgatgttatctttggaacagctgagtgcttcctgctggccgccatggcctatgatcgctatgtggccatctgctctccacttctctactctacacacatgtcttccagagtctgcatcatcctcttggctgcttcctatctggggggatgtgtgaatgcttcatcatttactggctgtctactgagcttgactttctgtggaccaaataaaatcaatcatttcttttgtgacttcccaccactagtaaagctttcttgtacccatatttatgttgctgaaacatcacctgctatcctagccgggtccatcattgtaatcacactgtttatcatagctatttcatatctatacatcctgcattcagtcctaaatatgcgctcccctgaaggaagacacaaggccttctccacttgtacttctcacctcagtgcagtcactttgttttatgggacagtcacatttgtttatgtcatacccaagtcagattactcgtctgatcatattaaagtggtgtctgtgttctacacagtggtgatccccatgttgaaccccttgatctatagtctgagaaacaaagaggttaaagaggccacgagaaaattgatggctagaagacattggttattttga

SEQ ID NO: 1486 - protein, 312 aa, Canis familiaris
METENHTMVTEFIILGLTEDPTLCTIFFVVFLGIYVATLLGNVSIIMLIHRSPQLHTPMYLFLSHLAFVDIGYSTSVTPIMIVGFLRERTTIPVAGCIAQLGSDVIFGTAECFLLAAMAYDRYVAICSPLLYSTHMSSRVCIILLAASYLGGCVNASSFTGCLLSLTFCGPNKINHFFCDFPPLVKLSCTHIYVAETSPAILAGSIIVITLFIIAISYLYILHSVLNMRSPEGRHKAFSTCTSHLSAVTLFYGTVTFVYVIPKSDYSSDHIKVVSVFYTVVIPMLNPLIYSLRNKEVKEATRKLMARRHWLF

SEQ ID NO: 1487 - DNA, 939 bp, Canis familiaris
atggagaatgaaaatcatacaacagtgacagagttcattattctgggattaacagataatcccacactatgtgccatcttctttgtgattttcctgggagtttatataattaccatagtgggaaatatcagtataatcatcctaatccgaagcagcccacagcttcacaccccgatgtacctttttctcagccatttggcctttgtagacattgggtattccacctcagtgactccgatcatgctaatgagtttcttaagagagaaaacgactatccctgtcactggctgtatagcccagcttggctctgatgtcacttttgggactacagagtgcttcctgctggccaccatggcctatgatcgctatgtggccatctgctctcccttgctctactccacccagatgtccccagtggtctgcttcctcctattgggggcttcctacctgggtggatgcatgaacgcttcatcatttactggctgtttgatgaatctaaccttctgtggaccaaacaaaatcaaccatttcttctgtgacctctttccactcttgaagctttcttgtggccatgtttatattgccgaaatatcgcccgccatctcttccgcatccgtcctcataagcacactgtttaccataattgtgtcctatacctacattctccactcaatcctgaatatgcgctctactgaggggagaaagaaggccttctcaacctgcacctcccacctcaccgcagtcactttgttttatgggacagttttgttcgtttatgtgatgcccaagtcaacttattcagctgatcaggtcaaagtggcatctgtgatctatacagtggtagtccccatgttgaaccccctcatctatagcctgagaaacaaggaggtaaaaggagccatgcgaaaactaatggctaaaatgcattggttctcctga

SEQ ID NO: 1488 - protein, 312 aa, Canis familiaris
MENENHTTVTEFIILGLTDNPTLCAIFFVIFLGVYIITIVGNISIIILIRSSPQLHTPMYLFLSHLAFVDIGYSTSVTPIMLMSFLREKTTIPVTGCIAQLGSDVTFGTTECFLLATMAYDRYVAICSPLLYSTQMSPVVCFLLLGASYLGGCMNASSFTGCLMNLTFCGPNKINHFFCDLFPLLKLSCGHVYIAEISPAISSASVLISTLFTIIVSYTYILHSILNMRSTEGRKKAFSTCTSHLTAVTLFYGTVLFVYVMPKSTYSADQVKVASVIYTVVVPMLNPLIYSLRNKEVKGAMRKLMAKMHWFS

SEQ ID NO: 1489 - DNA, 969 bp, Canis familiaris
atgatgggcaatcataccacagtgagcacattccttctgtgggggttttctagtttcccagacttgcagactctcctctttgtgatgattttcttctcccatgtgaccatcctagccgcaaatgtgtccgtaatggtggccatcaggctcagtcacaaccttcacacccctatgtactttttcctctgcggcctgtccttttcagaaacgtgtaccacgatggcaatcataccccgcatgttagtggacttgctagcagactgcaagaccatttctcttcctgagtgtgccacacagatgtttttcttctttggcttgggagccaataactgcttcatcatggctgccatgtcctatgaccgttatattgccattcacaacccgctgcactaccccatcttgatgacccataagatctgctttcagctcctcatggcctcttggatggctgggttcctggtttctctgtgcatcgtcatcattgtattcaacttgtctttctgtgactccaacatcatccagcacttcttctgtgatatctcacctgtggtctgccttgcctgtgattacaccttttttcaaaaaatggttctttttgcattcactgcctttgtgttggtgggcagctttgtctttattatgatgtcctatgtcttcattgcatccactgttgcgaagatgccctctgccaaggggaggtataaggccttttccacttgctcctcccacctcactgtggtgtgcatacactatggatttgctggctttgtctacttgaggcccaaggacagggacttgttccgtgaggacatgttgatggctgtcacatatacggtgctgacccctctgcttaacccgattgtttatagtctcagaaacaaagaaatgcagactgccctaaggaaggttctaggcaagacagataggttcatccctcagatggtgaataaacgaacaccggacagttaa

SEQ ID NO: 1490 - protein, 322 aa, Canis familiaris
MMGNHTTVSTFLLWGFSSFPDLQTLLFVMIFFSHVTILAANVSVMVAIRLSHNLHTPMYFFLCGLSFSETCTTMAIIPRMLVDLLADCKTISLPECATQMFFFFGLGANNCFIMAAMSYDRYIAIHNPLHYPILMTHKICFQLLMASWMAGFLVSLCIVIIVFNLSFCDSNIIQHFFCDISPVVCLACDYTFFQKMVLFAFTAFVLVGSFVFIMMSYVFIASTVAKMPSAKGRYKAFSTCSSHLTVVCIHYGFAGFVYLRPKDRDLFREDMLMAVTYTVLTPLLNPIVYSLRNKEMQTALRKVLGKTDRFIPQMVNKRTPDS

SEQ ID NO: 1491 - DNA, 966 bp, Canis familiaris
atgggcaatcataccacagtgagcacattccttctgtgggggttttccagtttcccagacttgcagactctcctctttgtgatgattttcttctcccatgtgaccatcctagccgcaaatgtgtccgtaatggtggccatcaggctcagtcacaaccttcacacccctatgtactttttcctctgcggcctgtccttttcagaaacgtgtaccacgatggcaatcataccccgcatgttagtggacttgctagcagactgcaagaccatttctcttcctgagtgtgccacacagatgtttttcttctttggcttagcagccaataattgcttcatcatggctgccatgtcctatgaccgttatattgccattcacaacccgctgcactaccccatcttgatgacccataagatctgctttcagctcctcatggcctcttggatggctgggttcctggtttctctgtgcatcgtcatcattgtattcaacttgtctttctgtgactccaacatcatccagcacttcttctgtgatatctcacctgtggtctgccttgcctgtgattacacctcccatcaagaaatggctatttttgtgctctctgcctttgtgttggtgggcagctttgtcttcattatgatgtcctatgtcttcattgtgtccaccgttgtgaagatgccctctgccaaggggaggtataaggccttttccacttgctcctcccacctcactgtggtgtgcatacactatggatttgctggctttgtctacttgaggcccaaggacagggactcgttccgtgaggacatgctgatggctgtcacatatacggtgctgacccctctgcttaacccgattgtttatagtctcagaaacaaagaaatgcagactgccctaaggaaggtgctaggcaggacagataggttcatccctcagatggtgaataaacgaacaccgcacagttaa

SEQ ID NO: 1492 - protein, 321 aa, Canis familiaris
MGNHTTVSTFLLWGFSSFPDLQTLLFVMIFFSHVTILAANVSVMVAIRLSHNLHTPMYFFLCGLSFSETCTTMAIIPRMLVDLLADCKTISLPECATQMFFFFGLAANNCFIMAAMSYDRYIAIHNPLHYPILMTHKICFQLLMASWMAGFLVSLCIVIIVFNLSFCDSNIIQHFFCDISPVVCLACDYTSHQEMAIFVLSAFVLVGSFVFIMMSYVFIVSTVVKMPSAKGRYKAFSTCSSHLTVVCIHYGFAGFVYLRPKDRDSFREDMLMAVTYTVLTPLLNPIVYSLRNKEMQTALRKVLGRTDRFIPQMVNKRTPHS

SEQ ID NO: 1493 - DNA, 945 bp, Canis familiaris
atggattccctggtggatgggaaccacactgcagtgacagggttcattttattgggcctaactgaggaccctgtccttcgagtcatcctcttcatgaccatcctctgcatctacctggtgaccgtatctggcaaccttagcacgatcattctgatcaggttctcctctcagctccaccaccccatgtatttttttctgagccacttggccttggctgacctaggctattcctcttctgtcacacccaacatgcttataaacttcctggtggagagaaatatgatctcctatcttggatgtgctatccagctgggttcagttgttttctttgggtcaagtgagtgcttccttctggctgcaatggcatatgatcgcttcatggccatctgcaacccactgctttattcaaccaaaatgtgcacacaggtttatgttcgcctactcacagtgacttacctaggtggttttctcaatgcttgctctttcactatttccttctcttttttacttttctgtggaccaaatcaagtcaatcattttttctgtgattttgctcctttagttaaactctcctgctctgatagtagaatccctgcggttgtcccctcatttacagctggctccatcattgtggtcacgatgtgtgtcatagtcatctcctatatctgtatcctcatcaccatcctgaagatgagctccactgagggacgccacaaggccttctccacctgcacatcccacctcacagtggtgactctgttctttgggaccattacattcatttatgtgatgcccaagtcctgctactcgactgaccagaacaaggtggtgtctttgttctacatggtggtggtccccatgttgaaccccctcatctatagcctcaggaacaatgagatgaagggggctctgaagagagagcttggcagaaaaatatttccttag

SEQ ID NO: 1494 - protein, 314 aa, Canis familiaris
MDSLVDGNHTAVTGFILLGLTEDPVLRVILFMTILCIYLVTVSGNLSTIILIRFSSQLHHPMYFFLSHLALADLGYSSSVTPNMLINFLVERNMISYLGCAIQLGSVVFFGSSECFLLAAMAYDRFMAICNPLLYSTKMCTQVYVRLLTVTYLGGFLNACSFTISFSFLLFCGPNQVNHFFCDFAPLVKLSCSDSRIPAVVPSFTAGSIIVVTMCVIVISYICILITILKMSSTEGRHKAFSTCTSHLTVVTLFFGTITFIYVMPKSCYSTDQNKVVSLFYMVVVPMLNPLIYSLRNNEMKGALKRELGRKIFP

SEQ ID NO: 1495 - DNA, 951 bp, Canis familiaris
atgagagagaacaaaatggcaagaggcaaccgtaccacagtgacagaatttgtccttatgggattcacagaccgcccagagctccagcttcccctctttgtggtgttcctggcaatgtatctcatcaccttggtggggaacctgggcatgattcttctcatcaaggtggattggaggctccatacccccatgtactatttcctcagccacctggcattcatcgatatctgttactcatctaccattgggcccaagatgctacaaaacttattggtgaagaaaaaaaccatctccttctcaggctgctttgcccagctgtacttctccagtgctttggccactactgaatgcttcctcttggccacaatggcctatgaccgctacatggctatctgcaacccgctgatttacacagccattatgactcagcgggtctgcaaggagttggtggtaggggtctacacctacggcttcttaaactctgtaatacaaacagttctgacattccagttgtctttctgcgactccaacatcatccaccacttctactgtgctgaccctcctctccttgccctctcctgctctgacaccggcaacaaagaaaagcagctcttgatcttctctgcagtgaatctcactggatccctcctgactgtcctcatctcctacatttgcatcctctttgccattataaaaatccagtcttccgaaggcaaatgtaaagccttttccacctgtgcctctcacctcactgtggtcatcatcttctatggaacgttgtttttcatgtatctacagcaacctaaagcaggggattcgtggaagtacaacaaagtggtctctgtgttttatagtcttgtaattcccctgctcaaccccctgatctataccctgaggaacacagaagtaaaggacaccctgaaaaagatgctacacggcagagggccatag

SEQ ID NO: 1496 - protein, 316 aa, Canis familiaris
MRENKMARGNRTTVTEFVLMGFTDRPELQLPLFVVFLAMYLITLVGNLGMILLIKVDWRLHTPMYYFLSHLAFIDICYSSTIGPKMLQNLLVKKKTISFSGCFAQLYFSSALATTECFLLATMAYDRYMAICNPLIYTAIMTQRVCKELVVGVYTYGFLNSVIQTVLTFQLSFCDSNIIHHFYCADPPLLALSCSDTGNKEKQLLIFSAVNLTGSLLTVLISYICILFAIIKIQSSEGKCKAFSTCASHLTVVIIFYGTLFFMYLQQPKAGDSWKYNKVVSVFYSLVIPLLNPLIYTLRNTEVKDTLKKMLHGRGP

SEQ ID NO: 1497 - DNA, 945 bp, Canis familiaris
atgaaaaggcaaaatcaaagctctgtggttgaattcatcctcttgggcttttccaactttcctgaactccaagagcagctctttggggttttcctggctgtttacctggtgactctgatgggaaatgccatcattatagtcatcatcaccttggaacagacgctccacgtgcccatgtatctgttcctccagaacctgtctgtggtggacatgagtttcagcgcagtcattatgcctgaaatgctggtggtcctcaccagggagaaaacgtccatttcatttgtgagctattttgcacagatgtatttcatccttttctttggtggcactgaatgttttctcctgggggcgatggcttatgaccgatttgctgcaatctgtcaccctctgagctacccaatgataatgaacaaaagggttttcatgaaattacttataacatcatgggccttaggcttcatgttaggtactgtgcaaacatcatgggtttccagttttcccttttgtggccccaatgaaatcaatcatatctcttgtgaaaccccagcagtgctagaacttgcatgtgcagacacgtttctgtttgaaatctatgcattcactggcaccattttgattatcatggttcctttcgtgttgatactcttgtcatacatttggattctctttgccatcctgaggatgccatcagctactgggaggcaaaaggccttttccacttgtgcctcccatctcacgtctgtgaccctcttctatggcacagccagtatgacttatttacaacccaaatctggctactcccctgaaaccaagaagctgatgtcattgtcttactcacttcttacacctctgctgaatccactgatctatagcttcagaaatagtgagatgaaaagagctttgatgaaactatggcgaagaagagtggatttacacacattctga

SEQ ID NO: 1498 - protein, 314 aa, Canis familiaris
MKRQNQSSVVEFILLGFSNFPELQEQLFGVFLAVYLVTLMGNAIIIVIITLEQTLHVPMYLFLQNLSVVDMSFSAVIMPEMLVVLTREKTSISFVSYFAQMYFILFFGGTECFLLGAMAYDRFAAICHPLSYPMIMNKRVFMKLLITSWALGFMLGTVQTSWVSSFPFCGPNEINHISCETPAVLELACADTFLFEIYAFTGTILIIMVPFVLILLSYIWILFAILRMPSATGRQKAFSTCASHLTSVTLFYGTASMTYLQPKSGYSPETKKLMSLSYSLLTPLLNPLIYSFRNSEMKRALMKLWRRRVDLHTF

SEQ ID NO: 1499 - DNA, 945 bp, Canis familiaris
atgaaaaggcaaaatcaaagctctgtggttgaattcatcctcttgggcttttccaactttcctgaactccaagagcagctctttggggttttcctggctgtttacctggtgactctgatgggaaatgccatcattatagtcatcatcaccttggaacagaccctccacgtgcccatgtatctgttcctccagaacctgtctgtggtggacgtgagtttcagcgcagtcattatgcctgaaatgctggtggtcctcaccagggagaaaacgtccatttcatttatgagctgttttgcacagatgtatttcatccttttctttggtggcactgaatgttttctcctggggacgatggcttatgaccgatttgctgcaatctgtcaccctctgagctacccaatgattatgaacaaaagagttttcatgaaattagtaatgttctcatgggtctcagggatcatggtggctactgtgcagaccacatgggttttcagttttcctttttgtggccccaatgtaatcaatcatctcttttgtgagactcccccagtgctagaacttgcatgtgcagacacgtttctgtttgaaatctatgcattcactggcaccattttgattgtcatggttcctttcgtgttgatactcttgtcatacattcggattctctttgccatcctgaggatgccatcagccacggggaggcaaaaggccttttccacttgtgcctcccatctcacttctgtgaccctcttctatggcacagccagtatgacttatttacaacccaaatctggctactcccctgaaaccaagaagctgatgtcattgtcttactcacttcttacacctctgctgaatccactgatctacagcttcagaaatagtgagatgaaaagagctttgatgaaactatggcgaagaagagtggatatacatgcattctga

SEQ ID NO: 1500 - protein, 314 aa, Canis familiaris
MKRQNQSSVVEFILLGFSNFPELQEQLFGVFLAVYLVTLMGNAIIIVIITLEQTLHVPMYLFLQNLSVVDVSFSAVIMPEMLVVLTREKTSISFMSCFAQMYFILFFGGTECFLLGTMAYDRFAAICHPLSYPMIMNKRVFMKLVMFSWVSGIMVATVQTTWVFSFPFCGPNVINHLFCETPPVLELACADTFLFEIYAFTGTILIVMVPFVLILLSYIRILFAILRMPSATGRQKAFSTCASHLTSVTLFYGTASMTYLQPKSGYSPETKKLMSLSYSLLTPLLNPLIYSFRNSEMKRALMKLWRRRVDIHAF

SEQ ID NO: 1501 - DNA, 945 bp, Canis familiaris
atgaaaaggcaaaatcaaagctctgtggttgaattcatcctcttgggcttttctaactttcctgaactccaagagcagctccttggggttttcctggctgtttacctggtgactctgatgggaaatgccatcattatagtcatcatcgccttggaacagaccctccacgtgcccatgtatctgttcctccagaacctgtctgtggtggacatgagtttcagcgcagtcattatgcctgaaatgctggtggtcctcaccagggagaaaacgtccatttcatttgtgagctgttttgcacagatgtatttcatccttttctttggtggcactgaatgttttctcctggggacgatggcttatgaccgatttgttgcaatctgtcaccctctgagctacccaatgattatgaacaaaagggttttcatgaaattagtaatgttctcatgggtctcagggatcatggtggctactgtgcagaccacatgggttttcagttttcctttttgtggtcccaacgaaatcaatcatctcttctgtgagactcccccagtgctagaacttgcatgtgcagacacgtttctgtttgaaatctatgcattcactggtaccattttgattgtcatggttccttttgtgttgatactcctgtcttatattcggattctctttgccatcctgaggatgccatcagccactgggaggcaaaaggccttttccacttgtgcctcccatctcacgtctgtgaccctcttctatggcacagccagtatgacttatttacaacccaaatctggctactccccagaaactaagaaactcatgtcattggcttacacatcacttacacctctgctgaatccactgatctacagtttgagaaacagtgagatgaaaaaagctttgatgaaactatggcgaagaagagtggattcacacacattctga

SEQ ID NO: 1502 - protein, 314 aa, Canis familiaris
MKRQNQSSVVEFILLGFSNFPELQEQLLGVFLAVYLVTLMGNAIIIVIIALEQTLHVPMYLFLQNLSVVDMSFSAVIMPEMLVVLTREKTSISFVSCFAQMYFILFFGGTECFLLGTMAYDRFVAICHPLSYPMIMNKRVFMKLVMFSWVSGIMVATVQTTWVFSFPFCGPNEINHLFCETPPVLELACADTFLFEIYAFTGTILIVMVPFVLILLSYIRILFAILRMPSATGRQKAFSTCASHLTSVTLFYGTASMTYLQPKSGYSPETKKLMSLAYTSLTPLLNPLIYSLRNSEMKKALMKLWRRRVDSHTF

SEQ ID NO: 1503 - DNA, 576 bp, Canis familiaris
ataaaaaatgaaaattaaactttgatatctgactatattctcttaggagtgttacccagaatggaaaatatcttttccgtctctataattctccttacatatacaatatggcccccacagggacgtttatcctgattttcttaatttggaaagattcctggcttcacaaatctatatacttcttgtttagctctcattgatttagctctgatagccacttctgtttctaaaatgggtattgactttttctttggaagaagaaacgtatcacacgctgggtgcaaagttcacatctttttctggacctcgtgatgtcccggtgtgtccttctcactcacgaggcttacagtgatgtacatagtgtggctatttgcttcagggcacccacccttggtgaggtatcagatcttccaacaactggcagtaggggcttggtttggaggatcactgtcttccttggcccataccgtctacattttgcatttccccatctgtaaagctaaggaaattaacctcttcctgtgtgaggtccaagttcttctaaagttctcctatgagaaccttaatatatataag

SEQ ID NO: 1504 - protein, 75 aa, Canis familiaris
MYIVWLFASGHPPLVRYQIFQQLAVGAWFGGSLSSLAHTVYILHFPICKAKEINLFLCEVQVLLKFSYENLNIYK

SEQ ID NO: 1505 - DNA, 576 bp, Canis familiaris
ttaaagaaaattatatttgttctagtttccaacatctacatcatttctgtggtaggaaatgtgctcattgtggccaccatcactgccagcccgtcatggaggcctcccatgtaccttttcctggcctatctcttctttactgatggttgctgttcttctataaatattcctaaactgattatagatttactctatgaaagaccatcctattgaatgagtatatgacctgaatctttggagaacatttctttggagctgctgacaccatcctacctagtgtgatggcctctgttatgtggccatctgcaagccgttgcgttatacaaccatcatgcactggcggatgtgtggcctgctagttggagtggtgtgggtgggaggctttcttcatgcaaccacatagatcctcttcagttctggttatccttctataaccctaacatcacagatcactctatgtgtaatttgaaccctttgctcaatcttgcccgcacagatacccaactctttgttgcagccaacagtggattgatctatgtgctaaacttccttttcttttaaaaagatttcattatt

SEQ ID NO: 1506 - protein, 70 aa, Canis familiaris
LKKIIFVLVSNIYIISVVGNVLIVATITASPSWRPPMYLFLAYLFFTDGCCSSINIPKLIIDLLYERPSY

SEQ ID NO: 1507 - DNA, 354 bp, Canis familiaris
ctcatctcaatgttaatttccttaatttgattattatggtattgtggttatctaagagaatgcctttattttaggaaattgactgaagtatttaagatgtctgtaacttgctctcacttgttacagaaaaacataatacgttgtggggtgtctgtgacactcttctatggcacagccagtatgacctatttacaacccaaatctggctattccccagaaactaagaaactcatatcattggcttacacatcacttacacctctgctgaatctactgatctacagtttgagaaacagtgagatgaaaaaaactttgatgaaactatggcaaagaaaagtggattcacacacattc

SEQ ID NO: 1508 - protein, 86 aa, Canis familiaris
MSVTCSHLLQKNIIRCGVSVTLFYGTASMTYLQPKSGYSPETKKLISLAYTSLTPLLNLLIYSLRNSEMKKTLMKLWQRKVDSHTF

SEQ ID NO: 1509 - DNA, 939 bp, Canis familiaris
atgcggggacggaacgccaccaaggtcagcgtcttcgtcctgctgggcttccccacggcccctcagctgcagtacgtgctcttcctcgtcttcctgctcacctacctcttcatcctggtggagaacctggtcatcatcgtcaccgtccgccgcagcgcccccctccacaggcccatgtactacttcctgggcgccctgtctgtcctggaggtctggtacgtgtctgacatcgtccccaagatgctgggggggctcctcctgcagcagaaactcatctcctttgccggctgcatgacccagctctacttcttcagctccctggtgtgcaccgaatgcgtgctcctggcctccatggcctacgaccgctacgtggccatctgccaccccttgcgctaccaagtcatcatgaccacggggctctgcgtccggctggtggccttctccttcgtcagcggcttctccatctctgtgatcaaggtgtgctttatctccagggccacgttttgtggctccaacgtcctgaaccacttcttctgtgacatttcccccatcctcaagctggcctgcaccgacttctcgaccgcggagctggtggacttcatcctggccttcatcatcctggtgtcgcccctggtggccaccgtgctgtcttacgggcacatcaccctggccgtcctgcgcatcccctcggccacgggccgctggagggccttctccacctgcgcctcccacctcaccgtggtcaccatcttctacacggccatgatcttcatgtacgtccggccccaggccatcgattcccggagctccaacaagctcatctctgcggtgtacactgtcctcaccccgataatcaaccccttgatctactgcctgaggaacaaagaatttaaggctgccttgaaaaaggctctgggctttggtccatcttcacggtag

SEQ ID NO: 1510 - protein, 312 aa, Canis familiaris
MRGRNATKVSVFVLLGFPTAPQLQYVLFLVFLLTYLFILVENLVIIVTVRRSAPLHRPMYYFLGALSVLEVWYVSDIVPKMLGGLLLQQKLISFAGCMTQLYFFSSLVCTECVLLASMAYDRYVAICHPLRYQVIMTTGLCVRLVAFSFVSGFSISVIKVCFISRATFCGSNVLNHFFCDISPILKLACTDFSTAELVDFILAFIILVSPLVATVLSYGHITLAVLRIPSATGRWRAFSTCASHLTVVTIFYTAMIFMYVRPQAIDSRSSNKLISAVYTVLTPIINPLIYCLRNKEFKAALKKALGFGPSSR

SEQ ID NO: 1511 - DNA, 951 bp, Canis familiaris
atgccacctcacagtaatggaaacctctccatggcctactttcaagattttgtgctggaaggatttggagttggccttgagacccaggccctgctctttgctgtgttcctggccctgtatatggtgactgtactgggcaacatcctcatgatcattgttatcaccctggatgcccgcctgcactccccaatgtacttcttcctcaagaacctctcctttgtggacttgtgctactcatctgtcattgcccccaatgcactggccaacttcttctcctcgtccaaggtcatcacctttgcaggatgtgccatgcagttttcctttttgtccttgctgggcacaactgaagctttcctcctgggtgtcatggcctatgaccgcttcatggccatctgtaaccccttgcgttaccccatcaccatgtgccagtctgcctgcactcgcctggtgctgggcgcctactgtggaggctgcttcaactctgttgtgcagaccagcttcacattccacctctcattctgcagctccaaccgcatcaaccacttcttctgtgatgtgccccctctgctccagatagcctgtggcaacacagccatcaataaacttctcatgtttggcatctgtgggttcatgattgtgggtttggcatttgtgatcctcatctcctatggctacatcatagcgaccatcctgaggatgcagtcaggagctgggagacgcaagatcttctccacctgtggctcccacatgactgtagtaactctcttttttgggactctctttgtcatgtatgcccagccaggagcaattgagtccatggagcagggcaaggtggtctctgtcttctacacgctggtcatcccaatgctcaatcctctcatctacagtctgcgaaacaaggatgtgaaggaggctgtgcagaggctgggccagaaacacatgaccatgtaa

SEQ ID NO: 1512 - protein, 316 aa, Canis familiaris
MPPHSNGNLSMAYFQDFVLEGFGVGLETQALLFAVFLALYMVTVLGNILMIIVITLDARLHSPMYFFLKNLSFVDLCYSSVIAPNALANFFSSSKVITFAGCAMQFSFLSLLGTTEAFLLGVMAYDRFMAICNPLRYPITMCQSACTRLVLGAYCGGCFNSVVQTSFTFHLSFCSSNRINHFFCDVPPLLQIACGNTAINKLLMFGICGFMIVGLAFVILISYGYIIATILRMQSGAGRRKIFSTCGSHMTVVTLFFGTLFVMYAQPGAIESMEQGKVVSVFYTLVIPMLNPLIYSLRNKDVKEAVQRLGQKHMTM

SEQ ID NO: 1513 - DNA, 867 bp, Canis familiaris
aacagctccatgatccactttcaagattttgtactagagggatttaggggtggtctggagactcaagccatgctcttcactgtgctcttggccctgtatatggtgcctatactgggaaacttcctcaatatcatctttagcatcctggatgcctgcctacacttcccaatgtactacttcctcaagaacctctcctttgtggacttgtgctactcatctgtcattgccccatgccacccagtttttctttttatccctttggccaccactgaatgcttcctcctgggtgttatgttctacgaccgcttcatagccatctgtagccccttgcgctaccccagcaccatgtgccagtctgcctgcactcgcctggtgctgggcgcctactgtggaggctgctccaactctgttgtgcagaccagcttcacattccacctcccattctgcagctccaaccgcatcaaccacttcttctgtgatgtgccccctctactccagatcgcctgtggcaacacggccatcaatgaacttctcttatttggcatctgtgggctcatgattgtgggtgtgacatttgttgtcctcatctcctatggttacataatagtgaccatcctgagcatgggctcaggagctgggagacgcaagatcttctccacctgtggctcccatatgactgcagtgtctctttttggggactgtctttgtcatgtatgcccagacaggagcaattgagtccatggagcagggctaggtggtctccgtcttctacacattggtcatcccaatgctcaatccctcacctacagactgcaaaacaaggatgtgaaggaggctgtgtggaggctaggccaggaacacttggcc

SEQ ID NO: 1514 - protein, 244 aa, Canis familiaris
NSSMIHFQDFVLEGFRGGLETQAMLFTVLLALYMVPILGNFLNIIFSILDACLHFPMYYFLKNLSFVDLCYSSVIAPCHPVFLFIPLATTECFLLGVMFYDRFIAICSPLRYPSTMCQSACTRLVLGAYCGGCSNSVVQTSFTFHLPFCSSNRINHFFCDVPPLLQIACGNTAINELLLFGICGLMIVGVTFVVLISYGYIIVTILSMGSGAGRRKIFSTCGSHMTAVSLFGDCLCHVCPDRSN

SEQ ID NO: 1515 - DNA, 951 bp, Canis familiaris
atgccatcccacagttatggaaacctctccaaggtctactttcaagattttgtgctggagggattttcaggtggtctggaaacccaggcgctgctctttgctgtgttcctggccctgtacatggtgactgtgctgggcaacctcctcatgatcattgttatcaccctggatgcccgcctgcactccccaatgtacttcttcctcaagaacctctccttcgtggacttgtggtactcatctttcattgcccccaatgcactggccaacttcttctcctcgtccaaggtcatcaccttcacaggatgtgccatgcagtttttctttttgtccattctggccaccactgaatgcttcctcctgggtgtcatggcctatgaccgcttcatggccatctgtaaccccttgcgctaccccatcaccatgtgccagtctgcctgcactcgcctggtgctgggcgcctactgtggaggctgcttcaactctattgtgcagaccagcttcacattccacctcccattctgcagctccaaccgcatcaaccacttcttctgtgatgtgccccctctactccagatcgcctgtggcaacatagccatcaataaacttctcttgtttggcatctgtgggctcatcattgtgggtgtgatgtttgtgatcctcatctcctatggctacatcatagcgaccatcctgaggatgcggtcaggagctgggagacgcaagatcttctccacctgtggctcccacatgactgcagtgactctcttttttgggactctctttgtcatgtatgcccagccaggagcaattgagtccatggagcagggcaaggtggtctctgtcttctacacgctggtcatcccaatgctcaatcccctcatctacagtctgcgaaacaaggatgtgaaggaggctgtgcagaggctgggccagaaacacatgaccatgtga

SEQ ID NO: 1516 - protein, 316 aa, Canis familiaris
MPSHSYGNLSKVYFQDFVLEGFSGGLETQALLFAVFLALYMVTVLGNLLMIIVITLDARLHSPMYFFLKNLSFVDLWYSSFIAPNALANFFSSSKVITFTGCAMQFFFLSILATTECFLLGVMAYDRFMAICNPLRYPITMCQSACTRLVLGAYCGGCFNSIVQTSFTFHLPFCSSNRINHFFCDVPPLLQIACGNIAINKLLLFGICGLIIVGVMFVILISYGYIIATILRMRSGAGRRKIFSTCGSHMTAVTLFFGTLFVMYAQPGAIESMEQGKVVSVFYTLVIPMLNPLIYSLRNKDVKEAVQRLGQKHMTM

SEQ ID NO: 1517 - DNA, 969 bp, Canis familiaris
atgccatcccacagtaatgaaaacctctccatggtctactttcaagattttgtgctggagggatttgggggtggcctggagacccaggcgctactcttcacactgtttctggccctgtacatggtgactctgctggggaacattctcatgatcatcataattaccctggatgcccgcctgcactccccaatgtacttcttcctcaagaacctctccttcgtggacttgtgctactcatctgtgatcgcccccaatgcactggccaacttcttctcctcatccaaggtcatcacctttgcaggatgtgccacccagtttttctttatctccctgctggccaccactgaatgcttcttcctgggtgtgatggcgtatgaccgcttcatggccatctgtagccctttgcgctacccaagtaccatgtgccagtctgcctgcactcgcctggtgctgggcgcctactgtggaggctgcttcaactctgttgtgcagaccagcttcacattccacctcccattctgcagctccaaccgcatcaaccacttcttctgtgatgtgccccctctgctccagatcgcctgtggcaacacggccatcaatgaacttcttctgtttggcatctgtgggctcatcattgtgggtgtgatgtttgtgatcctcatctcctatggctacatcacagtgaccatcctgaggatgcggtcaggaactgggagacacaagatcttctccacctgtggctcccacatgactgtagtgactctcttttttgggactgcctttgtcatgtatgcccagccaggagcaattgaatccatggagcagggcaaggtggtctctgtcttctacacgctggtcatcccaatgctcaatcccctcatctacagtctgcgaaacaaggatgtgaaggaggctgtgcagaggctgggccagaaacacatggccatacgaaggatgtgctgttggtag

SEQ ID NO: 1518 - protein, 322 aa, Canis familiaris
MPSHSNENLSMVYFQDFVLEGFGGGLETQALLFTLFLALYMVTLLGNILMIIIITLDARLHSPMYFFLKNLSFVDLCYSSVIAPNALANFFSSSKVITFAGCATQFFFISLLATTECFFLGVMAYDRFMAICSPLRYPSTMCQSACTRLVLGAYCGGCFNSVVQTSFTFHLPFCSSNRINHFFCDVPPLLQIACGNTAINELLLFGICGLIIVGVMFVILISYGYITVTILRMRSGTGRHKIFSTCGSHMTVVTLFFGTAFVMYAQPGAIESMEQGKVVSVFYTLVIPMLNPLIYSLRNKDVKEAVQRLGQKHMAIRRMCCW

SEQ ID NO: 1519 - DNA, 951 bp, Canis familiaris
atgccatcccacagtaatgaaaacctctccaaggtctacattcaagattttgtgctggagggatttgggggtggcctggagacccaggtgctactcttcactctgtttctggccctgtacatggtgactctgctggggaacattctcatgatcatcataattaccctggatgcccgcctgcactccccaatgtacttcttcctcaagaacctctccttcgtggacttgtgctactcatctgtgatcgcccccaatgcactggccaacttcttctcctcatccaaggtcatcacctttgcaggatgtgccacccagtttttctttttctccctcctggccagcactgaatgcttcctcctgggtgtcatggcctatgaccgcttcatggccatctgtaaccccttacattaccccagcaccatgtgccagtctgcctgcactcgcctggtgctgggcacctattgtggaggctgcctcaactctgttgtgcagaccagcttcacattccacctctcattctgcagctccaaccgcatcaaccacttcttctgtgatgtgccccctctgctcctgatcgcctgtggcaacacggccatcaatgaacttcttctgtttggcatctgtgggctcatcattgtgggtgtgacatttgtgatcctcatctcctatggctacatcacagtgaccatcctgaggatgcggtcaggagctgggagacgcaagatcttctccacctgtggctcccacatgactgcagtgaccctcttttttgggactctctttgtcatgtatgcccagccaggagcaattgagtccatggagcagggcaaggtggtctctgtcttctacacgctggtcatcccaatgctcaatcctctcatctacagtctgcgaaacaaggatgtgaaggaagctgtgcagaggttgggccagaaacacacagtcacgtga

SEQ ID NO: 1520 - protein, 316 aa, Canis familiaris
MPSHSNENLSKVYIQDFVLEGFGGGLETQVLLFTLFLALYMVTLLGNILMIIIITLDARLHSPMYFFLKNLSFVDLCYSSVIAPNALANFFSSSKVITFAGCATQFFFFSLLASTECFLLGVMAYDRFMAICNPLHYPSTMCQSACTRLVLGTYCGGCLNSVVQTSFTFHLSFCSSNRINHFFCDVPPLLLIACGNTAINELLLFGICGLIIVGVTFVILISYGYITVTILRMRSGAGRRKIFSTCGSHMTAVTLFFGTLFVMYAQPGAIESMEQGKVVSVFYTLVIPMLNPLIYSLRNKDVKEAVQRLGQKHTVT

SEQ ID NO: 1521 - DNA, 951 bp, Canis familiaris
atgccatcccacagtaatgaaaatctctctaaggtctacattcaagattttgtgctggagggatttgggggtggcctggagacccaggcgctactcttcactctgtttctggccctgtacatggtgactcttctggggaacatcctcatgatcatcataattaccctggatgcccgcctgcactccccaatgtacttcttcctcaagaacctctccttcgtggacttgtgctactcatctgtcattgcccccaatgcactggccaacttcttctcctcatccaaggtcatcacctttgcaggatgtgccacccagtttttctttatctcccttatggcaaccactgaatgcttcctcctgggtgtcatggcgtatgaccgcttcatggccatctgtagccctttgcgctacccgagcaccatgtgccagtctgcctgcactcgcctggtgctgggcgcctactgtggaggctgcttcaactctgttgtgcagaccagcttcacattccacctcccattctgcagctccaaccacatcaaccacttcttctgtgatgtgccccctctgctccagatcgcctgtggcaacacggccatcaatgaacttctcttgtttggcatctgtgggctcatcattgtgggtgtgacgtttgtgatcctcatctcctatggctacatcacagtgaccatcctgaggatgggatcaggagctgggagacacaagatcttctccacctgtggctcccacatgactgcagtgactctcttttttgggactctctttgtcatgtatgcccagccaggagcaattgagtccatggagcagggcaaggtggtctctgtcttctacacgctggtcatcccaatgctcaatcctctcatctacagtctgcgaaacaaggatgtgaaggaggctgtgcagaggctgggccagaaacacacagtcatgtga

SEQ ID NO: 1522 - protein, 316 aa, Canis familiaris
MPSHSNENLSKVYIQDFVLEGFGGGLETQALLFTLFLALYMVTLLGNILMIIIITLDARLHSPMYFFLKNLSFVDLCYSSVIAPNALANFFSSSKVITFAGCATQFFFISLMATTECFLLGVMAYDRFMAICSPLRYPSTMCQSACTRLVLGAYCGGCFNSVVQTSFTFHLPFCSSNHINHFFCDVPPLLQIACGNTAINELLLFGICGLIIVGVTFVILISYGYITVTILRMGSGAGRHKIFSTCGSHMTAVTLFFGTLFVMYAQPGAIESMEQGKVVSVFYTLVIPMLNPLIYSLRNKDVKEAVQRLGQKHTVM

SEQ ID NO: 1523 - DNA, 951 bp, Canis familiaris
atgccatcccacagtaatggaaaccactccaaggtctactttcaagattttgtgctggagggatttgcaggtggccttgagacccaggccctgctctttgctgttttcctggccctgtacatggtgactgtcctgggtaacctcctcatgatcatcgttatcaccctggatgcccgcctgcactccccaatgtacttcttcctcaagaacctctcctttgtggacttgtgctactcatctgtcattgcccccaatgcactggccaacttcttctcctcatccaaggtcatcacctttgcaggatgtgccacccagtttttctttttatccctgctggccacaactgaaggcttcctcctgggtgtcatggcctacgaccgcttcatggctatctgtagccccttgcgttaccccaccaccatgtgccagtctgcctgcactcgcctggtgctgggcgcctactgtggaggctgcttcaactctgttgtgcagaccagcttcacattccacctcccattctgcagctccaaccgcatcaaccacttcttctgtgatgtgccccctctgctccagatcgcctgtggcaacacggccatcaatgaacttctcttgtttggcatctgtgggctcatcatagtggctgtgacgattgtgatcctcatctcctatggctacatcacagtgaccatcctgaggatgggatcaggagctgggagacgcaagatcttctccacctgtggctcccacatgactgcagtgactctcttttttgggactctctttgtcatgtatgcccagccaggagcaattgagtccatggagcagggcaaggtggtctctgtcttctacacgctggtcatcccaatgctcaatcccctcatctacagtctgcgaaacaaggatgtgaaggaggccctgcggaggctgggccagaagcacacggccatgtga

SEQ ID NO: 1524 - protein, 316 aa, Canis familiaris
MPSHSNGNHSKVYFQDFVLEGFAGGLETQALLFAVFLALYMVTVLGNLLMIIVITLDARLHSPMYFFLKNLSFVDLCYSSVIAPNALANFFSSSKVITFAGCATQFFFLSLLATTEGFLLGVMAYDRFMAICSPLRYPTTMCQSACTRLVLGAYCGGCFNSVVQTSFTFHLPFCSSNRINHFFCDVPPLLQIACGNTAINELLLFGICGLIIVAVTIVILISYGYITVTILRMGSGAGRRKIFSTCGSHMTAVTLFFGTLFVMYAQPGAIESMEQGKVVSVFYTLVIPMLNPLIYSLRNKDVKEALRRLGQKHTAM

SEQ ID NO: 1525 - DNA, 951 bp, Canis familiaris
atgccattgcacaataatggaaacctctccaaggtctactttcaagattttgtgctggagggatttgcaggtggccttaggacccaggccctgctctttgctgtgttccttgccctgtacatggtgactgtgctgggtaacctcctcatgatcatcgttatcaccctggatgcccgcctgcactccccaatgtacttctttctcaagaacctctcctttgtggacttgtgctactcatctgtcattgccccaaatgcactggccaacttcttctcctcgtccaaggtcatcacctttgcaggatgtgccacccagtttttctttttctccttgctggccacaactgaaggcttcctcctgggtgtcatggcctatgaccgcttcatggccatctgtaaccccttgcgttaccccatcaccatgtgccagtctgcctgcactcgcctgctgctgggtgcctactgtggaggctgcttcaactctgttgtgcagaccagcttcacattccacctcccattctgcagctccaaccgcatcaaccacttcttctgtgatgtgccccctctgctccagatcgcctgtggcaacacggccatcaatgaacttctcttgtttggcatctgtgggctcatcatagtggctgtgacgattgtgatcctcatctcctatggctacatcacagtgaccatcctgaggatgcgctcaggaactgggagacgcaagatcttctccacctgtggctcccacatgactgcagtgactctcttttttgggactctctttgtcatgtatgcccagccaggagcaattgagtccatggagcagggcaaggtggtctctgtcttctacacgctggtcatcccaatgctcaatcccctcatctacagtctacgaaacaaggatgtgaaggaggccctgcggaggctgggccagaagcacacgaccatgtga

SEQ ID NO: 1526 - protein, 316 aa, Canis familiaris
MPLHNNGNLSKVYFQDFVLEGFAGGLRTQALLFAVFLALYMVTVLGNLLMIIVITLDARLHSPMYFFLKNLSFVDLCYSSVIAPNALANFFSSSKVITFAGCATQFFFFSLLATTEGFLLGVMAYDRFMAICNPLRYPITMCQSACTRLLLGAYCGGCFNSVVQTSFTFHLPFCSSNRINHFFCDVPPLLQIACGNTAINELLLFGICGLIIVAVTIVILISYGYITVTILRMRSGTGRRKIFSTCGSHMTAVTLFFGTLFVMYAQPGAIESMEQGKVVSVFYTLVIPMLNPLIYSLRNKDVKEALRRLGQKHTTM

SEQ ID NO: 1527 - DNA, 966 bp, Canis familiaris
atgccatcctacagtaatggaaacctctccatggtctaccttcaagattttgtgctggagggatttgaaggtggtctggagacccaggccctgctctttgctgtgttcctggccctgtacatggtgactgtcctgggtaacctcctcatgatcatcgttatcaccctggatgcccgactgcactccccaatgtacttcttcctcaagaacctctccttcctggacttgtgctactcatctgtcatcgcccccaatgcactggccaacttcttctcctcatccaaggtcatcacctttacaggatgtgccacccagttattctttttctccctgctggtcacaactgaaggtttcctcttgggtgtcatggcctatgaccgcttcatggccatctgtagccccttgcgctaccccatcaccatgtgccagtctgcctgcactcgcctggtgctgggcgcctactgtggaggctgcctcaactctgttgtgcagaccagcttcacattccacctcccattctgcagctccaaccgcatcaaccatttcttctgtgatgtgccccctctgctccagatcgcctgtggcaacacggccatcaatgaacttctcttgtttggcatctgtgggctcatcatagtggctgtgacgattgtgatcctcatctcctatggctacatcacagtgaccatcctgaggatgcggtcaggagctgggagacgcaagatcttctccacctgtggctcccacatgactgcagtgaccctattttttggggactgtttttttttggggactgtttttgtcatgtatgcccagccaggagcaattgagtccatggagcagggcaaggtagtctctgtcttctacacgctggtcatcccaatgctcaatcccctcatctacagtctgcgaaacaaggatgtgaaggaggccctgcggaggctgggccagaaacacacggccatg

SEQ ID NO: 1528 - protein, 322 aa, Canis familiaris
MPSYSNGNLSMVYLQDFVLEGFEGGLETQALLFAVFLALYMVTVLGNLLMIIVITLDARLHSPMYFFLKNLSFLDLCYSSVIAPNALANFFSSSKVITFTGCATQLFFFSLLVTTEGFLLGVMAYDRFMAICSPLRYPITMCQSACTRLVLGAYCGGCLNSVVQTSFTFHLPFCSSNRINHFFCDVPPLLQIACGNTAINELLLFGICGLIIVAVTIVILISYGYITVTILRMRSGAGRRKIFSTCGSHMTAVTLFFGDCFFLGTVFVMYAQPGAIESMEQGKVVSVFYTLVIPMLNPLIYSLRNKDVKEALRRLGQKHTAM

SEQ ID NO: 1529 - DNA, 939 bp, Canis familiaris
atgcggggacggaacgccaccaaggtcagcgtcttcgtcctgctgggcttccccacggcccctcggctgcagtacgtgctcttcctcgtcttcctgctcacctacctcttcatcctggtggagaacctcgtcatcatcgtcaccgtccgccgcagcgcccccctccacaggcccatgtactacttcctgggcgccctgtctgtcctggaggtctggtacgtgtcggtcatcatccccaagatgctgggggggctcctcctgcagcagaaactcatctcctttgccggctgcatgacccagctctacttcttcagctccctggtgtgcaccgaatgcgtgctcctggcctccatggcctacgaccgctacgtggccatctgccaccccctgcgctaccaagtcatcatgaccacgaggctctgcgtccggctggtggccttctccttcgtcagcggcttctccatctctatgatcaaggtgttctttgtctccagggccacgttctgtggctccaacgtcctgaaccacttcttctgtgacatttcccccatcctcaagctggcctgcaccgacttctcgaccgcggagctggtggacttcatcctggccttcatcatcctggtgtcgcccctggtggccaccgtgctgtcctacgggcacatcaccctggccgtcctgcgcatcccctcggccacgggccgctggagggccttctccacctgcgcctcccacctcaccgtggtcaccatcttctacacggccatgatcttcatgtacgtccggccccaggccatcgattcccggagctccaataagctcatctctgcggtgtacactgtcctcaccccgataatcaaccccttgatctactgcctgaggaacaaagaatttaaggctgccttgaaaaaggctctgggctttggtcaaattcccacatag

SEQ ID NO: 1530 - protein, 313 aa, Canis familiaris
LCGNLTKAQSLFQGSLKFFVPQAVDQGVDYRGEDSVHRRDELIGAPGIDGLGPDVHEDHGRVEDGDHGEVGGAGGEGPPAARGRGDAQDGQGDVPVGQHGGHQGRHQDDEGQDEVHQLRGREVGAGQLEDGGNVTEEVVQDVGATERGPGDKEHLDHRDGEAADEGEGHQPDAEPRGHDDLVAQGVADGHVAVVGHGGQEHAFGAHQGAEEVELGHAAGKGDEFLLQEEPPQHLGDDDRHVPDLQDRQGAQEVVHGPVEGGAAADGDDDDEVLHQDEEVGEQEDEEEHVLQPRGRGEAQQDEDADLGGVPSPH

SEQ ID NO: 1531 - DNA, 951 bp, Canis familiaris
atgccacccaaaagaaatggaaacctctccatggtccactttcaagattttgttctggagggatttgagggtggcctggagacccaggccctgctctttgctgtgttcctggctctatacatggtgactgtactgggtaacctcctcatgatcatcgttatcaccctggatgcccgcctgcactccccaatgtacttcttcctcaagaacctctccttcgttgacttgtgctactcatctgtcattgcccccaaagcactggccaacttcttctcctcatccaaggtcatcacctttgcaggatgtgccatgcagtttttctttttctccttgctgggcacaactggagctttcctcctgggtgtcatggcctatgaccgcttcatggccatctgtaaccccttgcgttaccccatcaccatgtgccagtctgcctgcacttgcctggtgctgggcgcctactgtggagggtgcttcaactctgttgtgcagaccagcttcacattccacctcccattctgcagctccaaccgcatcaaccacttcttctgtgatgtggtccccttgctcaaactctcctgtggcaacacagccatcaatgaacttctcttgtttggcatctgtgggctcatcattgtgggtttggcatttatggtcctcatctcctatggctacatcatagtgaccatcctgaggatgggatcaggagctaggagacgtaaggtcttctctacctgtggctcccacatgactgcagtgactctcttttttgggaccgtctttgtcatgtatgcccagccaggagcaattgagtctatggagcagggcaaggtggtctctgtcttctacacgctggtcatcccaatgctcaatcccctcatctacagtctgcgaaacaaggatgtgaaggaggccctgcggaggctgggccagaaacccatggccttgtga

SEQ ID NO: 1532 - protein, 316 aa, Canis familiaris
MPPKRNGNLSMVHFQDFVLEGFEGGLETQALLFAVFLALYMVTVLGNLLMIIVITLDARLHSPMYFFLKNLSFVDLCYSSVIAPKALANFFSSSKVITFAGCAMQFFFFSLLGTTGAFLLGVMAYDRFMAICNPLRYPITMCQSACTCLVLGAYCGGCFNSVVQTSFTFHLPFCSSNRINHFFCDVVPLLKLSCGNTAINELLLFGICGLIIVGLAFMVLISYGYIIVTILRMGSGARRRKVFSTCGSHMTAVTLFFGTVFVMYAQPGAIESMEQGKVVSVFYTLVIPMLNPLIYSLRNKDVKEALRRLGQKPMAL

SEQ ID NO: 1533 - DNA, 951 bp, Canis familiaris
atgccacccaaaagaaatggaaacctctccatggtccactttcaagattttgtgctggagggatttgaaggtggcctggaaacccaggccctgctctttgctgtgttcctggctctatacatggtgactgtactgggtaacctcctcatgatcatcgttatcaccctggatgcccgcctgcactccccaatgtacttcttcctcaagaacctctccttcgttgacttgtgctactcatctgtcattgcccccaaagcactggccaacttcttctcctcatccaaggtcatcacctttgcaggatgtgccatgcagttttcctttttgtccttgctgggcacaactgaagctttcctcctgggtgtcatggcctatgaccgcttcatggccatctgtaaccccttgcgttaccccatcaccatgtgccagtctgcctgcactcgcctggtgctgggcgcctactgtggaggctgcttcaactctgttgtgcagaccagcttcacattccacctcccattctgcagctccaaccgcatcaaccacttcttctgtgatgtggtccccttgctcaaactctcctgtggcaacacggccatcaatgaacttctcttgtttggcatctgtgggctcatcatcgtgagcgtgacatttgtgattctcatctcctatggctacatcatagcgaccatcctgaggatgggatcaggagctgggagaagcaagatcttctccacctgtggctcccacatgactgcagtgactctcttttttgggactgcctttttcatgtatgcccagccacgagcaattgagtctatggagcagggcaaggtggtctctgtcttctacacgctggtcatcccaatgctcaatcccctcatctacagtgtgcgaaacaaggatgtgaaggaggccctgcggaggctgggccagaaacacacggccacgtga

SEQ ID NO: 1534 - protein, 316 aa, Canis familiaris
MPPKRNGNLSMVHFQDFVLEGFEGGLETQALLFAVFLALYMVTVLGNLLMIIVITLDARLHSPMYFFLKNLSFVDLCYSSVIAPKALANFFSSSKVITFAGCAMQFSFLSLLGTTEAFLLGVMAYDRFMAICNPLRYPITMCQSACTRLVLGAYCGGCFNSVVQTSFTFHLPFCSSNRINHFFCDVVPLLKLSCGNTAINELLLFGICGLIIVSVTFVILISYGYIIATILRMGSGAGRSKIFSTCGSHMTAVTLFFGTAFFMYAQPRAIESMEQGKVVSVFYTLVIPMLNPLIYSVRNKDVKEALRRLGQKHTAT

SEQ ID NO: 1535 - DNA, 951 bp, Canis familiaris
atgctatcccacagaaatggaaacctctccatggtctactttcaagattttgttctggagggatttgaaagtggcctggaaacccaggccctgctctttgctgtgttcctggccctgtatatggtgactgtactgggcaacttcctcatgatcatcgttatcaccctggattcccacctgcactccccaatgtacttcttcctcaagaacctctccttcgtggatttgtgctactcatctgtcattgcccccaatgcactggccaactacttctcctcatcaaaggtcatcacctttgcaggatgtgccacccagttattctttttctctttgctgggaacaactgaatgcttcctcctgggtgtcatggcctacgaccgcttcatggccatctgtagccccttgcgttaccccatcaccatgtgccagtctgtctgcacttgcctggtgctgggcgcctactgtggagggtgcttcaactctgttgtgcagaccagcttcacattccacctcccattctgcagctccaaccgcatcaaccacttcttctgtgatgtgccccctctgctccagatcgcctgtggcaacacggccatcaatgaacttcttttgtttggcatctgtgggctcatcattgtgggggtgacgtttgtgatcctcatctcctatggctacatcacagtgaccatcctgaggatgcgaacaggagctgggagacgcaaggtcttctccacctgtggctcccacatgactgcagtgaccctcttttttgggactgcctttgtcatgtatgcccagccaggagcaattgagtccatggagcagggcaaggtggtctctgtcttctacacgctggtcatcccaatgctcaatcccctcatctacagtctgcgaaacaaggatgtgaaggaggccctggggaggctgggccagaaacacatggccatatga

SEQ ID NO: 1536 - protein, 316 aa, Canis familiaris
MLSHRNGNLSMVYFQDFVLEGFESGLETQALLFAVFLALYMVTVLGNFLMIIVITLDSHLHSPMYFFLKNLSFVDLCYSSVIAPNALANYFSSSKVITFAGCATQLFFFSLLGTTECFLLGVMAYDRFMAICSPLRYPITMCQSVCTCLVLGAYCGGCFNSVVQTSFTFHLPFCSSNRINHFFCDVPPLLQIACGNTAINELLLFGICGLIIVGVTFVILISYGYITVTILRMRTGAGRRKVFSTCGSHMTAVTLFFGTAFVMYAQPGAIESMEQGKVVSVFYTLVIPMLNPLIYSLRNKDVKEALGRLGQKHMAI

SEQ ID NO: 1537 - DNA, 951 bp, Canis familiaris
atgccatcccacagtagtgaaaacctctctatggtctactttcaagattttgtgctggagggatttgagggtggcctggaaacccaggccctgctctttgctgtgttcctggccctgtacatggtgactctgctgggcaacttcctcatgatcatcgttatcaccctggatgcccgcctgcactccccaatgtacttcttcctcaagaacctctcctttgtggacttgtgctactcatctttcattgctcccaaagcactggccaacttcttctcctcatccaaggtcatcacctttgcaggatgtgccacccagttattatttttctccttgctgggaacaactgaatgcttcctcctgggtgtcatggcctacgaccgcttcatggccatttgtaaccccttgcgttaccccatcaccatgtgccagtctgcctgcactcgcctggtgctgggcgcctactgtggaggctgcttcaactctgttgtgcagaccagcttcacattccacctcccattctgcagctccaaccacatcaaccacttcttctgtgatgtgcctcccttgctcaaactctcctgtggcgacacggccatcaatgaactattcttgtttggcatctgtgggctcatcattgtgggtgtaacaattgtgatcctcatctcctatggctacatcacagtgaccatcctgaggatgcgctcaggagctgggagacgcaagatcttctccacctgtggctcccacatgactgcagtgactctcttttttgggactctctttgtcatgtatgcccagccaggagcaattgagtccatggagcagggcaaggtggtctctgtcttctacacgctggtcatcccaatgctcaatcccctcatctacagtctgcgaaacaaggatgtgaaggaggccttgtggaggctgggccagaaacacatggccttgtga

SEQ ID NO: 1538 - protein, 316 aa, Canis familiaris
MPSHSSENLSMVYFQDFVLEGFEGGLETQALLFAVFLALYMVTLLGNFLMIIVITLDARLHSPMYFFLKNLSFVDLCYSSFIAPKALANFFSSSKVITFAGCATQLLFFSLLGTTECFLLGVMAYDRFMAICNPLRYPITMCQSACTRLVLGAYCGGCFNSVVQTSFTFHLPFCSSNHINHFFCDVPPLLKLSCGDTAINELFLFGICGLIIVGVTIVILISYGYITVTILRMRSGAGRRKIFSTCGSHMTAVTLFFGTLFVMYAQPGAIESMEQGKVVSVFYTLVIPMLNPLIYSLRNKDVKEALWRLGQKHMAL

SEQ ID NO: 1539 - DNA, 951 bp, Canis familiaris
atgctatcccacagtaatgaaaacctctccaaggtctactttcaagattttgtgctggagggatttggaggtggtctggagacccaggccatgctcttcactgtgttcctagccctgtacatggtgactgtgctggggaacatcctcatgatcatcgttatcaccctggatgcccgcctgcactccccaatgtacttcttcctcaagaacctctccttcctagacttgtgctactcatctgtgatcacccccaatgcactggccaacttcttctcatcatcaaagatcatcacctttgcaggatgtgccacccagttattctttttctccctgctagccacaactgaagccttcctcctaggtgtcatggcctacgaccgcttcatggccatctgtagccccttgcgctaccccatcaccatgtgccagtctgcctgcactcgcctggtgctgggcgcctactgcggaggctgcctcaactctgttgtgcagaccagcttcacattccacctcccattctgcagctccaaccgcatcaaccacttcttctgtgatgtgccccctctgctccagatcgcctgtggcaacacgaccatcaatgaacttctcttgtttggcatctgtgggctcatcattgtgggggtgacgtttgtgatcctcatctcctatggctacatcatagtgaccatcctgaggatgagctcaggagctgggagacgcaaggtcttctccacctgtggctcccacatgactgcagtgaccctcttttttgggaccgtctttgtcatgtatgcccagccaggagcaattgagtccatggagcagggcaaggtggtctctgtcttctacacactggtcatcccaatgctcaatcccctcatctacagtctgcgaaacaaggatgtgaaggaggccttgtggaggctgggccagaaacacatggccatgtga

SEQ ID NO: 1540 - protein, 316 aa, Canis familiaris
MLSHSNENLSKVYFQDFVLEGFGGGLETQAMLFTVFLALYMVTVLGNILMIIVITLDARLHSPMYFFLKNLSFLDLCYSSVITPNALANFFSSSKIITFAGCATQLFFFSLLATTEAFLLGVMAYDRFMAICSPLRYPITMCQSACTRLVLGAYCGGCLNSVVQTSFTFHLPFCSSNRINHFFCDVPPLLQIACGNTTINELLLFGICGLIIVGVTFVILISYGYIIVTILRMSSGAGRRKVFSTCGSHMTAVTLFFGTVFVMYAQPGAIESMEQGKVVSVFYTLVIPMLNPLIYSLRNKDVKEALWRLGQKHMAM

SEQ ID NO: 1541 - DNA, 951 bp, Canis familiaris
atgccatcccacagtaatggaaacctctccatggcctactttcaagattttgtgctggaaggatttggaggtggccttgagacccaggccctgctctttgctgtgttcctggccctgtatatggtgactgtactgggcaacattctcatgatcattgttatcaccctggatgcccgcctgcactccccaatgtacttcttcctcaagaacctctcctttgtggacttgtgctactcatctgtgatcgccccaaatgcactggccaacttcttctcctcgtccaaggtcatcacctttgcaggatgtgccacccagtttttctttttatccctgctggccacaacagaaggcttcctcctgggtgtcatggcctacgaccgcttcatggccatctgtagccccttgcgctaccccagcaccatgtgccagtctgcctgcactcgcctggtgctgggcgcctactgtggaggctgcttcaactctgttgtgcagaccagcttcacattccacctcccattctgcagctccaaccgcatcaaccacttcttctgtgatgtgccccctctgctccagatcgcctgtggcaatacggccatcaatgaacttctcttgtttggcatttgtgggttcatgattgtgggtttggcaattgtgatcctcatctcctatggctacatcatagcgaccatcctgaggatgcggtcaggagctgggagacgcaagatcttctccacctgtggctcccacatgactgtagtaactctcttttttgggactctctttgtcatgtatgcccagccaggagcaattgagtccatggagcagggcaaggtggtctctgtcttctacacgctggtcatcccaatgctcaatcccctcatctacagtctgcgaaacaaggatgtgaaggaggctgtgcagaggctgggccagaaacacatgaccatgtga

SEQ ID NO: 1542 - protein, 316 aa, Canis familiaris
MPSHSNGNLSMAYFQDFVLEGFGGGLETQALLFAVFLALYMVTVLGNILMIIVITLDARLHSPMYFFLKNLSFVDLCYSSVIAPNALANFFSSSKVITFAGCATQFFFLSLLATTEGFLLGVMAYDRFMAICSPLRYPSTMCQSACTRLVLGAYCGGCFNSVVQTSFTFHLPFCSSNRINHFFCDVPPLLQIACGNTAINELLLFGICGFMIVGLAIVILISYGYIIATILRMRSGAGRRKIFSTCGSHMTVVTLFFGTLFVMYAQPGAIESMEQGKVVSVFYTLVIPMLNPLIYSLRNKDVKEAVQRLGQKHMTM

SEQ ID NO: 1543 - DNA, 861 bp, Canis familiaris
cactttcaagattttgtactagagggatttaggggtggtctggagacccaagccatgctcttcactgtgttcttggccttgtacatggtgactatactgggcaacttcctcatgatcatctctagcaccctggatgcctgcctacacttcccaatgtatgtcttcctcaagaacccctccttcgtggacttgtgctactcatctgtcattgcccccaatgcaccggccaactacttctcctcatccaaggtcatcacctttacagaatgtgccacccagtttttctttttatccctggtggctaccactgaatgcttcctcctgggtgttatgtcctacgaccacttcatgaccatttgtagacccttgagctaccctagcaccatgtgccagtctggctgcactcgcctggtgctgtgcacctactgtggaggctgcttcaactcttcaactctggtgcagagaagcttcacattcaacctctcattctgcagctccaactgcatcaaccacgtcctctgtgatgtgccccctctgttccatatcgcctgtggcaagacggccatcaatgaacttctcttgtttggcatctgtgggctcatgattgtgtgtgtgacatatatggtcctcatctcctatggttacataatagtgtccatcctgaggatgggctcaggagcgtttgggaccgtctttgtaatatatacccagccaggagcaactgagtccatggagcagggcaaggtggtctctgtcttctacacgctggtcatcccagagctcaatcccctcatctacagtctgcaaaacaaggatgtgaaggaggctgtgtggaggctgggccagaaacacatggccacg

SEQ ID NO: 1544 - protein, 287 aa, Canis familiaris
HFQDFVLEGFRGGLETQAMLFTVFLALYMVTILGNFLMIISSTLDACLHFPMYVFLKNPSFVDLCYSSVIAPNAPANYFSSSKVITFTECATQFFFLSLVATTECFLLGVMSYDHFMTICRPLSYPSTMCQSGCTRLVLCTYCGGCFNSSTLVQRSFTFNLSFCSSNCINHVLCDVPPLFHIACGKTAINELLLFGICGLMIVCVTYMVLISYGYIIVSILRMGSGAFGTVFVIYTQPGATESMEQGKVVSVFYTLVIPELNPLIYSLQNKDVKEAVWRLGQKHMAT

SEQ ID NO: 1545 - DNA, 567 bp, Canis familiaris
atggctatctgtcaccccctgcattacatggttatcatgaatccctggctctgtggactgctggttctagtgtcctgaattccttattacagagcttaatggtgttgtgggtgtccttctgtacaggcacagaaatccttcatttttttttaactcaatcaagtaatcaggaatgcctgttctgacacttttcttaatgacatggtgatatattttatgactgtgctgctggcaggtggtcctttcactgggttcctttactcttgtttcccccgtacatagaatctcatcatcttagagcaagtataaagcattttctacctgtgcatctcacctcttggttgtctccttattttactctacaagccttgaagtgtactttagctctgctgctccccagagctcccacacaagtgcagtggcctcggtgatatacacatagtcatacccatgctgaaccccttcatctatagtctgaagaacagagacataaagagggctctgaaaagaatctttggggttccagtgatgcagtggccagtcatcctggggctgaagatgtgccca

SEQ ID NO: 1546 - protein, 70 aa, Canis familiaris
WAHLQPQDDWPLHHWNPKDSFQSPLYVSVLQTIDEGVQHGYDYVYITEATALVWELWGAAELKYTSRLVE

SEQ ID NO: 1547 - DNA, 939 bp, Canis familiaris
atgaggaatcagtcaacaaagattgagttctttctcctggggctgaccgatgacccacaactgcaaattgtgatttttacgtttctcttcatcaactatgtgctgagcatgactggaaacttaaccatcatccttctcaccctgctacatcccagcctcaagactcccatgtattttttcctccgaaatttctcctttatggaagcttcaatgacaacagtctgtattcccagattcctgataagcctcataactaaaaacaaagtcatttcctacaattgttgtgcatctcagttattctttttcctccaattagaaattgcagaattttacctgctggctgccatgtcctttgaccgttatgtagcaatctgcaaacccctgcattacctgatcatcatgaacaacaaaatgtgctaccaactcctgttcagctcatgggccgtgggctttctgctgtcgttttcaccattagctgtgggcctcacactggatttctgtgtttccggaataattgatcatttcatgtgtgacatttcccctgtgctgcagctttcctgcactgacactcgtttcttggaattgctttcgtttgccttagctattgtaacacttctggtgaccttactattagtgattctttcttacacatacattatcaagaccattctcaagatcccctctgctcagaaaagaaccaaggctttttctacttgttcttctcatatgattgtggtctcccttacgtatggtagctgcatctttaattacataaagccaacagcgaaggaaagggtgactttgtccaaaggtgtaagtgttatttatacctcggttgcccctttattaaaccctttcatttacagtctcagaaaccagcaagtcaaacaagccttcaaggacacactccaaaagattttctctctttccagaaaataa

SEQ ID NO: 1548 - protein, 312 aa, Canis familiaris
MRNQSTKIEFFLLGLTDDPQLQIVIFTFLFINYVLSMTGNLTIILLTLLHPSLKTPMYFFLRNFSFMEASMTTVCIPRFLISLITKNKVISYNCCASQLFFFLQLEIAEFYLLAAMSFDRYVAICKPLHYLIIMNNKMCYQLLFSSWAVGFLLSFSPLAVGLTLDFCVSGIIDHFMCDISPVLQLSCTDTRFLELLSFALAIVTLLVTLLLVILSYTYIIKTILKIPSAQKRTKAFSTCSSHMIVVSLTYGSCIFNYIKPTAKERVTLSKGVSVIYTSVAPLLNPFIYSLRNQQVKQAFKDTLQKIFSLSRK

SEQ ID NO: 1549 - DNA, 936 bp, Canis familiaris
atggaaaaccatacaactgtgacagtatttatcttagcaggattgacggaggacccaaaactgaagattgtgctatttgtcttcctgctcctcacctatttgctaagcatctcaggcaacttagtcattattaccctcactttgctggactcccatctcaagacccctatgtatttctttcttcgaaatttttctttcttagaaatttcttatacgacagtctgcatccccaaattgcttgtaagcatggcaaccggtgacaaaaccatttcctataactgttgtgcaactcagttattttttgccttccttcttggagcatctgaattttacctcctggctgtcatgtcctatgatcgttatgtcgccatctgcaagcccctgcattacacaaccattatgagcagcaaaatctgtatccagctagtccttagctcttggatcactggtttcctcatcatctttccaggactcattttaggcttaagcctggacttctgtgattccaatgtcattgatcatttctactgtgacacggctcccctcctgcagatctcctgcacagacacacacgtgttggaaatgatgagtttcatcttagctttggtgactctgctggtcactttggccttagtgattctatcgtacacatatatcgccctgacaattttaaaaattccttctgccaaccagagaaaaaaggctttctccacctgttcttctcacatgattgtcatctccctctcatacggcagctgcatctttatgtacattaaaccctcggtcaaacagaggatatccttgatgaagggggtggcagttctcaatacttctgttgctccacttttgaatccctttatctatactctaaggaaccagcaggtgaagcaagcatttaagaacttgctacaaagagttctgtctttattcaaatag

SEQ ID NO: 1550 - protein, 311 aa, Canis familiaris
MENHTTVTVFILAGLTEDPKLKIVLFVFLLLTYLLSISGNLVIITLTLLDSHLKTPMYFFLRNFSFLEISYTTVCIPKLLVSMATGDKTISYNCCATQLFFAFLLGASEFYLLAVMSYDRYVAICKPLHYTTIMSSKICIQLVLSSWITGFLIIFPGLILGLSLDFCDSNVIDHFYCDTAPLLQISCTDTHVLEMMSFILALVTLLVTLALVILSYTYIALTILKIPSANQRKKAFSTCSSHMIVISLSYGSCIFMYIKPSVKQRISLMKGVAVLNTSVAPLLNPFIYTLRNQQVKQAFKNLLQRVLSLFK

SEQ ID NO: 1551 - DNA, 948 bp, Canis familiaris
atgatgggaaaccagacatcggtgatagaattcattcttcttggactgacgaatgacgctgagcttcaagctgtgcttttcccttttctgctgctaacttacgtcttgagcatcatgggaaacttgaccatcatcattctgaccctgttggattatcgcctgcagactcctatgtatttctttctccggaatttttctgttttggaaatatcttttacttctgtctttgttcccaaaatgctagtcaacattgcaactggagacaagactatctccttcgctggttgtttcactcagtatttttttgccatccttctgggggcaactgaattttatcttttagctgccatgtcctacgatcgctatgttgccatttgtaaacccctgcactatacaactgtaatgagcaggaaactctgcattcagcttgttctgtgttcctggttctctggttttttggttgtcgttgtgccacatgcaatgactctccagctgcctttctgtgcctccaatgtcatcaaccattattgctgtgactataccgttctgctgcatctgtcctgttcagacacacagttcatagaagtgatggagtttatctttgcagcagttaccctcatcttgactttggtgccggtgactctttcctacacgtacatcatcaggacaattctgagaatcccctctgttcaacaaagaaaaaaagccttttctacatgctcctctcatatgattgtggtctcactttcttatggaagttgtatctttatgtacataaatccttctgttaaggatgcagaaacgtttaataagagagtggctgttttaaatacctcagttgcccctctgttgaaccctttcatctataccctaaggaacaagcaggtgaaaatagccttcaaagacatggtcagcaagataacgatgttttcaggaaaacgaaagtga

SEQ ID NO: 1552 - protein, 315 aa, Canis familiaris
MMGNQTSVIEFILLGLTNDAELQAVLFPFLLLTYVLSIMGNLTIIILTLLDYRLQTPMYFFLRNFSVLEISFTSVFVPKMLVNIATGDKTISFAGCFTQYFFAILLGATEFYLLAAMSYDRYVAICKPLHYTTVMSRKLCIQLVLCSWFSGFLVVVVPHAMTLQLPFCASNVINHYCCDYTVLLHLSCSDTQFIEVMEFIFAAVTLILTLVPVTLSYTYIIRTILRIPSVQQRKKAFSTCSSHMIVVSLSYGSCIFMYINPSVKDAETFNKRVAVLNTSVAPLLNPFIYTLRNKQVKIAFKDMVSKITMFSGKRK

SEQ ID NO: 1553 - DNA, 948 bp, Canis familiaris
atgatttgtgaaaatcacaccagagtcactgaatttgttcttctcggttttacaaataaccctgagatgcaagtttccctctttattttgttcctcatcatctatacagtcactttgttgggcaatttccttattatcacagttaccagtgtggatcctgctcttcaaacacccatgtacttctttctccgaaacctatcacttcttgaagtctgttttaccttggtcatggtgccgaagatgctggtggatctagtgtccctaaggaagatcatctcttttgtgggctgtggtatccagatgtactttttctttttcttcggcagctccgaatgttttctcctgtctatgatggcatatgatcgctttgtggccattggtaaccctctccgttattcagtcataatgaataggtccctatgtttatggatggctgtcggctcttggatgtctggggttcctgtctctatgctacaaacagcttggttgatggcccttcctttctgtggaccaaataccatagaccactttttttgtgatggtcccccagtgctgaaactagtcactcaagatacaaccatgtatgaaatgcaagcacttgcttccacactactgtttatcatgtttcccttttccctcattttggtctcctacacccgcattatcataaccatcctgaagatgccctctgctaccggtcgtcagaaggcattctccacttgttcatcacacctcattgtggtatcccttttctatggaacagccagcttgacctacctgcgacccaaatccaaccagtccccagagagcaagaagctagtgtcattgtcctacactgtcatcactcctatgttaaaccccatcatctacagcctaaggaacaatgaagtgaagggggcagtcaagaggacagttacccgaaaagtcttgaagttagatgcgttttga

SEQ ID NO: 1554 - protein, 315 aa, Canis familiaris
MICENHTRVTEFVLLGFTNNPEMQVSLFILFLIIYTVTLLGNFLIITVTSVDPALQTPMYFFLRNLSLLEVCFTLVMVPKMLVDLVSLRKIISFVGCGIQMYFFFFFGSSECFLLSMMAYDRFVAIGNPLRYSVIMNRSLCLWMAVGSWMSGVPVSMLQTAWLMALPFCGPNTIDHFFCDGPPVLKLVTQDTTMYEMQALASTLLFIMFPFSLILVSYTRIIITILKMPSATGRQKAFSTCSSHLIVVSLFYGTASLTYLRPKSNQSPESKKLVSLSYTVITPMLNPIIYSLRNNEVKGAVKRTVTRKVLKLDAF

SEQ ID NO: 1555 - DNA, 948 bp, Canis familiaris
atgaagagcgagctgagccggaattcctcaggagtgactgagttcattctgctgggcttcagaacagctccagacatacagatcctcttattcctattcttcttgctggtctacgtggtcatcgtggtgggaaatagcagcatgataattgtcatcaggatggactcgaggcttcacacacctatgtatttcttccttagaaacttgtcctatttagatctctgctactccacagtcattgctcccaaagctctggctactttcttgtccaaggacaagaaaatttcctacaatggctgcgcagcacagttctttttctttgctctctgtgttgggactgagggctttcttctggccgtgatggcctatgatcgtttctcagccatttgctcgccattcctctatcctgtccgtatgtctcaacaggtttgtgttcacttagtaattggctcctacatctgtggaggcctcaactccatggtccaaacaggattcaccttcagcttgcgtttctgtggagaaaaccgcctggaccacttcttctgtgacgtcccagccctgatcaagatctcatgtgttgacacgtctgtgaacgagatggtgctgttcatcctctcctccctcatcattgtcaccaccacgactgtcatcctggtttcctatgcttacatactctccactgtcctgaagatcccctccacccacggcaggggtaagaccttctccacctgtagctctcacatcactgtggtgagtttgttctatgggaccgtgttcttcatgtacgcccagcccggggccatctcctccccagagaaaagcaagattatagctgtgttctacactcttatcatccctatgttgaatccactgatttatagtctaaggaataaggaggtgaaaaatgctgtaaaaagggtattgttgagaagattatctttccattga

SEQ ID NO: 1556 - protein, 315 aa, Canis familiaris
MKSELSRNSSGVTEFILLGFRTAPDIQILLFLFFLLVYVVIVVGNSSMIIVIRMDSRLHTPMYFFLRNLSYLDLCYSTVIAPKALATFLSKDKKISYNGCAAQFFFFALCVGTEGFLLAVMAYDRFSAICSPFLYPVRMSQQVCVHLVIGSYICGGLNSMVQTGFTFSLRFCGENRLDHFFCDVPALIKISCVDTSVNEMVLFILSSLIIVTTTTVILVSYAYILSTVLKIPSTHGRGKTFSTCSSHITVVSLFYGTVFFMYAQPGAISSPEKSKIIAVFYTLIIPMLNPLIYSLRNKEVKNAVKRVLLRRLSFH

SEQ ID NO: 1557 - DNA, 963 bp, Canis familiaris
atgggtgacaggggaaccagcaatcgctcagaagtgactgacttcattcttgtaggcttcagggtccgccccgagctctacattctcctcttcctgctcttcctgcttgtgtatgccatgatcctgctggggaatgttgggatggtggccgttatcctgactgatcccaggctgaacacaccgatgtacttcctcctgggcaacctctccttcattgacctcttctactcctctgtaattgcccccaaggctatgatcaacttctggtctgagagcaagtccatctcctttgcaggctgtgcgacccagctctttctctttgccctcttcattgtggctgaggggtttctcctggctgccatggcttatgaccgcttcattgccatctgcaacccactcctctactccgtccagatgtcaacgcgtctctgcatccagttggtggctggttcctatttttgtggctgcatcagctcggttcttcagacgagtatgacatttagtatgtccttttgtgcttcccgggccattgaccacttttactgtgatgaccgtccacttcaaaggatttcttgctctgatctctactttcataagatagtttcctttctcttatgcagcattattattttgcccaccatcattgtcattctcgtgtcctatatgtatattgtgtccacagttctaaagataagatccactgagggacgtaagaaagccttctccacttgcagctctcacctaggggtcgtgagcgtcctgtacggtgccatcatttttatgtatttcatccctgacagattccctgagctgagtaaagtggcttccttatgttatacgttagtcactcccatgttgaatcctttgatttactccctgagaaacaaagatgtcaaagaggctctgagaaagatcctggggaaaaaaatatttttatttaattctatcttaacagtgatataa

SEQ ID NO: 1558 - protein, 320 aa, Canis familiaris
MGDRGTSNRSEVTDFILVGFRVRPELYILLFLLFLLVYAMILLGNVGMVAVILTDPRLNTPMYFLLGNLSFIDLFYSSVIAPKAMINFWSESKSISFAGCATQLFLFALFIVAEGFLLAAMAYDRFIAICNPLLYSVQMSTRLCIQLVAGSYFCGCISSVLQTSMTFSMSFCASRAIDHFYCDDRPLQRISCSDLYFHKIVSFLLCSIIILPTIIVILVSYMYIVSTVLKIRSTEGRKKAFSTCSSHLGVVSVLYGAIIFMYFIPDRFPELSKVASLCYTLVTPMLNPLIYSLRNKDVKEALRKILGKKIFLFNSILTVI

SEQ ID NO: 1559 - DNA, 897 bp, Canis familiaris
atgagaaatcacacaaaggtaacagagtttattcttctcgggttgaccgatgacccaaagtggcaggttgtacttttcatatttctcctggtcacctacatgtgcagtgtgactgggaacctggtcattatcttcctcaccctttacgatccccacctgaagactccaatgtattcttcccttcgaattcccagattccttgtcactgttgtgacgggagacagaaccatttcctacaatgactgtctggctcaggtattcttcgtcatcttattgggggtgacagagttttacctcctgaccgccatgtcctatgaccgctacatggccatctgcaaacctctgcattacatgaccatcatgagcagcagagtctgcatcctccttgtctttagctcatggcttgcaggattcctggtcatctttccacctgtaattctggtgctgaagttggatttctgtgcctccaatataatcgatcattttgtctgtgactcttcaccaattctacagctttcttgcacaaacactcactttctagaactcatggcatttgttttagcggtggtaacgcttatggtcaccttaaccctagttatgctctcctacacacacatcatccgcacaattctgagaattccttccacgagtcaaaggaaaaaagccttttccacgtgttcctcccacatgatagtggtctccctctcttatggcagctgcatcttcatgtacatcaagccttctgcaaaggaaagggtgagtttaaacaaaggcgtagctgtgatcattacctcagtgactcctcttctcaatcctttcatatataccttaagaaaccagcaggtgaaacaagccttcaaaaacatggtccacagaatggtcttttcttcatataaa

SEQ ID NO: 1560 - protein, 299 aa, Canis familiaris
MRNHTKVTEFILLGLTDDPKWQVVLFIFLLVTYMCSVTGNLVIIFLTLYDPHLKTPMYSSLRIPRFLVTVVTGDRTISYNDCLAQVFFVILLGVTEFYLLTAMSYDRYMAICKPLHYMTIMSSRVCILLVFSSWLAGFLVIFPPVILVLKLDFCASNIIDHFVCDSSPILQLSCTNTHFLELMAFVLAVVTLMVTLTLVMLSYTHIIRTILRIPSTSQRKKAFSTCSSHMIVVSLSYGSCIFMYIKPSAKERVSLNKGVAVIITSVTPLLNPFIYTLRNQQVKQAFKNMVHRMVFSSYK

SEQ ID NO: 1561 - DNA, 939 bp, Canis familiaris
atgagaaatcacacaaaggtaacagagtttattcttctcgggttgaccgatgacccaaagtggcaggttgtacttttcatatttctcctggtcacctacatgtgcagtgtgactgggaacctggtcattatcttcctcacccttacggatccccacctgaagactccaatgtatttcttccttcgaaacttctcattcctagaaatgtcattcacgtctgccacaattcccagattccttgtcactgttgtgacgggagacagaaccatttcctacaatgactgtctggctcaggtatttttcgtcatcttattgggggtgacagagttttacctcctgaccgccatgtcctatgaccgctacgtggccatctgcaaacctctgcattacatgaccatcatgagcaccagagtctgcatcctccttgtctttagctcatggcttgcaggattcctggtcatctttccacctgtaattctgatgctgaagttggatttctgtgcctccaatataatcgatcattttgtctgtgactcttcaccaattatacagctttcttgcacaaacactcactttctagaactcatggcatttgttttagcggtggtaacgcttatggtcaccttaaccctagttatgctctcctacacacacatcatccgcacaattctgagaattccttccacgagtcaaaggaaaaaagccttttccacgtgttcctcccacatgatagtagtctccctctcttatggcagctgcatcttcatgtacatcaagccttctgcaaaggaaagggtgagtttaaacaaaggcgtagctgtgatcattacctcagtgactcccctcctcaatcctttcatatataccttaagaaaccagcaggtgaagcaagccttcaagaacatggtccacagaatggtcttttcttcatataaatga

SEQ ID NO: 1562 - protein, 312 aa, Canis familiaris
MRNHTKVTEFILLGLTDDPKWQVVLFIFLLVTYMCSVTGNLVIIFLTLTDPHLKTPMYFFLRNFSFLEMSFTSATIPRFLVTVVTGDRTISYNDCLAQVFFVILLGVTEFYLLTAMSYDRYVAICKPLHYMTIMSTRVCILLVFSSWLAGFLVIFPPVILMLKLDFCASNIIDHFVCDSSPIIQLSCTNTHFLELMAFVLAVVTLMVTLTLVMLSYTHIIRTILRIPSTSQRKKAFSTCSSHMIVVSLSYGSCIFMYIKPSAKERVSLNKGVAVIITSVTPLLNPFIYTLRNQQVKQAFKNMVHRMVFSSYK

SEQ ID NO: 1563 - DNA, 942 bp, Canis familiaris
atgaacgacaagggagcgggcaactactcagatgtaactgacttcactcttgtaggcttcagggtccgtccagagctccacattctcctcttcctcctattcctgctggtctatagcatggtccttttggggaactttagtatgattggcatcattgtgactgactcccagctgaacacaccaatgtatttctttctaggcaatctctccttcattgacctctcctactccactattattgccccgaaagccatggtcaacttcctgtctgagaaaaatactgtctcctttttggggtgtgctacccagctcttcttttttaccttctttattgtaacagaaggtttcatcctggcagtcatggcctatgaccgcttcatcgccatctgcaatcctcttctttatagtatccacatgtcaagacacctttgcgctcagctggtgactggctcctatctctgtggctgggtcagttccatcatccaagtcagcacaacattctcagtgtctttctgtgcttcccgagtcattgatcacttctactgtgattcttaccaaattgagaagatctcctgttccaatctctctgtaaacaagatgatatctctttgtttggctgccttcatcattttgcctacgatagttgttattgtcgtgtcttacatgtacattgtgaccacagtcctgaggattccctccagtgaagggagaaagaaagccttctccacctgcagctcccatttgggagtggtaagtttgctgtacgggacagtctcctttgtgtatctcacacctccaagcaatcctgaacttcgtaaagtggcttcggtgttttacatattggtcacgcccatgttaaaccctctgatctactctctaagaaacaaagatgtcaaacaagcattggggaaaatcctgtggaagaaaaccactttatattaa

SEQ ID NO: 1564 - protein, 313 aa, Canis familiaris
MNDKGAGNYSDVTDFTLVGFRVRPELHILLFLLFLLVYSMVLLGNFSMIGIIVTDSQLNTPMYFFLGNLSFIDLSYSTIIAPKAMVNFLSEKNTVSFLGCATQLFFFTFFIVTEGFILAVMAYDRFIAICNPLLYSIHMSRHLCAQLVTGSYLCGWVSSIIQVSTTFSVSFCASRVIDHFYCDSYQIEKISCSNLSVNKMISLCLAAFIILPTIVVIVVSYMYIVTTVLRIPSSEGRKKAFSTCSSHLGVVSLLYGTVSFVYLTPPSNPELRKVASVFYILVTPMLNPLIYSLRNKDVKQALGKILWKKTTLY

SEQ ID NO: 1565 - DNA, 936 bp, Canis familiaris
atgaagagcaagctgagcaggaattcctcaggagtgactgagttcattctgctgggcttcagaacagctccagacatacagatcctcttattcctattcttcttgctggtctacgtggtcactgtggtgggaaatgtcagcatgataattgtcatcaggatggactcgaggcttcacacgcctatgtatttcttccttagacacttgtcctatgtagatctctgctactccacagtcattgctcccaaaactttagccaacttcctgtctcatgaaaagaagatttcctacaatggctgtgcagcccaatttttcttctttgctctgtttgtcacaactgaaagcattcttttggctgtcatggccttcgatcgattctcagccatttgctcccctctcctttaccctgtgcacatgtcccagaaagtgtgcgctcagctggtgactggctcctacatctgtggaggccttaactccatggtccacacaggattcaccttcagcttgcgtttctgtggagaaaaccacctggatcacttcttctgtgacgtctcagccctgatcaagatctcatgtgtagacacgtctgtgaacgagatggtgctgttcatcctctccgccctcatcattgtcaccaccacgactgtcatcctggtttcctatgcttacatactctccactgtcctgaagatcccctccacccacggcaggggtaagaccttctccacctgtggctcccacatggccacggtgactttgttctatgggaccgtgttcttcatgtacgcccagcccggggccatctcctccccagggcaaaacaaggtcgtggctgtgctctacacactcatcatcccaatgctaaaccctctgatatacagtctgagaaacagagacgtgaaagatgctgtgagaagagtgctgcacaggaagtga

SEQ ID NO: 1566 - protein, 311 aa, Canis familiaris
MKSKLSRNSSGVTEFILLGFRTAPDIQILLFLFFLLVYVVTVVGNVSMIIVIRMDSRLHTPMYFFLRHLSYVDLCYSTVIAPKTLANFLSHEKKISYNGCAAQFFFFALFVTTESILLAVMAFDRFSAICSPLLYPVHMSQKVCAQLVTGSYICGGLNSMVHTGFTFSLRFCGENHLDHFFCDVSALIKISCVDTSVNEMVLFILSALIIVTTTTVILVSYAYILSTVLKIPSTHGRGKTFSTCGSHMATVTLFYGTVFFMYAQPGAISSPGQNKVVAVLYTLIIPMLNPLIYSLRNRDVKDAVRRVLHRK

SEQ ID NO: 1567 - DNA, 963 bp, Canis familiaris
atgggtgacaggggaaccagcaatcgctcagaagtgactgacttcattcttgtaggtttcagggtccgccccgagctctacattctcctcttcctgctcttcctccttgtgtatgccatgatcctgctggggaatgttgggatggtggccgttatcctgactgatcccaggctgaacacaccgatgtatttcttcctgggcaacctctccttcattgacctcttctactcctccgtaattgcccccaaggctatgatcaacttctggtctgagagcaagtccatctcctttgcaggctgtgtgacccagctctttctctttgccctcttcattgtggctgaggggtttctcctggctgccatggcttatgaccgcttcattgccatctgcaacccactcctctactccgtccagatgtcaacacgcctctgcatccagttggtggctggttcctatttttgtggctgcttcagttctattcttttgaccagtgtgacatttactttgtccttttgtgcttcccgagccatcgaccacttttactgtgattaccgtccacttcaaaggatttcttgctctgatctctactttcataagatagtttcttttttcttatgcagcattattattttgcccaccatcattgtcattctcgtgtcctatatgtatattgtgtccacagttctaaagataagatccactgagggacgtaagaaagccttctccacttgcagctctcacctaggagtcgtgagcgtcctgtacggtgccatcatttttatgtatttcatccctgacagattccctgagctgagtaaagtggcttctttatgttatacgttagtcactcccatgttgaatcctttgatttactccctgagaaacaaagatgtcaaagaggctctgagaaagatcctggggaaaaagatatttttatttaattccatcttaacagtgatataa

SEQ ID NO: 1568 - protein, 320 aa, Canis familiaris
MGDRGTSNRSEVTDFILVGFRVRPELYILLFLLFLLVYAMILLGNVGMVAVILTDPRLNTPMYFFLGNLSFIDLFYSSVIAPKAMINFWSESKSISFAGCVTQLFLFALFIVAEGFLLAAMAYDRFIAICNPLLYSVQMSTRLCIQLVAGSYFCGCFSSILLTSVTFTLSFCASRAIDHFYCDYRPLQRISCSDLYFHKIVSFFLCSIIILPTIIVILVSYMYIVSTVLKIRSTEGRKKAFSTCSSHLGVVSVLYGAIIFMYFIPDRFPELSKVASLCYTLVTPMLNPLIYSLRNKDVKEALRKILGKKIFLFNSILTVI

SEQ ID NO: 1569 - DNA, 942 bp, Canis familiaris
atgggtgacaggggaacaagcaatggctcagaagtgactgacttcattcttgtaggcttcagggtccgccccgagctctacattctcctcttcctgctcttcctgcttgtgtatgccatgatcctgctggggaatgttggaatggtggccgttatcctgactgatcccaggctgaacacaccgatgtatttctttctgggcaacctctccttcattgacctcttctactcctctgtaattgcccccaaggctatgatcaacttctggtctgagagcaagtccatctcctttgcaggctgtgcgacccagctctttctctttgccctcttcattgtggctgaggggtttctcctggctgccatggcttatgaccgcttcattgccatctgcaacccactcctctactccgtccagatgtcaacgcgtctctgcattcagttggtggctggttcctatttttgtggctgcatcagctcggttcttcagacaagcttgacatttactttgtctttttgtgcttcccgggccattgaccacttttactgtgacactcgtccacttcagaggatatcttgttctgatctgttcatcaacaggataatttctttctccttatctgccatcattattttgcctactatcatagttattcttatttcttacttgtatattgtgtccacagttctaaagataagatccactgagggacgtaagaaagttttctccacttgcagctctcacctaggagtcgtgagtgtcctgtatggtgctgtcttttttatgtatctcactcctgacagatttcctgagctgagtaaagtggcttctttatgttatacgttagtcactcccatgttgaatcctttgatttactccctgagaaacaaagatgttaaagaagctctaaaaaaacttcttgagaagaaaaatacaattgtttga

SEQ ID NO: 1570 - protein, 313 aa, Canis familiaris
MGDRGTSNGSEVTDFILVGFRVRPELYILLFLLFLLVYAMILLGNVGMVAVILTDPRLNTPMYFFLGNLSFIDLFYSSVIAPKAMINFWSESKSISFAGCATQLFLFALFIVAEGFLLAAMAYDRFIAICNPLLYSVQMSTRLCIQLVAGSYFCGCISSVLQTSLTFTLSFCASRAIDHFYCDTRPLQRISCSDLFINRIISFSLSAIIILPTIIVILISYLYIVSTVLKIRSTEGRKKVFSTCSSHLGVVSVLYGAVFFMYLTPDRFPELSKVASLCYTLVTPMLNPLIYSLRNKDVKEALKKLLEKKNTIV

SEQ ID NO: 1571 - DNA, 942 bp, Canis familiaris
atgggtgacaagggaggagacaaccactcagaagtgactgacttcattcttgtaggcatcagggtccgtccagagctccacagtctcctcttcctactattcctggttgtttatgggatggtcctcctggggaaccttagcatgattggcatcattgtgaccgacccccggctgaacacaccaatgtatttcttcctaggcaatctttccatcattgacctctcctactccactgttattgtacccaaagccatggtcaacatcctgtctcagaaaaagaccatctcctttgcaggctgtgtggctcagctatttctttacgcgcttttcatggtcacagaggcctttgtcctggcagccatggcctatgaccgcttcatcgccatctgcaacccgctcctctacactatccgcatgtcaagaagcctctgtatccagttggtggctggctcctatctctgcggctgggtcagctccatccttcaaatcagtgtaaccttctcaatgtctttctgtgcttcccgagtcattgatcacttctactgtgattcaaacccaattgagaagatctcctgttccaatatctttatgaataagatggtgtcatttagtctggctgtcctcattattttgcccacgatagttgttattgtggtatcgtatatgtatattgtgtctgcagttttaaaaatccgctctagtgaagggaggaagaaagccttctccacctgcagctcccacctgggggttgtaagtttgctctatgggacagtctcctttgtctatctcacacccccaagtaaccctgaacttcgtaaagtggcttcagtatgttacattttgttcacacctatgctgaaccctttaatctactctctaagaaataaggatgttaaagatgccatgaaaaaagtcctatggaagaaaaaagttttactttaa

SEQ ID NO: 1572 - protein, 313 aa, Canis familiaris
MGDKGGDNHSEVTDFILVGIRVRPELHSLLFLLFLVVYGMVLLGNLSMIGIIVTDPRLNTPMYFFLGNLSIIDLSYSTVIVPKAMVNILSQKKTISFAGCVAQLFLYALFMVTEAFVLAAMAYDRFIAICNPLLYTIRMSRSLCIQLVAGSYLCGWVSSILQISVTFSMSFCASRVIDHFYCDSNPIEKISCSNIFMNKMVSFSLAVLIILPTIVVIVVSYMYIVSAVLKIRSSEGRKKAFSTCSSHLGVVSLLYGTVSFVYLTPPSNPELRKVASVCYILFTPMLNPLIYSLRNKDVKDAMKKVLWKKKVLL

SEQ ID NO: 1573 - DNA, 447 bp, Canis familiaris
tttctttgaatactgatgactaaagagctgaaagtttgagggcagttgttggtatttgctataaactgctagagattcaatccctccacccactcagtgggttctctagaggagtctttgcttctttcaggccaagagaagttcttagagaaaacatctcatggcctaaagcccagaatattgagtagctccagtaacgtttgcattgttcagttattgtttttcattctgttgggagtcactgaattttacctgctggctgccatgtcctatgaccaatacaatgccatctgcaaacctgtgcattacatgaccatcatgaatcagagtctgcatactccttgcttactcttcatggctgatttccttcttaatcatattccctgtgctcatgttgctcttaattactgtaggcctgatattattgaccatttcacctgtgattat

SEQ ID NO: 1574 - protein, 61 aa, Canis familiaris
MSYDQYNAICKPVHYMTIMNQSLHTPCLLFMADFLLNHIPCAHVALNYCRPDIIDHFTCDY

SEQ ID NO: 1575 - DNA, 975 bp, Canis familiaris
atgagaaaccatacaatgattacagagttcgttctcttgggcatctcagatgacccacagcttcaggttgtaatctttatctttttatttatggcttatgtattaagtgtcactggaaacctaaccatcatcatcctcaccttgatagactgtcatctcaagactcctatttattatttcctgcagaatttctccttcttagaaattacattcaccagtgtttgtatccccagatttttggggacaatcgttactaaaatcaagactgtttcctataacagttgtgtagctcaactattttttatcatcctcacgggtgttactgaatttccccttctcactgtcatggcttttgatcgttatgttgccatctgtaagcctcttcattatatcatcatcatgaacaagaaaatctgtaccctgcttgtctttgggtcctggttactaggatttcttaccattttcccaccactcatcctcatcctccagctagatttctgtgcttccaacgtaattgatcatttctgttgtgactatttccccattttacaactctcatgctcagatacatggcttttagagatgattggcttttacttcgcttttgttattcttttcttcacattggcattagtgattcaatcctacgtgagcatccttagcaccattctgagactcccatctgctagtcaaaggaaaaaggctttatccacgtgttcctctcacttgattgtcatttccatctcttatgggagctgtatattcatgtatgtcaagccttcagcaaaagaaagagcatcactgaccaaaggagtagctattctcaacacctcgattgcccccatgttgaacccttttatttataccctgaggaaccagcaagttaaacaagctttgaagaacttgcttcacaaagtagcattttctatcagagagggagacaaaacatggaagactcctaactctgggaaatga

SEQ ID NO: 1576 - protein, 324 aa, Canis familiaris
MRNHTMITEFVLLGISDDPQLQVVIFIFLFMAYVLSVTGNLTIIILTLIDCHLKTPIYYFLQNFSFLEITFTSVCIPRFLGTIVTKIKTVSYNSCVAQLFFIILTGVTEFPLLTVMAFDRYVAICKPLHYIIIMNKKICTLLVFGSWLLGFLTIFPPLILILQLDFCASNVIDHFCCDYFPILQLSCSDTWLLEMIGFYFAFVILFFTLALVIQSYVSILSTILRLPSASQRKKALSTCSSHLIVISISYGSCIFMYVKPSAKERASLTKGVAILNTSIAPMLNPFIYTLRNQQVKQALKNLLHKVAFSIREGDKTWKTPNSGK

SEQ ID NO: 1577 - DNA, 939 bp, Canis familiaris
atgaggaatcagtcaacaaagatcgagttcattctcctgggactgaccgatgacccacaactgcaaattgtgatttttacatttctcttcatcaactatgtgctgagcatgactggaaacttaaccatcatccttctcaccctgctacatcccagcctcaagactcccatgtattttttcctccgaaatttctcctttatggaagcttcactgacaacagtctgtattcccagattcctgataagcctcataactaaaaacaaagtcatttcctacaattgttgtgcatctcagttattctttttcctccaattagaaattgcagaattttacctgctggctgccatgtcctttgaccgttatgtagcaatctgcaaacccctgcattacctgatcatcatgaacaacaaaatgtgctaccaactcctgttcagctcatgggccgtgggctttctgctatcgtttccaccattggctgtgggcctcacactggatttctgtgcttccagagtaatcgatcatttcatgtgtgacatttcccctgtgctgcagctttcctgcactgacactcgtttcttggaattgctttcgtttgtcttatctcttgtaacacttctgatcacgttgctgttactgattctttcttacacatacattatcaagaccattctcaagatcccctctgctcagaaaagaaccaaggctttttctacttgttcttctcatatgattgtggtctcccttacgtatggtagctgcatctttaattacctaaagccaacagcgaaggaaagggtgactttgtccaaaggtgtaagtgttatttatacctcggttgcccctttattaaaccctttcatttacagtctcagaaaccaacaagtcaaacaagccttcaaggatgcacgccaaaagatttgctctttttccaaaaaatga

SEQ ID NO: 1578 - protein, 312 aa, Canis familiaris
MRNQSTKIEFILLGLTDDPQLQIVIFTFLFINYVLSMTGNLTIILLTLLHPSLKTPMYFFLRNFSFMEASLTTVCIPRFLISLITKNKVISYNCCASQLFFFLQLEIAEFYLLAAMSFDRYVAICKPLHYLIIMNNKMCYQLLFSSWAVGFLLSFPPLAVGLTLDFCASRVIDHFMCDISPVLQLSCTDTRFLELLSFVLSLVTLLITLLLLILSYTYIIKTILKIPSAQKRTKAFSTCSSHMIVVSLTYGSCIFNYLKPTAKERVTLSKGVSVIYTSVAPLLNPFIYSLRNQQVKQAFKDARQKICSFSKK

SEQ ID NO: 1579 - DNA, 945 bp, Canis familiaris
atgaaaaaccattcaacggaaatagagtttattctcctaggactgacagatgacccacaattgcaagttgtgatttttgtgtttttatttcttaattacactttgagcctgatggggaacttaaccattatcctcctcaccctgctggatcctcgcctcaagatgccaatgtatttctttctccgtaatttctcatttctagaaatcatattcacaacggtatgtattcccagatacttgaaaaccatagtgactaaagaaaaaaccatctcatataataattgtgcggctcaattattttttattcttttactgggagttacagagttttaccttctggctgctatgtcctatgaccgctatgttgccatctgcaaacccttgcattacccaatcattatgaacagccgagtgtgctatcagcttgtacttgcttcttggctgactggattcctaatcatctttcccccattgctcatgggactcaagctggatttctgtgcttccaaaacgattgatcactttatgtgtgaaacttcccccatcctgcagatatcctgcacagacacacatgtcctagaattgatgtctttcatcttcgccgtggtgacacttgtggtcacattggtgttagtggttctctcctacacttgcatcatgaagaccattatgaaattcccttctgcacagcaaagggccaaagctttttccacctgtacttcccatatgattgttgtctccatgacatatgggagctgcatctttatgtatattaagccatctgccaaagaaagggtgactgtatccaaaggtgtagctttgctgtatacctcaatcgcccctttactaaatcccttcatttataccctaaggaaccagcaggtgaaagaagtcttctgggatatgttacaaaaaaggttgtatttttcaaaaaaaaaattgtga

SEQ ID NO: 1580 - protein, 314 aa, Canis familiaris
MKNHSTEIEFILLGLTDDPQLQVVIFVFLFLNYTLSLMGNLTIILLTLLDPRLKMPMYFFLRNFSFLEIIFTTVCIPRYLKTIVTKEKTISYNNCAAQLFFILLLGVTEFYLLAAMSYDRYVAICKPLHYPIIMNSRVCYQLVLASWLTGFLIIFPPLLMGLKLDFCASKTIDHFMCETSPILQISCTDTHVLELMSFIFAVVTLVVTLVLVVLSYTCIMKTIMKFPSAQQRAKAFSTCTSHMIVVSMTYGSCIFMYIKPSAKERVTVSKGVALLYTSIAPLLNPFIYTLRNQQVKEVFWDMLQKRLYFSKKKL

SEQ ID NO: 1581 - DNA, 939 bp, Canis familiaris
atgggaaatcacacacaagggatagtgtttatcctggcaggtctgactgatgatccacaactgaaagttacgctatttgtcttcctgcttctcacctacttgctgagcatctctggcaacttaaccatcatcacactcaccctggtggatactcatctcaagacccccatgtattttttccttcggaatttttccttcttagaaatttcctatactactacatgcatccctaaattgttggttactatggcaactggagacaaaaccatttcctataataattgcattactcaattgttttttgccttccttcttggtgcatctgaattttacttgctggcagctatgtcctatgaccgctatgttgccatttgtaagcccctgcattacacaaccatcatgagcagtaagatctgcatgcaacttgtcttctgttgttggcttgcaggattctttaccatctttgtacccctcctattgggtctaaaccttgacttctgtgcttcccacattgttgatcacttctactgtgacacaacacccctgctgcagatctcctgctcggacacacagctcttagagacaatgggatttatttctgcatcgatgacacttgtggtcacattaatcatggtgataatatcctatacctttattgcattaacaatcctaaaaataccttcaactaaacagaagaaaaaggctttttcaacatgttcttctcacatgattgtgatatccctttcttacggcagctgcatcttcatgtatgttaagccatcggtcaaacaaagaatatctttctccaagggaattgcagtgctcaacacctccgtggctccacttttgaatcctttcatctatactctgaggaaccagcaagtaaaaacagccttcatgaacatggtacaaagggttgtttctttcttaagcaaatga

SEQ ID NO: 1582 - protein, 312 aa, Canis familiaris
MGNHTQGIVFILAGLTDDPQLKVTLFVFLLLTYLLSISGNLTIITLTLVDTHLKTPMYFFLRNFSFLEISYTTTCIPKLLVTMATGDKTISYNNCITQLFFAFLLGASEFYLLAAMSYDRYVAICKPLHYTTIMSSKICMQLVFCCWLAGFFTIFVPLLLGLNLDFCASHIVDHFYCDTTPLLQISCSDTQLLETMGFISASMTLVVTLIMVIISYTFIALTILKIPSTKQKKKAFSTCSSHMIVISLSYGSCIFMYVKPSVKQRISFSKGIAVLNTSVAPLLNPFIYTLRNQQVKTAFMNMVQRVVSFLSK

SEQ ID NO: 1583 - DNA, 645 bp, Canis familiaris
caactgttttttaccttccttcttggtgcatctgaattttgcttgctgccagctatgtcctatgaccgctatgttgccatttgtaagcccctgcattacacaaccatcatgagcagtaagatctgcatgcaacttgtcttctgttgttggcttgctgggtcttttgtcatctttccacctctcctcttaggcttaaattttgacttctctgctttcaatattgttgatcatttctactgtgccacaacctccctgctgcagatctcctgctcagacacacagctcttagtgacaatgggatccatctctgctttggtgacactcatagtcacattggtaatggtgataatatcatatacctatattgcattaagaattctaaaaatcctttcagtcaatcagaggaaaaaggctttttcaacatgttcttctcacatgattatgatatccctttcttacggcagctgcatcttcatgtatgttaagccattagtcaaacaaagaacatctttttccaagggaattgcagtgctcaacacctccgtggctccacttttgaatcctttcatctacattttgtggaaccagcaagtaaaaacggccttcatgaacatggtacacaaaattgtttctttcccaaacaaa

SEQ ID NO: 1584 - protein, 215 aa, Canis familiaris
QLFFTFLLGASEFCLLPAMSYDRYVAICKPLHYTTIMSSKICMQLVFCCWLAGSFVIFPPLLLGLNFDFSAFNIVDHFYCATTSLLQISCSDTQLLVTMGSISALVTLIVTLVMVIISYTYIALRILKILSVNQRKKAFSTCSSHMIMISLSYGSCIFMYVKPLVKQRTSFSKGIAVLNTSVAPLLNPFIYILWNQQVKTAFMNMVHKIVSFPNK

SEQ ID NO: 1585 - DNA, 201 bp, Canis familiaris
gtgggaaaccacatgcaagggatagtgtttatcctggcaggtctgactgatgatccacaattgaaagttgtgttatttgtcttcctgcttctcacctacttgctgagcatctttggcaacttaaccatcatcacactcaccctggtggatactcatctcaagacccccatgtattttttccttctcaaaaatttcctatac

SEQ ID NO: 1586 - protein, 67 aa, Canis familiaris
VGNHMQGIVFILAGLTDDPQLKVVLFVFLLLTYLLSIFGNLTIITLTLVDTHLKTPMYFFLLKNFLY

SEQ ID NO: 1587 - DNA, 939 bp, Canis familiaris
atgagaaaccacaccacagtaacaacttttattcttcttggactgactgataatccacaattgcaagtggtcattttccttctcctgtttttcacatacatgttgagtgtcactatgaatctaaccataatcatcctcaccctactggattctcatctaaaaacacccatgtatttcttcctccgaagtttctcatttttagaggtctcattcacaactgtctgcatccccaaatttcttgtcagcatggcaacgggtgataggaccatttcttacaacagttgtgcgacacagctgttttttactattgtcttgggtgcaattgaattttttcttctggctgccatgtcttatgaccgctatgttgccatttgcaaacccctgcattacaccaccatcatgaatgacagagtctgcaacttgttggtctttgcttcatggttagctggttttatagtagtcgttccaccactccttgtgggtctccagctagatttctgtgccgccaacactatagatcatttcttctgtgatttttctcctatattacagctctcttgcacagatacagatgtaatagaattaatggcgcttctctcagccattttgaccctcctggttacactggtattagtgatcctctcctatgcaaacatcatcaggactattctgaagataccttcttctcaacaaaggaagaaagccttttctacatgttcttctcacatggtggttgtatccatttcatatggcagctgcatcttcatgtatgtgaaaccctctgcaaaggatagagtatctttaaataaagggatagccctgctcagtacctctgttgcccccatgttgaatcccttcatttatacactgagaaacaaacaagtgaaagatgcttttatgcacatgaccaaaaagatggagattttctcagtgaagtga

SEQ ID NO: 1588 - protein, 312 aa, Canis familiaris
MRNHTTVTTFILLGLTDNPQLQVVIFLLLFFTYMLSVTMNLTIIILTLLDSHLKTPMYFFLRSFSFLEVSFTTVCIPKFLVSMATGDRTISYNSCATQLFFTIVLGAIEFFLLAAMSYDRYVAICKPLHYTTIMNDRVCNLLVFASWLAGFIVVVPPLLVGLQLDFCAANTIDHFFCDFSPILQLSCTDTDVIELMALLSAILTLLVTLVLVILSYANIIRTILKIPSSQQRKKAFSTCSSHMVVVSISYGSCIFMYVKPSAKDRVSLNKGIALLSTSVAPMLNPFIYTLRNKQVKDAFMHMTKKMEIFSVK

SEQ ID NO: 1589 - DNA, 936 bp, Canis familiaris
atggctttgaggaaccacagcaccatcacagagttcatcctccttgggctgtctgttgactctcacatccaggttctgctctttgtgcttttccttgggatttacctcttgactattttgggaaatttattgatgctgttggtcatcaaggctgattcccacctccacacacctatgtacttcttcctgagtcacctctctctcacggacttttgtttctctactgccatagtgcccaggttgctggagaacctcctgtcccagaggaaaaccatctcagtggagggctgcctggctcaagtcttctttctgtttgactttggaggaacagaagtctgcctactgtcagcaatggcctatgatcgttatgctgctatctgtcatccactcctctatggccaggtgatgaataatcagctgtatatgcagcttgtatggggttcatggagcctggggtttctagatgcactcattaacatcaccttagtaacaaacctggatttctgtaaggcccataccatcccccactatagctgtgagctgccctcccttttccctttgtcctgctctgatgtctctaccaacctcactgtcctgctctgttccacactcctgcatggctttggtacattcttcctgatattcttctcctatgcacgcattgtctccaccatcctgagcatcagctcctcctcaggcagaagcaaggccttctccacctgctcctcccacctcactgcagtgagcttcttctatggctcagctttcctgcgtcatctcatgccaacctcaggctcacctctggagctgatcttctccatacagtatagtgtggtaactcccctagtaaaccccttcatctacagcctgaaaaacagggagattaaaaatgcactgagaagaaccttggggaagtttttgcaacagtacaggtag

SEQ ID NO: 1590 - protein, 311 aa, Canis familiaris
MALRNHSTITEFILLGLSVDSHIQVLLFVLFLGIYLLTILGNLLMLLVIKADSHLHTPMYFFLSHLSLTDFCFSTAIVPRLLENLLSQRKTISVEGCLAQVFFLFDFGGTEVCLLSAMAYDRYAAICHPLLYGQVMNNQLYMQLVWGSWSLGFLDALINITLVTNLDFCKAHTIPHYSCELPSLFPLSCSDVSTNLTVLLCSTLLHGFGTFFLIFFSYARIVSTILSISSSSGRSKAFSTCSSHLTAVSFFYGSAFLRHLMPTSGSPLELIFSIQYSVVTPLVNPFIYSLKNREIKNALRRTLGKFLQQYR

SEQ ID NO: 1591 - DNA, 936 bp, Canis familiaris
atggccttgggaaaccacagcaccatcactgaattcctccttcttggactgcctgctgatcatcatacccaggccctaatctttgtgcttttcctggtaatttacctcctgactctgtcagggaacctgctgatgatcttggttatcagagctaactcacactttcacacacccatgtacttcttcttgaatcacctctccttcctggatctctgttactcttcggtcactgttcccaagatgctagagaacctcctgtctgagaagaaaaccatttcagtggaggactgtttgacgcaggccttctttgtgcttgcctctgggggaacagagctctgcctccttgcagtgatggcatatgaccgctatgctgccatttgctaccctctactctatggtcagatgatgaacaatgagctgtgtgtgggactggtatggggatcttggggtctggcctttttggatgcattcatcaataccctcctagcttggaatttggacttctgtgagactcaagtcatctcgaatttcatttgtgagattccttctctgttccctctatcctgttccaatagctctgttaactttgtagtcctgctctgctctgccctcctgcatgcctttgggaccttcattctggtcttcttctcttatacacgcattgttgccaccatcctaagcatcagctctacctcaggcagacacaaggccttctccacctgctcctcccacctcaccacagtgagcttattttatggctcaggttttcttcgctatctcatgccaacctcaggttctccatgggagttggttttttccatgcagtacagtgtggtcactcccctagtgaatccccttgtctacagccttaaaaacaaggaagttaaagcagctctgaaaaacatgttgcagaaacatttaaaacgtcttagatag

SEQ ID NO: 1592 - protein, 311 aa, Canis familiaris
MALGNHSTITEFLLLGLPADHHTQALIFVLFLVIYLLTLSGNLLMILVIRANSHFHTPMYFFLNHLSFLDLCYSSVTVPKMLENLLSEKKTISVEDCLTQAFFVLASGGTELCLLAVMAYDRYAAICYPLLYGQMMNNELCVGLVWGSWGLAFLDAFINTLLAWNLDFCETQVISNFICEIPSLFPLSCSNSSVNFVVLLCSALLHAFGTFILVFFSYTRIVATILSISSTSGRHKAFSTCSSHLTTVSLFYGSGFLRYLMPTSGSPWELVFSMQYSVVTPLVNPLVYSLKNKEVKAALKNMLQKHLKRLR

SEQ ID NO: 1593 - DNA, 639 bp, Canis familiaris
gatccccatttccctgcctccatgtacttcttcctcaatcacttctctttactggatctttgctattccttagtcaccatacccaaaatgctggagaaactcttgtttcagaggaaatcaatctcagtagaggctgactcaggtttatgtatgtgtgtgtgttgtactgcagggattgaggcttttctgctctaagtgatgacttataaccactctactgcctgccatctgccacctcctgctctgtggtcagcctatgagtaaacagttgtgtaggtctcatggagactagaatttgggatgttcatggcttggaatttggacttctgtgaggctcacgttatgccttacttcagttgtcagctgcctcttctatttcctctgttctgctctgatatctccaccaaatttgcagtcctcatgtgctctgccatcattcatgcccttttgaccatcctcctaatcctcttctcttccacttacattattaccatcctcctgagcattagctccatcacaggcagaagcaaggccttctccacctgctcctcccacctcaatgcaacgactttttcttaaggctcaagttttctttactatctcaggctaacctctggttccccactggaggtggttttt

SEQ ID NO: 1594 - protein, 64 aa, Canis familiaris
DPHFPASMYFFLNHFSLLDLCYSLVTIPKMLEKLLFQRKSISVEADSGLCMCVCCTAGIEAFLL

SEQ ID NO: 1595 - DNA, 939 bp, Canis familiaris
atggacttggggaaccacagcaccatcacggagtttatcctccttgggctctctgctgaccctcacatccaggttgcactctttgttctcttcctggggatttacctcctgactgtgatggggaacctgattatgctgctggtgatcaggactgattcccacctccatacacccatgtacttcttcctgagtcacctctcttttgttgatatctgcttctcttcggtcactgtgcccaagatgctggagaaccttctttctcaaaagaaaaccatctcagtagagtgctgcctcactcaagtcttcttcgtgtttgttgctgcaggaactgaagcctgtctgctctcagtgatggcctatgaccgctatgctgccatctgccacccactgctctatggacagatcatgaataaacagctgtatatgcagcttgtatggggatcatggggactgagctttctggatgcactcatcaacatctttctagctatgaagatggtcttctgcaaagcccaaatcatcccccactacagctgtgaaatgccctctctcctctcattgtcctgttctgatacctccaaaaacctcattgccttgctctgctccactcttctgcatgggctgggaaccttccttttggtcttcttatcctatgcccgtattattgccactatcctgagcatcagctccacctcaggcagaagcaaggccttctccacctgctcctcacacctcactgcagtgactctttattatggctcaggtttgctccgccatctcatgccaaattcaggatcccccctcgagttgatcttttctgtacagtatactgtagtcactcctgtgctgaatcctctcatctacagcctgaagaacaaggaggtgaaggcagctctgacacgaactatggaaaagtatttgcaacatatcaggtgctga

SEQ ID NO: 1596 - protein, 312 aa, Canis familiaris
MDLGNHSTITEFILLGLSADPHIQVALFVLFLGIYLLTVMGNLIMLLVIRTDSHLHTPMYFFLSHLSFVDICFSSVTVPKMLENLLSQKKTISVECCLTQVFFVFVAAGTEACLLSVMAYDRYAAICHPLLYGQIMNKQLYMQLVWGSWGLSFLDALINIFLAMKMVFCKAQIIPHYSCEMPSLLSLSCSDTSKNLIALLCSTLLHGLGTFLLVFLSYARIIATILSISSTSGRSKAFSTCSSHLTAVTLYYGSGLLRHLMPNSGSPLELIFSVQYTVVTPVLNPLIYSLKNKEVKAALTRTMEKYLQHIRC

SEQ ID NO: 1597 - DNA, 906 bp, Canis familiaris
atgggcttgtggaaccacagaaccatcacccaattccttctccttgggctatctactgaccccccatgcccaggctgcactctttgtgctgttcctgaacatttacctgctgaccatcatggggaacctgctgctgctgatggtgatcagagctgactctcacctccacgtgcccgtgtactttttccttgtcatctctctttcctgggcttttgtttatcttcagttattgtgcctaagatgctgaaagacctcctagcagagataaaaaccatctcagtaaggggctgcctggctcaaggtttctttgtgtttatccctgcaggaactgagggctttctactctcagtgatggcctatgaccactttgctgacatccgccatcctctgctctatggacagatgatgaggaaacagctgtgtgtacagcttgtgtgggtctcatgggtcgtgggtggtttgaatacgctcatcaacatcctccgagctacccacttggacttctgtgagagccataccaccagccactacagctatgaggtgccctctctcttccctttgtcttgctctgatgtcttcaccaacctcatagtgctgttctgctccactctgcttcatggggttgggaccttcttcccaatcatttcatcctatgcctgcattgtctccaccatcctgagcatcagctcctcctcaggcagaagcaaagccttctccacctgcccctctcacctcattgtggtgagcttcttctatggatctgcttttctcagctatctcatgccaaattctggataccccctagagttgatctctatacagtatggtgtggtcattcccatgctgaatcctctcatctacagcctgaagaacaaggaggtgaaggcagctgtgagaaggaaattg

SEQ ID NO: 1598 - protein, 222 aa, Canis familiaris
MLKDLLAEIKTISVRGCLAQGFFVFIPAGTEGFLLSVMAYDHFADIRHPLLYGQMMRKQLCVQLVWVSWVVGGLNTLINILRATHLDFCESHTTSHYSYEVPSLFPLSCSDVFTNLIVLFCSTLLHGVGTFFPIISSYACIVSTILSISSSSGRSKAFSTCPSHLIVVSFFYGSAFLSYLMPNSGYPLELISIQYGVVIPMLNPLIYSLKNKEVKAAVRRKL

SEQ ID NO: 1599 - DNA, 918 bp, Canis familiaris
atgagaaaccacagtgttgtttctgagttcattctccttgggctgtctgctgacccccagatccaggctctgctctttatgctgttccttgttatttacctcctgaccctgatggggaacctgctactgctgctggtgattagagctgattctcaccttcacagccccatgtacttcttcctgggacagttgtccttcctggatctctgccactcctctgtcactgtgcccaagcttttggagaaccttctgtctgagaagaaaaccatctcagtagagggctgcctcgctcaggtcttctttgtgtttgccactgggggcactgaatcctgcctacttgctgtcatggcctatgaccgctatgttgccatcagctcccctctgctctatggccagatgatgaacagaccactgtgtatggggctggtttggggctcatggagcttagcttttctggatgctcttatcaatatccttgtagctctcaatttagacttctgtgaggctcagaatatacaccacttcagctgtgagctgccatctctctaccctttgtcttgctctgatgtgtctgcaagttttactgccctgctctgctccagcctcctgcatttctttggaaatttcctcctgatatttttctcctatgttcgcattttatccaccatcctgagcatcagttctaccacaggcagaagcaaggccttctccacctgctcctcccacctcactgcagtgatcttcttttatggctcagggttactccgttatctcatgccaaattcaggatccactcaagagttaatcttttccttgcagtatagcgtggtcactcctatgctgaatcctctcatctatagcctgaagaacaaagaggtgaaggcagctgtgagaagaattttgagaaaatgtgtctag

SEQ ID NO: 1600 - protein, 305 aa, Canis familiaris
MRNHSVVSEFILLGLSADPQIQALLFMLFLVIYLLTLMGNLLLLLVIRADSHLHSPMYFFLGQLSFLDLCHSSVTVPKLLENLLSEKKTISVEGCLAQVFFVFATGGTESCLLAVMAYDRYVAISSPLLYGQMMNRPLCMGLVWGSWSLAFLDALINILVALNLDFCEAQNIHHFSCELPSLYPLSCSDVSASFTALLCSSLLHFFGNFLLIFFSYVRILSTILSISSTTGRSKAFSTCSSHLTAVIFFYGSGLLRYLMPNSGSTQELIFSLQYSVVTPMLNPLIYSLKNKEVKAAVRRILRKCV

SEQ ID NO: 1601 - DNA, 936 bp, Canis familiaris
atggcaatgaaaaactacagtgctatcagtgagttcattcttcttggactatctattgaccccagtattcaggtaatactctttgtgctattccttctgatttatctcttcactctgatgggaaatttcttgatgctcttggtgattagggctgattctcacctccacatacccatgtacttctttttgcaacaactctccttcctggacctctgccactcatctgtcacagtccccaagatgctggagaatctactttctgagagtaaaactatctttgtagaaagctgcctagctcaggccttctttgtgtttgccacagggggcactgaggcctgtctgctggctgtgatggcctatgaccgctgtatagccatcacctcccctctgctctatggccaggtgatgaacaaccaactctgtgttgggatggtgtggagttcctggggcctggcctttgctgatgctctcatcaatatcctcttggctgtcaatttagactattgtgaggaccagactattccccatttcagctgtgagctgtcttctctcttccctctgtcttgctctgatacctccaccaatttcacacttctgctctgctcctctttcctgcatttctttggaaccttcctaatgattgttttgtcctatgcccgcattgtcttcaccatcctgagcatcagctctacctcaggcagaggcaaggctttctccacctgctcctcccaccttactactgtgatcttgttctatggctcaggtttcctcagctatctcttgccaacttcaggctcccctctggagatgatgttctccttgcaatatagtgtcattactcccatgctgaacccgctcatttacagcttgcagaacaaggaggtgaaggcagctatgggaagaatcttcagaaaatatttctattctttaatgtag

SEQ ID NO: 1602 - protein, 311 aa, Canis familiaris
MAMKNYSAISEFILLGLSIDPSIQVILFVLFLLIYLFTLMGNFLMLLVIRADSHLHIPMYFFLQQLSFLDLCHSSVTVPKMLENLLSESKTIFVESCLAQAFFVFATGGTEACLLAVMAYDRCIAITSPLLYGQVMNNQLCVGMVWSSWGLAFADALINILLAVNLDYCEDQTIPHFSCELSSLFPLSCSDTSTNFTLLLCSSFLHFFGTFLMIVLSYARIVFTILSISSTSGRGKAFSTCSSHLTTVILFYGSGFLSYLLPTSGSPLEMMFSLQYSVITPMLNPLIYSLQNKEVKAAMGRIFRKYFYSLM

SEQ ID NO: 1603 - DNA, 738 bp, Canis familiaris
atcactatgggaaaccatagcatgttcagtgagtccatcctccttaggttgtctgctgaccctcagacctggattctgctctccatgttgtttctggtgctttacctcctcactctgatgggaaacctggtgatgctgctggtgatgagggctaattctcaccttccctgtacttctcctatgcccatgtacttctttttgagacaactccccttcctggacctctgccactcatctatcacagtccccaagatgatggagactatcctatcttctgaaagcacagtcatctttgtagagagctgtctggctcaagccttctttgtgtttgccacagggggcactgaggcctttctgcaggctgtggtggcctatgaccactttgtagccatcacctcccctctgctctagggccaggtgatgaacaaccagctctgtgttgggatggtgtggagttcctggggcctggcctttgctgatgctctcatcaatatcctcttggttgtcaatttagactattgtgaggaccagactattccccatttcagctgtgagcggtcttctctcttccctttgtcttgctctgatacctccaccaatttcgcactcctgctctgctcctctgtcttgcatttctttggaaccttcctaatgattgtttcttcccatgcctgcattgtttccaccatcctcagcatcagctccatctcttgtaggtgtgaggccttttttacttgt

SEQ ID NO: 1604 - protein, 136 aa, Canis familiaris
ITMGNHSMFSESILLRLSADPQTWILLSMLFLVLYLLTLMGNLVMLLVMRANSHLPCTSPMPMYFFLRQLPFLDLCHSSITVPKMMETILSSESTVIFVESCLAQAFFVFATGGTEAFLQAVVAYDHFVAITSPLL

SEQ ID NO: 1605 - DNA, 822 bp, Canis familiaris
ctggtgatttacctcttgaccttgatggggaatctgatgatgatcctggtgatcagaaatgattctcaccttaaaacacccatgtacttcttcctaggtcacctgtcatttctagatctctgcctttcttcagtaacgatgcctaagatgctgcagaatttattagctcaaaagaaaactatttctacatggggctgtgtgacccagagtttctttctcatattttctgggagcacagaggcctgcttactgtcagccatggcctatgaccgctatgctgccatctgccaccctctcctatatagtgtggttatgaataggcctctctgtgttgggatgataattgcagcatgggcagtggggttcctaaactccttgccaaatagtcttttcacctacaacttacatttctgtggccccaatgtcatccctcacttttgctgtgagcttccttctctcttccctctgtcctgcactgacgctactgccaatgaggtccttcttgctgggtcatgtgcattgttgggatttgtgacacttcccctcatcctcttctcttattctagaatcatctctgccatcctagtcatccgttcttctgggggtcaaggcaaagccttctctacctgttcttcccacctcactgtggtgcttttgtactatggcacagctttattcaggtacatgactcccctctcaggctctaagttggaacaagtggtttccattcagtacagtgtgatcacatctttgctgaaccccctcatctatagcctcaagaaccaggaggtgaaggcagctctgcataaaatgttgaagcaa

SEQ ID NO: 1606 - protein, 274 aa, Canis familiaris
LVIYLLTLMGNLMMILVIRNDSHLKTPMYFFLGHLSFLDLCLSSVTMPKMLQNLLAQKKTISTWGCVTQSFFLIFSGSTEACLLSAMAYDRYAAICHPLLYSVVMNRPLCVGMIIAAWAVGFLNSLPNSLFTYNLHFCGPNVIPHFCCELPSLFPLSCTDATANEVLLAGSCALLGFVTLPLILFSYSRIISAILVIRSSGGQGKAFSTCSSHLTVVLLYYGTALFRYMTPLSGSKLEQVVSIQYSVITSLLNPLIYSLKNQEVKAALHKMLKQ

SEQ ID NO: 1607 - DNA, 912 bp, Canis familiaris
atgaacaacttcactttcttcactgagttcatcctccttgggctgtctgctgactgccacgtccagactctgctctttgtgctgtttctgggaatttacctcctgactctgatggggaatctggtgatgatcctcgtgatcaggggggattctcacctccatatccccatgtattttttccttggacacctgtccttcctagatatctgcttctcctcagttactatgcccaaaatgctgcagaacttcctgtctgagaagaaaagcatctcggtctggggctgcatcacccagagtttcttttttcttctctctgggtgtgctgaagccagtcttctctctgccatggcctatgaccgctatgctgctgtctgctaccctctgctctataccatggtcatgaacagatctctttgcatagtaatggttagtgcagcatgggtgatggggtttctgaactcactagtgaataatcttttcatccacaagttacatttttgtgggtccaatgtcatctcccacttctgctgcgagctaccctcactcttccctctgtcatgtactgatcccactgccaacaaattccttctgtcagggtccagtgcatttctgggactgctgacacttcccctgatcctcttctcttactccagaatcatttctgccattctgaacatccgctcctctgagggccaagccaaagccttctccacctgctcctcccacctcaccgtggtactcttgttctatgggacagctctattcaggtacatcagccctgcctcaggctcggtgttggagcgagtggtctccattcagtacagtgtgatcacatctttggtgaaccccctcatctacagtctcaagaaccaagaggtgaaggcagctctgcagaggctgctgaggcaataa

SEQ ID NO: 1608 - protein, 303 aa, Canis familiaris
MNNFTFFTEFILLGLSADCHVQTLLFVLFLGIYLLTLMGNLVMILVIRGDSHLHIPMYFFLGHLSFLDICFSSVTMPKMLQNFLSEKKSISVWGCITQSFFFLLSGCAEASLLSAMAYDRYAAVCYPLLYTMVMNRSLCIVMVSAAWVMGFLNSLVNNLFIHKLHFCGSNVISHFCCELPSLFPLSCTDPTANKFLLSGSSAFLGLLTLPLILFSYSRIISAILNIRSSEGQAKAFSTCSSHLTVVLLFYGTALFRYISPASGSVLERVVSIQYSVITSLVNPLIYSLKNQEVKAALQRLLRQ

SEQ ID NO: 1609 - DNA, 912 bp, Canis familiaris
gaaaaccagaccacctggctgatcctggttggctttggggatctgcaacacctaggcttcctccccttcaccttctttttggccatttatgtggtaacagttgggggcaacgccctcatcgtgctggctgtggcctccagtcggacactccacacacccatgtatttcttcctctgccacttctccttgctggagattggttatacctccaacatcatgcctcagctgctgtggagctttctggaagggagggaagccatctcactggtcagctgtctggtccagttctacgtgtttgcctccctggctgctgttgagtgcctcctgctatctgctatgtcctatgaccgttacttggccatctgccaccctcttcgctaccctgccctgatgagcacctggttgtgtggctgcctcgctgctggagcctgggtcagtggcttttctttctctgccttcactctggccctggcagcccctcttcccctctgccctggcagcagggagatcgaccactacttctgtgactttgctccagttgtagggctgttctgtggggatgtgggggtcatgtggggagctggggtgagcatctcaggctttctgacattggcccccttcctgttgattgtggcaccccttcctgttgattgtggcacctatgccttcatcttgaggactgtgctgcaaataccttcaggccatggtaggcagaaagccttctccacctgttcctcccacctcagcgtggtcggggtgttttatggcaccctcattgtggtctatgtagccccaacagaccacatggcccccttgctccgaaaggccttctctgtcctctatactgtattcactcctatggtcaaccccatcatttacagcctcaagaaccaagaggtaaagggggccctt

SEQ ID NO: 1610 - protein, 304 aa, Canis familiaris
ENQTTWLILVGFGDLQHLGFLPFTFFLAIYVVTVGGNALIVLAVASSRTLHTPMYFFLCHFSLLEIGYTSNIMPQLLWSFLEGREAISLVSCLVQFYVFASLAAVECLLLSAMSYDRYLAICHPLRYPALMSTWLCGCLAAGAWVSGFSFSAFTLALAAPLPLCPGSREIDHYFCDFAPVVGLFCGDVGVMWGAGVSISGFLTLAPFLLIVAPLPVDCGTYAFILRTVLQIPSGHGRQKAFSTCSSHLSVVGVFYGTLIVVYVAPTDHMAPLLRKAFSVLYTVFTPMVNPIIYSLKNQEVKGAL

SEQ ID NO: 1611 - DNA, 930 bp, Canis familiaris
atgaaaaacgtcagtataattactgaatttgtccttctgggattgtctagtgatccccagatccagactatgctctttgtgctgttcctggggatttaccttctgactttgatgggaaatctggtgatgatcctggtgatcagggttgattctcatctccaaacacccatgtacttcttcctcggacacttatccttcctggatctcagtttctcctcagtcactgtgcccaaaatgctacagaacttcttatctcagaagaaaagcatctcggtgtggggttgcatcactcagagtttctttttcactctctctggaggaacagaagcttgtctgctctctgccatggcctatgaccgctatgctgccatctgctaccctctggtctacaccatggtcataaacaggcctctctgtattgtgactgtgagtatagcttggacagtgggatttctgatttccttgatgaatattcttttcatctacaagttacatttctgtgggtccaacattatcccccatttcagctgtgagctacctccgctctttcctctgtcctgtacagatcccattgtcaatgagattcttctagcagtgtcatgtgcgtttctgggactgctgacacttcccctaatcctcttctcttactccagaatcatttctgccattctgaacatccgctcctctgagggccaagccaaagccttctccacctgctcctcccacctcaccgtggtactcttgttctatgggacagctctattcaggtacatcagccctgcctcaggctcagtgttggagcgagtggtctccattcagtacagtgtgatcacatctttggtgaaccccctcatctacagtctcaagaaccaagaggtgaaggcagctctgcagaggatgctaaagcaacaaaagtgtgccctggggtag

SEQ ID NO: 1612 - protein, 309 aa, Canis familiaris
MKNVSIITEFVLLGLSSDPQIQTMLFVLFLGIYLLTLMGNLVMILVIRVDSHLQTPMYFFLGHLSFLDLSFSSVTVPKMLQNFLSQKKSISVWGCITQSFFFTLSGGTEACLLSAMAYDRYAAICYPLVYTMVINRPLCIVTVSIAWTVGFLISLMNILFIYKLHFCGSNIIPHFSCELPPLFPLSCTDPIVNEILLAVSCAFLGLLTLPLILFSYSRIISAILNIRSSEGQAKAFSTCSSHLTVVLLFYGTALFRYISPASGSVLERVVSIQYSVITSLVNPLIYSLKNQEVKAALQRMLKQQKCALG

SEQ ID NO: 1613 - DNA, 363 bp, Canis familiaris
cagagtttatcctcatgggctttgagcagagctcctcttccactcaggcactactctttgctccccatgtccatgaatggccttatcatcttcatcacctggacagaccccaggctcaacagccccatgtacttcttccttggccacctgtccttcctggatgtctgcttcatcaccaccactatcccacagatgctgatccacctggtgatcaaggaatatctcctttgcctctgcttgacccaaatgtatctggtttttggtgtaggtgtggccaagtgcaccctcttggcttttatggcctatgacggttatgttgctatctgccacccactcagctatgcccagatcatgagtcacagg

SEQ ID NO: 1614 - protein, 121 aa, Canis familiaris
QSLSSWALSRAPLPLRHYSLLPMSMNGLIIFITWTDPRLNSPMYFFLGHLSFLDVCFITTTIPQMLIHLVIKEYLLCLCLTQMYLVFGVGVAKCTLLAFMAYDGYVAICHPLSYAQIMSHR

SEQ ID NO: 1615 - DNA, 1029 bp, Canis familiaris
ctgggtctctgggctcaagtgagtaccttacattccctacaaactatctcacctgtgctttcctgtcctccctcctcaagcaggtccaagacagtggacctaaggaatggcagcacagtgacagagttcatcctcgtgggctttgagcagagctcctcttccactcaggcattactctttgtcctcttcctagccctctacagccttgccatggccatgaatggcctcatcatcttcatcacctggacagaccccaggctcaacagccccatgtacttcttccttggccacctgtccttcctggatgtctgcttcatcaccaccactatcccgcagatgctgatccacttggtggtcaagaaccacattgtctcttttgtctcttgcttgacccagatgtacttggtcttctgtgtgggtgtggctgagtgcatcctcttggcttttatggcctatgaccgttatgttgctatctgccacccactcagctatgcccagatcatgagccggcaggtctgtgtgaagctggtgagtactgcctggctctttgggctgatcaatggcatctttcttgagtatatgtcattccggaatcccttctgtagagacaaccacatagagaacttcttctgtgaggcccccatagtgattgccctgtcttgtggagacccccaatttagtctgagaatgatctttgccgatgcaatcgtggtgctactcagccccatggtgctcattgtcatctcctatgcccgcatcctggcctccatccttggaagagcctcctcctcaggtcgagggaagaccttctctacttgtgcctcccatctgactgtggtcatctttttctacacctctgccatgttctcttatatgaaccctcgcagcacacatggccctgacaaagacaagcctttctccctcctctacaccatcatcacccccatgtgcaaccccatcatctatagttttcgaaacaaggaaatgaagggagccatggtgagggcccttgggaggaccagcctggct

SEQ ID NO: 1616 - protein, 343 aa, Canis familiaris
LGLWAQVSTLHSLQTISPVLSCPPSSSRSKTVDLRNGSTVTEFILVGFEQSSSSTQALLFVLFLALYSLAMAMNGLIIFITWTDPRLNSPMYFFLGHLSFLDVCFITTTIPQMLIHLVVKNHIVSFVSCLTQMYLVFCVGVAECILLAFMAYDRYVAICHPLSYAQIMSRQVCVKLVSTAWLFGLINGIFLEYMSFRNPFCRDNHIENFFCEAPIVIALSCGDPQFSLRMIFADAIVVLLSPMVLIVISYARILASILGRASSSGRGKTFSTCASHLTVVIFFYTSAMFSYMNPRSTHGPDKDKPFSLLYTIITPMCNPIIYSFRNKEMKGAMVRALGRTSLA

SEQ ID NO: 1617 - DNA, 1047 bp, Canis familiaris
atgggtctctgggctcaagtgagtaccttacattccctacaaactatctcacctgtgctttcctgtcctccctcctcaagcaggtccaagacagtggacctaaggaatggcagcacagtaacagagttcatcctcgtgggctttgagcagagctcctcttccactcgggcattactctttgctctcttcctagccctctacagccttgccatggccatgaatggcctcatcatcttcatcacctggacagaccccaggctcaacagccccatgtacttcttccttggccacctgtccttcctggatgtctgcttcatcaccaccactatcccgcagatgctgatccacttggtggtcaagaaccacattgtctcttttgtctcttgcttgacccagatgtacttggtcttctgtgtgggtgtggctgagtgcatcctcttggcttttatggcctatgaccgttatgttgctatctgccacccactcagctatgcccagatcatgagccagcaggtctgtgtgaagctggtgagtactgcctggctctttgggctgatcaatggcatctttcttgagtatatgtcattccggaatcccttctgtagagacaaccacatagagaacttcttctgtgaggcccccatagtgattgccctgtcttgtggagacacccggtttagtctgaggatgatctttgtcgatgccattttggtgctgctcagccccatggtgctcattgtcatctcctatgcccgcatcctggcctccatccttggcagagcctcctcctcaggtcgagggaagaccttctctacttgtgcctcccatctgactgtggtcctccttctgtatacctctgccatgttctcttacatgaaccctcgcagcacacatggccctgacaaagacaagcctttctccctcctctacaccatcatcacccccatgtgcaaccccatcatctatagttttcgaaacaaagaaatgttgggagccatggtgagggcccttgggaggatcagcctggcccaggatgagtctgtctag

SEQ ID NO: 1618 - protein, 348 aa, Canis familiaris
MGLWAQVSTLHSLQTISPVLSCPPSSSRSKTVDLRNGSTVTEFILVGFEQSSSSTRALLFALFLALYSLAMAMNGLIIFITWTDPRLNSPMYFFLGHLSFLDVCFITTTIPQMLIHLVVKNHIVSFVSCLTQMYLVFCVGVAECILLAFMAYDRYVAICHPLSYAQIMSQQVCVKLVSTAWLFGLINGIFLEYMSFRNPFCRDNHIENFFCEAPIVIALSCGDTRFSLRMIFVDAILVLLSPMVLIVISYARILASILGRASSSGRGKTFSTCASHLTVVLLLYTSAMFSYMNPRSTHGPDKDKPFSLLYTIITPMCNPIIYSFRNKEMLGAMVRALGRISLAQDESV

SEQ ID NO: 1619 - DNA, 1044 bp, Canis familiaris
ctgggtctctgggctcaagtgagtaccttacattccctacaaactatctcacctgtgctttcttgtcctccctcctcaagcaggtccaagacagtggacctaaggaatggcagcacagtgacagagttcatcctcgtgggctttgagcagagctcctcttccactcaggcattactctttgctctcttcctagccctctacagccttgccatggccatgaatggcctcatcatcttcatcacctggacagaccccaggctcaacagccccatgtacttcttccttggccacctgtccttcctggatgtctgcttcatcaccaccactatcccacagatgctgatccacctggtggtcaagaaccacattgtctcctttgcctcttgcttgacccagatgtatctggtttttggtgtaggtgttgctgagtgcatcctcttggcctttatggcctatgaccgttatgttgctatctgccacccgctcagctatgcccagatcatgagccggcaggtctgtgtgaagctggtgagtactgcctggttctttgggctgatcaatgggattctgctggattatatgacatttcgtggtcccttctgtagagacaaccacatagagaacttcttctgtgaggcccccatagtgattgccctgtcttgtggagacccccagtttagtctcaggacaatctttgctgatgccgtcgtggtgctgctcagccccatggtgctcattgtcatctcctatgcccgcatcctggcctccatccttggcagagcctcctcctcaggtcgagggaagaccttctctacttgtgcctcccatctgactgtggtcatctttttctacacctctgccatgttctcttacatgaaccctcgcagcacacatggccctgacaaagacaagcctttctccctcctctacaccatcatcacccccatgtgcaaccccatcatctatagttttcgaaacaaggaaatgaaaggagccatggtgagggcccttgggaggaccagcctggcacaggcagagtctgtc

SEQ ID NO: 1620 - protein, 348 aa, Canis familiaris
LGLWAQVSTLHSLQTISPVLSCPPSSSRSKTVDLRNGSTVTEFILVGFEQSSSSTQALLFALFLALYSLAMAMNGLIIFITWTDPRLNSPMYFFLGHLSFLDVCFITTTIPQMLIHLVVKNHIVSFASCLTQMYLVFGVGVAECILLAFMAYDRYVAICHPLSYAQIMSRQVCVKLVSTAWFFGLINGILLDYMTFRGPFCRDNHIENFFCEAPIVIALSCGDPQFSLRTIFADAVVVLLSPMVLIVISYARILASILGRASSSGRGKTFSTCASHLTVVIFFYTSAMFSYMNPRSTHGPDKDKPFSLLYTIITPMCNPIIYSFRNKEMKGAMVRALGRTSLAQAESV

SEQ ID NO: 1621 - DNA, 780 bp, Canis familiaris
atggaagttggcaacataaccacagtcacatttgtcctcctaggactatccaacaatcctcagatccaggctctgctctttgtgctcttcctggggatttacctcctgaccattctggggaacctggcgatgctgctggtcaccagggctgattctcacctccacacacccatgtacttcttcctgagtcacctctccttcttggatgctttctattcctcaatcattgtgcctaaattgctagagaacctcctttccaagtggaagactgtttcctctgttgaatgtttcacccagatctccttggtcatattttctggggccactgaaacttgcctcctttcagtcatggcctatgaccggttccaggctgtgtgccacccactgttgtatgtggtggctatgaacaagaagctatgtactggcctggtggtagcatcctgggccataggagtagggactagcctggttaacagcatccttctggctcagcagcacttctgtgggcccaatcttgtccgtagttttgcctgtgagcttcccccagtgctcctgctgacctgttctgacccctatgttagtgttgcctccaatctgaccaccatggcagtcctgggccttggtgcctttgtcctattgctgggctcctacacccgtatcatcatgacagccctaggaatcaactctgccactggtcggagaaagatcttttccacctgctcttctcatcttcttgtgatcaccaacttttatggttcaggagttatcaggtatgtcata

SEQ ID NO: 1622 - protein, 260 aa, Canis familiaris
MEVGNITTVTFVLLGLSNNPQIQALLFVLFLGIYLLTILGNLAMLLVTRADSHLHTPMYFFLSHLSFLDAFYSSIIVPKLLENLLSKWKTVSSVECFTQISLVIFSGATETCLLSVMAYDRFQAVCHPLLYVVAMNKKLCTGLVVASWAIGVGTSLVNSILLAQQHFCGPNLVRSFACELPPVLLLTCSDPYVSVASNLTTMAVLGLGAFVLLLGSYTRIIMTALGINSATGRRKIFSTCSSHLLVITNFYGSGVIRYVI

SEQ ID NO: 1623 - DNA, 930 bp, Canis familiaris
atggcctggaggaaccacagcaccatcacggagttcattctccttgggctgtccgacgacccctacatcgaagctctgctctttgtgttcttcctggggatctacctcctgactatgatggggaacctgatgatgctgctggtgatcagggctgattcccgcctccacactcccatgtacttcttcctgagtaacctgtccttcctagacctctgcttctcttctgtcactgtgcccaagctcctgaaggaccttctgtctgagaagagaaccatctcagtggagggctgcctcacccaggtgttctttgtgtttatcactgcagggaccgaagcctttctgctctcagtgatggcctatgaccgctatgctgccatctgccacccactgctctatggccaggtgatgagcacccagttctgtgtgaagctcgtgttgatctcatggggtctggcctgcctgaattcggttgtgattgtgttcttggctattaacctggacttctgtgaggcccaaactatacatcattacatctgtgagctgccctccctcttccctctctcttgctcagatatttctatcaatgttgacatcttgatctgctccatcttactgcatgggcttgggaccttcctcccaatcttcttctcctatgcccgtattgtctccaccatcctgagcatcagctctacctcaggcagaagcaagaccttctccacctgctcttcccacctcattgcagtgactctgttctttggctcaggtttgattcgctaccttatgcccacctccggttcctccctggatttgctctcctccttgcagtacagtgcagtcacacccttgctgaatcccctcatctacagcctaaagaataaagaagtgaaggcagctgtgagaaggacactaggaaaatacctacactcttag

SEQ ID NO: 1624 - protein, 309 aa, Canis familiaris
MAWRNHSTITEFILLGLSDDPYIEALLFVFFLGIYLLTMMGNLMMLLVIRADSRLHTPMYFFLSNLSFLDLCFSSVTVPKLLKDLLSEKRTISVEGCLTQVFFVFITAGTEAFLLSVMAYDRYAAICHPLLYGQVMSTQFCVKLVLISWGLACLNSVVIVFLAINLDFCEAQTIHHYICELPSLFPLSCSDISINVDILICSILLHGLGTFLPIFFSYARIVSTILSISSTSGRSKTFSTCSSHLIAVTLFFGSGLIRYLMPTSGSSLDLLSSLQYSAVTPLLNPLIYSLKNKEVKAAVRRTLGKYLHS

SEQ ID NO: 1625 - DNA, 1005 bp, Canis familiaris
atggcctggaggaaccacagcaccatcacggagttcattctcattgggctgtccgacgacccctacatcgaagctctgctctttgtgttcttcctggggatctacctcctgactgtgatggggaacctgataatgctgctggtgatcagggctgattcccgcctccacactcccatgtacttcttcctgagtaacctgtccttcctagacctctgcttctcttctgtcactgtgcccaagctcctaaaggaccttctgtctgagaagagaaccatctcagtggagggctgcctcacccaggtgttctttgtgtttatcacaccagggaccgaagcctttctgctctcagtgatggcctatgaccgctatgctgccatctgccacccactgctctatgaccaggtgatgagcacccagttctgtgtgaagctggtgttgatctcatggggtctggcctgtctcaatgcatttatcattgtgctcttggctattaacctggacttctgtgaggcccaaaccatacagcactacacctgcgaactgccctccctcttccctctctcttgctcagatatttccatcaatgttgacatcttgatctgctccaccttactgcatggccttgggaccttcctcccaatcttcttctcctatgcccgtatcgtctccaccatcctgagcatcagctccacctcaggcagaagcaagactttctccacctgctcttcccacctcattgcagtgaccctattttttggctcaggtttgattcgctaccttatgcccacaactggttcctccctggatttgctcctgtccttgcagtacagtgctgtaacacccttgctgaatcccctcatctacagcctaaagaataaagaggtgaaggcagctgtgagaaggacactgggaaaatatctcttaagtagtgacagacacatggttacaaagaccgggttcctttgcatttctttttttgttcccaccttctcccacacacagtga

SEQ ID NO: 1626 - protein, 334 aa, Canis familiaris
MAWRNHSTITEFILIGLSDDPYIEALLFVFFLGIYLLTVMGNLIMLLVIRADSRLHTPMYFFLSNLSFLDLCFSSVTVPKLLKDLLSEKRTISVEGCLTQVFFVFITPGTEAFLLSVMAYDRYAAICHPLLYDQVMSTQFCVKLVLISWGLACLNAFIIVLLAINLDFCEAQTIQHYTCELPSLFPLSCSDISINVDILICSTLLHGLGTFLPIFFSYARIVSTILSISSTSGRSKTFSTCSSHLIAVTLFFGSGLIRYLMPTTGSSLDLLLSLQYSAVTPLLNPLIYSLKNKEVKAAVRRTLGKYLLSSDRHMVTKTGFLCISFFVPTFSHTQ

SEQ ID NO: 1627 - DNA, 924 bp, Canis familiaris
atggcctggaggaaccacagcaccatcacggagttcattctcattgggctgtccgacgacccctatatcgaagctctgctctttgtgttcttcctggggatctacctcctgactgtgatggggaacctgatgatgctgctggtgatcagggctgattcccgcctccacactcccatgtacttcttcctgagtaacctgtccttcctagacctctgcttctcttctgtcactgtgcccaagctcctgaaggaccttctgtctgagaagagaaccatctcagtggagggctgcctcacccaggtgttctttgtgtttatcacaccagggactgaagcctttctgctctcagtgatggcctatgaccgctatgctgccatctgccacccactgctctatggccaggtgatgagcccccagttctgtgtgaagctggtgttgatctcatggggtctggcctgtctcaatgcatttgtcattgtgttcttggctattaacctggacttctgtgaggcccaaaccatacatcattacatctgtgagctgccctccctcttccctctctcttgctcagatatttccatcagtgttgacatcttgatctgctccatcttactacatgggcttgggaccttcctcccaatcttcttctcctatgcccgtatcgtctccaccatcctgagcatcagctccacctcaggcagaagcaagactttctccacctgctcctcccacctcattgcagtgaccctgttctttggctcaggtgtgattcgctaccttatgcccacaactgattcctccctggttttgctcctgtccttgcagtacagtgcagtcacacccttgctgaatcccctcatctacagcctaaagaataaagaggtgaaggcagctgtgagaaggacactggggaaatatttctaa

SEQ ID NO: 1628 - protein, 307 aa, Canis familiaris
MAWRNHSTITEFILIGLSDDPYIEALLFVFFLGIYLLTVMGNLMMLLVIRADSRLHTPMYFFLSNLSFLDLCFSSVTVPKLLKDLLSEKRTISVEGCLTQVFFVFITPGTEAFLLSVMAYDRYAAICHPLLYGQVMSPQFCVKLVLISWGLACLNAFVIVFLAINLDFCEAQTIHHYICELPSLFPLSCSDISISVDILICSILLHGLGTFLPIFFSYARIVSTILSISSTSGRSKTFSTCSSHLIAVTLFFGSGVIRYLMPTTDSSLVLLLSLQYSAVTPLLNPLIYSLKNKEVKAAVRRTLGKYF

SEQ ID NO: 1629 - DNA, 924 bp, Canis familiaris
atggcctggaggaaccacagcaccatcacggagttcattctcattgggctgtccgacgacccctacatcgaagctctgctctttgtgttcttcctggggatctacctcctgactgtgatggggaacctgatgctgctgctagtgatcagggctgattctcgcctccacactcccatgtacttcttcctgagtaacctgtccttcatggacctctgcttctcttctgtcactgtgcccaagctactgaaggaccttctgtctgaaaagaaaaccatctcagtggagggctgcctcacccaggtgttctttgtgtttttctcttcagggactgaagcttgtctgctctcggtgatggcctatgaccgctatgctgccatctgccacccactgctctatggccaggtgatgagcggccagttctgtgtgaagctggtgttgatctcatggggtctggcctgtctcaatgcatttgtcattgtgctcttggctattaacctggacttctgtgaggcccaaaccatacaccactacacctgtgagctgcctgcccttttccctctgtcttgttcggatatctccatcactaccgatatcctgctgtcctccagtttattgcatgggcttgggaccttcctcccaatcttcttctcctatgctcgcatcatctccaccatcctgagcatcagctccacctcaggcagaagcaagaccttctccacctgctcctcccacctcattgcagtgaccttgttctttggctcaggttttctttgttatctcatgcctccctcaggttcctccctggattttctcatctccttgcagtacagtgcagtcacacccctgctgaatcccctcatctacagcttaaagaataaagaggtgaaggcggctgtgagaaggacactggggaaatatctctaa

SEQ ID NO: 1630 - protein, 307 aa, Canis familiaris
MAWRNHSTITEFILIGLSDDPYIEALLFVFFLGIYLLTVMGNLMLLLVIRADSRLHTPMYFFLSNLSFMDLCFSSVTVPKLLKDLLSEKKTISVEGCLTQVFFVFFSSGTEACLLSVMAYDRYAAICHPLLYGQVMSGQFCVKLVLISWGLACLNAFVIVLLAINLDFCEAQTIHHYTCELPALFPLSCSDISITTDILLSSSLLHGLGTFLPIFFSYARIISTILSISSTSGRSKTFSTCSSHLIAVTLFFGSGFLCYLMPPSGSSLDFLISLQYSAVTPLLNPLIYSLKNKEVKAAVRRTLGKYL

SEQ ID NO: 1631 - DNA, 936 bp, Canis familiaris
atggccttgagaaaccacagcaccagcactgagttcatcctcctcgggctgtctgctgaccccaaagtccaggctctgctctttgtgctcttcctggggatttatctcctgactgtgatggggaacctggcaatgctgctggtgatcagtgctgatttccacctccacacacccatgtacttcttcctgagtaacctgtccttcctagacctctgcttttcctcggtcactgtgcccaagatgctggagaacctcctatctaaaaggaaaatcatttcaatagaaggatgcctgactcaagccttctttgtgtttgacgttggaggaacagaaattttcctgctctctgccatggcctatgaccgctatgcagccatctgccaccctctgctctacagccgcatgatgagcaaccagctgtgtgtgaggctggtatgggcttcatggagcctaggtttcctggatgcagttatcaacatccccctggctatgaacttgaacttctgtgaggcccataccatcccccactacagctgtgagctgccctccctcttccctttgtcctgctctgatgtctctaccaacctcactgtcctgctctgttccacactcttgcatggctttggtacattcttcctgatattcttctcttatgcacgcattgtctccaccatcctgagcatcagctcctccttgggcagaagcaaggccttctccacctgctcctcccacctcactgcagtgagcttcttctatggctcagctttcctccgtcatctcataccaacctcaggctcacctctggagctgatcttctccatacagtatggtgtgatcactcccctagtgaatcccctcatttacagcctgaaaaacaaagaagtaaaggcagctctaagaagaaccttgggaaagtgtttgcaatggcacaggtag

SEQ ID NO: 1632 - protein, 311 aa, Canis familiaris
MALRNHSTSTEFILLGLSADPKVQALLFVLFLGIYLLTVMGNLAMLLVISADFHLHTPMYFFLSNLSFLDLCFSSVTVPKMLENLLSKRKIISIEGCLTQAFFVFDVGGTEIFLLSAMAYDRYAAICHPLLYSRMMSNQLCVRLVWASWSLGFLDAVINIPLAMNLNFCEAHTIPHYSCELPSLFPLSCSDVSTNLTVLLCSTLLHGFGTFFLIFFSYARIVSTILSISSSLGRSKAFSTCSSHLTAVSFFYGSAFLRHLIPTSGSPLELIFSIQYGVITPLVNPLIYSLKNKEVKAALRRTLGKCLQWHR

SEQ ID NO: 1633 - DNA, 948 bp, Canis familiaris
atggcctcagcgaatcacagcagaatcacggagttcatccttcttgggctgtctgctgacccctatgtccaggctctactctttgttctgttcctgatgatttaccttctgactctactggggaatcttctgataatacttgtgatccatacagatgctaacctccacatgcccatgtacttctttctgggccatctctccttccaagacctcttctactctacagtcactgtgcccaagctgctggagaacctcctgtctcagaggaaaaccatctcagtggagggctgcctggctcaggtgttctttgtgtttgccactacagggattgaagcctgcctgctttcggtgatggcctatgaccgctatgctgccatctgccaccctctgctttatggccaggtgatgagtaaacagctatgtgagaggttggtgtggggctcttgggtcgtggcctttctggatgcactcatgaacatcctcctggctttgaatatggacttctgtgaggctcaaaccatccaccactactcctgtgagctgccttccctcttccctctctcctgctctgatgtctccaccaactctgcaatgctactctgctctgccctcctgcatgccattgggacatgcctcctgatcttcttctcttatgtgcgcattgtctctaccatcctgagcatcagctccaccacaggcagaagcaaggccttctccacctgctcctcccacctcactgcagtgatcctgttctatggctcagcccttcttcgctatctcatgccaacctcagggtcacctctagagttgatcctctccatacaatacagtgtaatcactcccttggtgaatccactcatctacagctggaagaacaaggaggtgaaagcagctctgagaagaatgatgataaaatacttacgatgtctcagcacagaagagatataa

SEQ ID NO: 1634 - protein, 315 aa, Canis familiaris
MASANHSRITEFILLGLSADPYVQALLFVLFLMIYLLTLLGNLLIILVIHTDANLHMPMYFFLGHLSFQDLFYSTVTVPKLLENLLSQRKTISVEGCLAQVFFVFATTGIEACLLSVMAYDRYAAICHPLLYGQVMSKQLCERLVWGSWVVAFLDALMNILLALNMDFCEAQTIHHYSCELPSLFPLSCSDVSTNSAMLLCSALLHAIGTCLLIFFSYVRIVSTILSISSTTGRSKAFSTCSSHLTAVILFYGSALLRYLMPTSGSPLELILSIQYSVITPLVNPLIYSWKNKEVKAALRRMMIKYLRCLSTEEI

SEQ ID NO: 1635 - DNA, 957 bp, Canis familiaris
atggtcttaggaaaccacagcaccatcacagaattcatcttccttggactgtctgctgacccccacatccagattctgctctttgtgcttttcctagcaatttacctcctgactatcatggggaacctgatgataatgatagtgactatgactgatacccatctccacacccccatgtacttcttcttgagccacctctccttcctggatctttgtttaacttcagtaattgtgcccaagatgctggagaatctcgtatctcacaagaaatcagtatcagtagaaggctgcctcactcaggcatttttcgtgttttccatcgctggaactgaagtttttgtgctctctgccatggcctatgaccgctatactgccatctgctaccccctgctctatggccagctgatgagtaaacagttgtgtgggggtctggtatgggtctcatgggcactgggctttctggatgctctcattaacaccctcatggcttggaatttggacttctgtgaggttcaggtcatccctcacttcagctgtgaactgccatctctattccctctatcttgctctgacatctccaccaactttacagtcctggtgtgctctgccatcattcatgcctctggaaccttgcttctggtcttcttctcatatactcgcattgtctccaccatcctgagcatcagctccacctcaggcagaagtaaagccttctccacctgctcctcccacctcactgcagtgagctttttctatggatctgcttttcttcgctatttcatgccaatctcaggctcacctctggagctgattttctccatacagtacagtgtggtcactcctctaataaatccccttatttacagcttgaagaacaaggaagtaaaatcagctctgaaaagaatgctgcaaaaaggtttaaaacagctcagagagcagagaacaggcagtggatga

SEQ ID NO: 1636 - protein, 318 aa, Canis familiaris
MVLGNHSTITEFIFLGLSADPHIQILLFVLFLAIYLLTIMGNLMIMIVTMTDTHLHTPMYFFLSHLSFLDLCLTSVIVPKMLENLVSHKKSVSVEGCLTQAFFVFSIAGTEVFVLSAMAYDRYTAICYPLLYGQLMSKQLCGGLVWVSWALGFLDALINTLMAWNLDFCEVQVIPHFSCELPSLFPLSCSDISTNFTVLVCSAIIHASGTLLLVFFSYTRIVSTILSISSTSGRSKAFSTCSSHLTAVSFFYGSAFLRYFMPISGSPLELIFSIQYSVVTPLINPLIYSLKNKEVKSALKRMLQKGLKQLREQRTGSG

SEQ ID NO: 1637 - DNA, 537 bp, Canis familiaris
atggaagacaatatgacatctatcacagagttcaccctactgggatttcctcttggcccaaggattcagatggttctctttgggctcttcaccctgttctacaccttcaccctgctggggaatgggctcatcctggggctcatctcactggaccccagactgcacacccccatgtacttcttcctctcccacctggccatcgtcgatatagcctatgcctgcaacacggtgccccagatgctggtgaacctcctgaggccagacaagcccatctcctttgctggctgtctgacacagacctttctctttctgacctttgctgtcacagaatgtcttctcctggtggtgatgtcctatgaccggtatgtggccatctgccaccccctccgctattctgtgatcatgagctggagagtctgcatcaccctggtgctgacttcttggaccattggagtccttctgtttttggtacatctcatgttacttctccccttacccttctgtagattccagaaaatcaatcactttttctgtgaa

SEQ ID NO: 1638 - protein, 179 aa, Canis familiaris
MEDNMTSITEFTLLGFPLGPRIQMVLFGLFTLFYTFTLLGNGLILGLISLDPRLHTPMYFFLSHLAIVDIAYACNTVPQMLVNLLRPDKPISFAGCLTQTFLFLTFAVTECLLLVVMSYDRYVAICHPLRYSVIMSWRVCITLVLTSWTIGVLLFLVHLMLLLPLPFCRFQKINHFFCE

SEQ ID NO: 1639 - DNA, 927 bp, Canis familiaris
atgagtaacaagacgctagtaacagagtttatcctgcagggcttttcagagcacccagaataccatatgctcttattcagctgtttcctctccctctactctgtggccctcacaggtaatatcctcatcattttggccatcaccttcaaccctgggctccatacccccatgtacttttttctcttcaacttggctactatggatattatctgcacctcttccatcatgcccaaagcactggagggtctggtatcagaggagagctctatctcttatggggcctgcatggcccagctctattttctcacatgggctgcatcctccgagctgctcctcctcacggtcatggcctatgaccggtatgcagccatctgccaccctctgcactacagcacgacaatgagcatggcattctgcagtaagctggccacaggtgtatgggtgctttgtgccttcaacacagccatccacactgggctgatgctgcggttaaatttctgtggccctaacgtcattacccattttttctgtgaggtccctcctctgttgcttctctcctgtagctccacctatgtgaacagcatcatgattgtcctagctgatgccttttatggcatattgaacttcctgatgaccattgtgtcatacggctttattatctctagcatcctaaaaatgcggactgcagaggggaagaaaaaagccttttccacttgctcttctcacctcattgtggtgtgtatgtattatactgctgtcttctatgcctacataagccctgtctccagctatagtccagggaagagcaagttggctggtgtactgtacaccatattgagccctacactcaaccccctcatctatactttgagaaacaaggaggtcaaggcagccctcaggaagcttttctccttctccagaaattaa

SEQ ID NO: 1640 - protein, 308 aa, Canis familiaris
MSNKTLVTEFILQGFSEHPEYHMLLFSCFLSLYSVALTGNILIILAITFNPGLHTPMYFFLFNLATMDIICTSSIMPKALEGLVSEESSISYGACMAQLYFLTWAASSELLLLTVMAYDRYAAICHPLHYSTTMSMAFCSKLATGVWVLCAFNTAIHTGLMLRLNFCGPNVITHFFCEVPPLLLLSCSSTYVNSIMIVLADAFYGILNFLMTIVSYGFIISSILKMRTAEGKKKAFSTCSSHLIVVCMYYTAVFYAYISPVSSYSPGKSKLAGVLYTILSPTLNPLIYTLRNKEVKAALRKLFSFSRN

SEQ ID NO: 1641 - DNA, 954 bp, Canis familiaris
atggaaaagtcggtgatggaggatgcaagaaaccacacagaagttcaggaattcaccttggaaggttttcctggtgtccagcaccctggaaagattctcttcctggtgcatctgttggcatacctggcctccatcatgggaaacatactcataatcaccattacctgggctgaccatcacctccagacacccatgtacttcttcctcagcagtttctccttttctgaatgctgttttataaccactgttattccaaaattgctggctatctttctggtagggaggcaatcaatttactttgctgcctgcctcacacaagactttatctttcttttcctgggaataactgttttcttccttatggctatattatccctagatcggtacttggccatttgcaaacctctgtattacccaaccatcatgaacccaaggatgtgtttccttctggtcattgcctgtttagctttgggattcatccttatggtggttccagttgtaatgctttcccattcatccttctgtggttcccatatcatatctcacttctgtaattttgggcccctggtttatctctcctgttctgataccagatttactgagatgttggcctttgtccttgatttgtttatccttttgacatcccttatcataaccatcattacctacagcaacatagtaatcacaattgtgcaactcctatcagccaaggagaaaaagaaagctttctccacctgctcctctcacctcatagtcctctctctgatgtatggcagctgtgtctttatatatatgaaaccaaagcaaactaaagggctagactccaacagagaggctacccttgtgaacatggtggtaaccacactgctcaaccctgtcatctctactctgcagaacaagcaggtccactgggctgtaagggatactctgtccagggttagactgaagaaatag

SEQ ID NO: 1642 - protein, 317 aa, Canis familiaris
MEKSVMEDARNHTEVQEFTLEGFPGVQHPGKILFLVHLLAYLASIMGNILIITITWADHHLQTPMYFFLSSFSFSECCFITTVIPKLLAIFLVGRQSIYFAACLTQDFIFLFLGITVFFLMAILSLDRYLAICKPLYYPTIMNPRMCFLLVIACLALGFILMVVPVVMLSHSSFCGSHIISHFCNFGPLVYLSCSDTRFTEMLAFVLDLFILLTSLIITIITYSNIVITIVQLLSAKEKKKAFSTCSSHLIVLSLMYGSCVFIYMKPKQTKGLDSNREATLVNMVVTTLLNPVISTLQNKQVHWAVRDTLSRVRLKK

SEQ ID NO: 1643 - DNA, 954 bp, Canis familiaris
atggaggtgaggaatgagacagtaatccgaggattcattctggaagggtttcctaccatccagtacttgggaaacctcttcttcctggtacatctgctggcatacgtggcctctatcacaggaaatatggtgatcatcatcatcacttgggttgattatcgtctccagacacccatgtatattttacttagcactttctccttctttgaatgctgttttatcaccacagttgttcctaaactgctgtccatctttctttcaggaaggcaaacaatttcctttactgcttgtgtcacacaagccttttcttttctgttttttgggtcaataattttcttcctcatggctgtaatgtccttggatcgatacttggccatttgcaagcctctgcattacccaaccatcatgaacctgaagacttgcttcctcctggtcatgatctgttgtgctttgcccttctctctcatcactggtctggtagtaaaggtgttccagttatccttctgtggtcctcatgtcatcccccattttttctgtgaccttggccccctgattcatctctcctgttctgacaccaggtctattgaaatgttggcctttgtcctcacttcctttatccttttgacatcacttatcataaccatcattgcctatagcaacatagtagtcacaatcctgcaactcccatcagccaaggagaaaaagaaagctttctccacctgctcatctcacctcatagtcctctctctgatgtatggcagttgtgtctttatatatgtgaaaccaaaacaaacgaacaggatggactccaacagggaggctgcccttgtgaacacagtagtgaccccgctgctcaaccctgttatttatactctgcggaacaagcaggtccaccaggctttgagggatgctctgtcctgggtgaggttgcataaacagagctttagagggtaa

SEQ ID NO: 1644 - protein, 317 aa, Canis familiaris
MEVRNETVIRGFILEGFPTIQYLGNLFFLVHLLAYVASITGNMVIIIITWVDYRLQTPMYILLSTFSFFECCFITTVVPKLLSIFLSGRQTISFTACVTQAFSFLFFGSIIFFLMAVMSLDRYLAICKPLHYPTIMNLKTCFLLVMICCALPFSLITGLVVKVFQLSFCGPHVIPHFFCDLGPLIHLSCSDTRSIEMLAFVLTSFILLTSLIITIIAYSNIVVTILQLPSAKEKKKAFSTCSSHLIVLSLMYGSCVFIYVKPKQTNRMDSNREAALVNTVVTPLLNPVIYTLRNKQVHQALRDALSWVRLHKQSFRG

SEQ ID NO: 1645 - DNA, 723 bp, Canis familiaris
tttcctcacatccagcacctgggaaagtttctcttcctggtgcacctgctgacatacctggcatccattgcaggcaatgctgtcatagtcaccatcatctgtgctaattcccggctccagacaccgatgtactttttcctcagcattttctccttcttggagtgttacttcataaatactgttattcctaagttattggtcatctttctttcaggtaagcaaaccatttcttttcctgcctgtttcatacaagcctttgtctttgtatttctggaagcagcaggtttcttcctcatagcagtgatgtctctggattggtatgtggccatttgcaagcccctgcattacccgaccatcatgaacctgaagactagttccctcctggtcactgcctgctgtgctttggggttctctctaatcactggtctggtagtaaaggtttcccagttatccttctgtggtccccatgtcatcccccactttttttgtgaccttggccccctgattcatctcttctgttctgacaccaagtctgttgaaatgttgatctctgtccttgctttgttaatccttttgacatcccttatcataaccatcattgactatagcaacatagtagtcacaatcctgaaactcccatcagccaaggagaaaaagaaagctttctccaccggctcctctcacctcatagtcctctctcgaatgtatggaagctgtgtcttt

SEQ ID NO: 1646 - protein, 241 aa, Canis familiaris
FPHIQHLGKFLFLVHLLTYLASIAGNAVIVTIICANSRLQTPMYFFLSIFSFLECYFINTVIPKLLVIFLSGKQTISFPACFIQAFVFVFLEAAGFFLIAVMSLDWYVAICKPLHYPTIMNLKTSSLLVTACCALGFSLITGLVVKVSQLSFCGPHVIPHFFCDLGPLIHLFCSDTKSVEMLISVLALLILLTSLIITIIDYSNIVVTILKLPSAKEKKKAFSTGSSHLIVLSRMYGSCVF

SEQ ID NO: 1647 - DNA, 963 bp, Canis familiaris
atgatgctgtggaaagagatgcccatggaaatggagaatgggacagctgtccaggaattcaccttggaagggttccctgacatccagcacctgggaaagtttctcttcctggtgcacctgctgacatacctggcatccattgcaggcaatgctgtcatagtcaccatcatctgtgctaattcccggctccagacacctatgtactttttcctcagcattttctcctttgtagagtgttgtttcataaatactgttattcctaagttgttagtcatctttcttttaggcaagcaaaacatttcctttcctgcctgtttcatacaagcctttttctttttctttctgggagcagcagatttctttctcatagcagtgatgtctctggatcggtatgtggccatttgcaagcccctgcattacttgaccatcatgaacctgaagacttgctcctttctggtcactacctgcttcactttggccttcactctcatcactggtttggtagtgaaagtttcccagttatccttctgtggcccctatgtcatccctcactttttctgtgacattggccccctgattcatctttcctgttctgacactaaacctactgaaatgttggcttttgtcctcgctttgtttatccttttgacatcccttatcataaccatcattgcctacagcaacataatagtcacaattgtacaactcccatcagctagggaacgacagaaagctttctccacctgctcctctcaccttatagtcctctctctgatgtatggcagctgtgtctttatatatgtaaaactaaagcaaacgaacaggatggactccaacagggaggctgcccttgtgaacacggtggtgaccccgctgctcaaccctgtcatttacactctgcggaacaagcaggtccaccaggctctgagagagacaatgtgcagaatgaaaatgtcaagatga

SEQ ID NO: 1648 - protein, 320 aa, Canis familiaris
MMLWKEMPMEMENGTAVQEFTLEGFPDIQHLGKFLFLVHLLTYLASIAGNAVIVTIICANSRLQTPMYFFLSIFSFVECCFINTVIPKLLVIFLLGKQNISFPACFIQAFFFFFLGAADFFLIAVMSLDRYVAICKPLHYLTIMNLKTCSFLVTTCFTLAFTLITGLVVKVSQLSFCGPYVIPHFFCDIGPLIHLSCSDTKPTEMLAFVLALFILLTSLIITIIAYSNIIVTIVQLPSARERQKAFSTCSSHLIVLSLMYGSCVFIYVKLKQTNRMDSNREAALVNTVVTPLLNPVIYTLRNKQVHQALRETMCRMKMSR

SEQ ID NO: 1649 - DNA, 903 bp, Canis familiaris
acggagttcatcctgctgggcttcccagagctgtgccaccttcggggactgcttttcgggttattcctcgccacctacctggtgaccgtcctggagaacctggtcatcgtggtgaccatccgagccagccgccaactgcacacgcccatgtacttcttcctggccaacctgtcagtgctggagaccctctacatctcggtcaccgtccccaagctgctggcgggcctcctggcgcgggcgaggaccatctccttcgcagggtgcctcacgcagctgtttctcttcctctcgctcggctcctccgagtgcttcctcctgaccaccatggcctgtgaccggtacctggccatctgtcgcccgctgcgctacccggccaccatgaaccgggggctctgcctgtggctggccctgggcgcctggctgggcggcttcctggcctcgttcgtgtccgtggctctcatctcgcgcctcaggttctgtggccccaacgtcctcaaccacttcttctgcgacgtctcacccctgctgcagctctcgtgctctgacaccagtgccgtggaagttctagacttcgtggcagccctggctgtgctcgccacctccctgctggtgaccacggtgtcctacgtgcacatcctggccaccgtgctgaggatcccggggtgggccagacgccggagagccttctccacctgcgcctcccacctgctggtggtggccgtcttctacagcaccaccatcttcatgtacgcccggcctcgcgccgccagctccatcgacctcaacaagcgggtgtccgtggtctactcactcgtgaccccgctgctcaaccccgtcttctactgcctgcgcaaccgggacatcagggcggctctggccaaactcctacacgccccgggcctg

SEQ ID NO: 1650 - protein, 301 aa, Canis familiaris
TEFILLGFPELCHLRGLLFGLFLATYLVTVLENLVIVVTIRASRQLHTPMYFFLANLSVLETLYISVTVPKLLAGLLARARTISFAGCLTQLFLFLSLGSSECFLLTTMACDRYLAICRPLRYPATMNRGLCLWLALGAWLGGFLASFVSVALISRLRFCGPNVLNHFFCDVSPLLQLSCSDTSAVEVLDFVAALAVLATSLLVTTVSYVHILATVLRIPGWARRRRAFSTCASHLLVVAVFYSTTIFMYARPRAASSIDLNKRVSVVYSLVTPLLNPVFYCLRNRDIRAALAKLLHAPGL

SEQ ID NO: 1651 - DNA, 936 bp, Canis familiaris
atggcctggggccgcagccagaaccagtctgcgcaggagcccttcatcctgctgggcttcccggggccgctggggctgcacgtggggctcttcgccctcttcctgctcatgtacgtgctggcggtggcgggcaacctggccatcatcggcctggtcggggcgcacccgcgcctccggacgcccatgtacttcttcctctgccacctggccttcctggaggtctggttcaccacggcctgcgtgcccaaggccctggccacgctcgcctcccgccgcggagccatctccccggccggctgcgcggcgcagatgtacttcgtgttctcgctgggctgcacggagtacttcctgctggccgcgatggcctacgaccgctacctggccatctgccggccgctgcgctatggcagcgtcatgacgcccggcctgtgcgcccgcctggcgctcggctgctggctgtgcggcttctcggccatcgccgtgcccgccgccctcatcgcccgcctctccttctgcggcgcccgcgtcatcaaccacttcttctgcgacatcgcgccctggatcgcgctgtcctgcagcgacacgcgcgtggtggagctggcgtccttcggcatcgccttctgcgtcatcctgggctcctgctccgtcacgctgctctcctacgcctgcatcatcgccaccgtcgtcaggatcccggccggcgaggggcggtgcagggccttctccacctgctcctcccacctcactgtggtcctcgtctggtacggctccaccatcttcctgcacgtgaggatgtcggcggagagctcgctggacctcaccaaggccgtcaccgtgctcaacaccgctgtgaccccggtgctgaaccccttcatttacaccctgaggaacagggaggtcagggaggccctgtggggctgggtgcagggcaagtga

SEQ ID NO: 1652 - protein, 312 aa, Canis familiaris
  MOD_RES (312)..(312): Any amino acid
GLGPQPEPVCAGALHPAGLPGAAGAARGALRPLPAHVRAGGGGQPGHHRPGRGAPAPPDAHVLLPLPPGLPGGLVHHGLRAQGPGHARLPPRSHLPGRLRGADVLRVLAGLHGVLPAGRDGLRPLPGHLPAAALWQRHDARPVRPPGARLLAVRLLGHRRARRPHRPPLLLRRPRHQPLLLRHRALDRAVLQRHARGGAGVLRHRLLRHPGLLLRHAALLRLHHRHRRQDPGRRGAVQGLLHLLLPPHCGPRLVRLHHLPAREDVGGELAGPHQGRHRAQHRCDPGAEPLHLHPEEQGGQGGPVGLGAGQVX

SEQ ID NO: 1653 - DNA, 957 bp, Canis familiaris
atgtgcgccccggacaacggctccgaagtgacggagttcatcctggtgggcttcccgggcccggcgggcttccacgcgggcctgctggcgctcttctcgctggcctacgcgctcacggtcacagagaacgcgctcatcgtggcggtgatccgcgtcagccccgcgctgcacaagcccatgtacgtcttcctgggccacctgtccttcctggagctgtggtacgtgtcggtcacggagcccaagatgctgctgggcctggcggcgccgcgcttccggcgcatctcgttcgcgggctgcatggcgcagctgtacttcttcctggcgctggcctgcaccgagtgcgcgctcctgggcgtcatggcctacgaccgctacgtggccatctgccgcccgctgcgctacccggtcgtcatgagcggccgcctctgccgcctgctggccgctggctcgtggctctcgggcttcagcgtgtcgctggggaaggtcttcttcatctcgcgcctgggctactgcggccccaacgtcatgaaccacttcttctgcgacgtgtccccgctgctgaacctggcgtgctccgacatgtcgcgggccgagctcgtggacttcctcctggcgctgctggtgctgctgggcccgctgctgctcaccgtgctgtcctacggcgccatcgtgagcgccgtgctgcgcgcccgctccgccgccggccgccgcaaggccttctccacctgcgccgcgcacctggccgtggtgctcgtcttctactcggcctcgctcttcatctacgcccggccccgcgccatctactccttcgacttcaacaagctggtgtccgtggtctacacggtgctcacgccgctgctcaaccccatcatctactgcctgcggaaccgggaggtgaaggacgcgctgcgcaaggcggccgggagggcggcctgggccctgggtgcccggtcttag

SEQ ID NO: 1654 - protein, 319 aa, Canis familiaris
  MOD_RES (319)..(319): Any amino acid
VRPGQRLRSDGVHPGGLPGPGGLPRGPAGALLAGLRAHGHRERAHRGGDPRQPRAAQAHVRLPGPPVLPGAVVRVGHGAQDAAGPGGAALPAHLVRGLHGAAVLLPGAGLHRVRAPGRHGLRPLRGHLPPAALPGRHERPPLPPAGRWLVALGLQRVAGEGLLHLAPGLLRPQRHEPLLLRRVPAAEPGVLRHVAGRARGLPPGAAGAAGPAAAHRAVLRRHRERRAARPLRRRPPQGLLHLRRAPGRGARLLLGLALHLRPAPRHLLLRLQQAGVRGLHGAHAAAQPHHLLPAEPGGEGRAAQGGREGGLGPGCPVLX

SEQ ID NO: 1655 - DNA, 933 bp, Canis familiaris
atgagcaaccggacgctgctgacggagttcatcctgcagggcttctccgacgcgccgcggctgcgcggccccttcttcgcgctcttcctctgcctcttcgtggcggcgctgggcgggaatctcctcatcgtggcggccatcgcctccagcccgcggctccacacgcccatgtacttcttcctggtcaacctgtctgtgctggacgtcacctgcgcgtgcaccgtggtgcccaagctgctggacatcctgctggcagagaggaggagcatctcctacgggggctgcatggcccagatgtacttcctgtcgtggtcggtggcgggggaggtgctgctcttcacggccatggcctacgaccgctacgtggccatctgccggccgctgcgctacggctccctcatgagccccagggtgtgcgcggcgctggccggcgccgtgtggggcatcagcgtgctgggcgccggggtcaacacctgcctgatgacgcggctcagcttctgcgggcccaacgtgatcgatcacttcttctgcgagatcccccccgtgctggtgctctcctgctcctccacgctcgtgaacgacatcatggccgtgatggccgacatcttcttcgccatgctgaacttcctgctcaccgtggtgtcctacggcttcatcatctccaccatcctgaagatccgcacagccgaggggaagcagcgagccttctccacctgctcctcccacctcaccgccgtcaccttgtactactccaccatcatctacacctacctgagccctggctccagctactccccagggatgggcaaggtcatggccgtactgtactccactgtgagccccaccctgaaccctctcatctactccctcaagaacaaggaggtcaaggcagccctcaggaaagtcttgacgctcgtggtcaaaagcctgtaa

SEQ ID NO: 1656 - protein, 311 aa, Canis familiaris
  MOD_RES (311)..(311): Any amino acid
EQPDAADGVHPAGLLRRAAAARPLLRALPLPLRGGAGRESPHRGGHRLQPAAPHAHVLLPGQPVCAGRHLRVHRGAQAAGHPAGREEEHLLRGLHGPDVLPVVVGGGGGAALHGHGLRPLRGHLPAAALRLPHEPQGVRGAGRRRVGHQRAGRRGQHLPDDAAQLLRAQRDRSLLLRDPPRAGALLLLHARERHHGRDGRHLLRHAELPAHRGVLRLHHLHHPEDPHSRGEAASLLHLLLPPHRRHLVLLHHHLHLPEPWLQLLPRDGQGHGRTVLHCEPHPEPSHLLPQEQGGQGSPQESLDARGQKPVX

SEQ ID NO: 1657 - DNA, 939 bp, Canis familiaris
atgagaaatcacacaaaggtaacagagtttattcttctcgggttgaccgatgacccaaagtggcaggttgtacttttcatatttcttcttgttacctacatgttcagtgtgactgggaacctggtcattatcatcctcaccctaacagatccccacctgaagactccaatgtatttcttccttcgaaacttctcattcctagaaatgtcattcacctctgttgcaattcccagattccttgtcactgttgtgacgggagacagaaccatttcctacaatgactgtctggctcaggtatttttcttcatcttattgggggccacagagttttacctcctgactgccatgtcctatgaccgctacattgccatctgcaaacctctgcattacatgaccatcatgagcagcagagtctgcatccttcttgtctttagctcatggcttgcaggattcctgatcatctttccaccagtaattctggcgctgaagttggatttctgtgcctccaatataattgaccattttatctgtgactcttctccaattctacagctttcttgcacaaacactcactttctagaactcatggcatttattttagcggtggtaacacttatggtcaccttaaccctagttatgctctcctacatatacatcatccgcacaattctgagaattccttccaggagtcaaaggaaaaaagccttttccacgtgttcctcccacatgatagtagtctccctctcttatggaagctgcatcttcatgtacattaagccttctgcaaaggaaagggtgagtttaaacaaaggagtagctgtgatcattacctcagtgactcctctcttgaatcctttcatatatacattaagaaaccagcaggtgaagcaagccttcaagaacatggtccacagaatggccttttcttcatataaatga

SEQ ID NO: 1658 - protein, 312 aa, Canis familiaris
MRNHTKVTEFILLGLTDDPKWQVVLFIFLLVTYMFSVTGNLVIIILTLTDPHLKTPMYFFLRNFSFLEMSFTSVAIPRFLVTVVTGDRTISYNDCLAQVFFFILLGATEFYLLTAMSYDRYIAICKPLHYMTIMSSRVCILLVFSSWLAGFLIIFPPVILALKLDFCASNIIDHFICDSSPILQLSCTNTHFLELMAFILAVVTLMVTLTLVMLSYIYIIRTILRIPSRSQRKKAFSTCSSHMIVVSLSYGSCIFMYIKPSAKERVSLNKGVAVIITSVTPLLNPFIYTLRNQQVKQAFKNMVHRMAFSSYK

SEQ ID NO: 1659 - DNA, 822 bp, Canis familiaris
gtgacccagctctttctctttgccctcttcattgtggctgaagggtttctcctggctgccatggcttatgaccgcttcattgccatctgcaactcactcctctactccgtccagatgtcaacgtgcctctgcattcagttggtggctggttcctatttttttaatttctttttatttttatttatttttatttttttataataaatttattttttattggtgttcaatttaccaacatacagaataacacccagtgctcatcccgtcaagtgctcccctcagtgcccgactcccattcacccccaccccccaccctcctatttttgtggctgcatcagctcggttcttcagacgagaatgacatttactttgtccttttgtgcttcccaagccatcgaccacttttactgtgatgaccatccacttcaaaagattacttgctctgatctctactttcataggatagtttcctttcccttatgcagcattattattttgcctaccatcattgtcattctcgtgtcctatatgtatattgtgtccacagttctaaagataagatccactgagggatgtaagaaagccttctccacttgcagctctcatctaggagtcgtgagcatcctgtacggtgccattatttttatgtatttcatccctgacagattccctgagctgagtaaagtggctccttatgttatacgttagtcactctcatgttgaatcctttgatttactccctgagaaacaaagatgtcaaagaggctctgagaaagatcctggggaaaaatatttttatttaattctatcttaacagtgata

SEQ ID NO: 1660 - protein, 66 aa, Canis familiaris
VTQLFLFALFIVAEGFLLAAMAYDRFIAICNSLLYSVQMSTCLCIQLVAGSYFFNFFLFLFIFIFL

SEQ ID NO: 1661 - DNA, 639 bp, Canis familiaris
gtaattttttttgtcctctttggagcaacagaattttttctccttgccgccatgtcctatgaccgctatgtggtcatttgcaagcccctgcattatacaacgatcatgaataacagagtctgcactaccctcgttctctgctgttggtttgctggcctgttaatcatcctcccgcctcttggcctgggcctccagctggaattctgtgactcaaatgtgattgatcattttggctgtgatgcatctccaattttacagataacctgctcagacacagtcttaatagagagaattgttctgagttttgccgtgctgacactcattatcaccttagtgtgtgtagtcctctcttatacctacatcaagaccattctaagattcccttctgcccaacaaaggaaaaaggtcttttccacctgctcttcccatatgattgtggtttccatcacttatggcagctgcatcttcatctacatcaaaccttcagcaaaggaaggagtagctattaataaagtggtgtctgtgctcactacttcagttgctcctttgtttaacccattcatttatacacttcgaaacaaacaagtgaaagatgccttcaaagacacagtaaaatggattgtatttctcacaaagaag

SEQ ID NO: 1662 - protein, 213 aa, Canis familiaris
VIFFVLFGATEFFLLAAMSYDRYVVICKPLHYTTIMNNRVCTTLVLCCWFAGLLIILPPLGLGLQLEFCDSNVIDHFGCDASPILQITCSDTVLIERIVLSFAVLTLIITLVCVVLSYTYIKTILRFPSAQQRKKVFSTCSSHMIVVSITYGSCIFIYIKPSAKEGVAINKVVSVLTTSVAPLFNPFIYTLRNKQVKDAFKDTVKWIVFLTKK

SEQ ID NO: 1663 - DNA, 933 bp, Canis familiaris
atgaaaaatcattctgcaataacattcatcctactaggattaacagatgatccacgactacaggtttttctttcattatttctgtttttcacctacattttcactgttgctggaaatctaatcattatcctcctcactcttgtagactctcacctcaaaacacccatgtactttttccttcggaatttttccatcttagaaataatatttacaactgtctgtgttcctcgattcttatacagcctgacaactggggacaaaagtgttacctataatgcttgtgtcatccaattgttttttgttatcctcattggagcaacagaattttttcttctaaccgccatgtgctatgaccgctatgtcgccatctgcaagcccttgcactacactatcatcatgaatgaaagggtatgcacaattcttgtcctttgctgttggctgattgggttaattgtcatactcccaccacttagcttgggagttcagctagatttctgtaactccaatctcattgaccattttggttgtgatgcatctcctctcctgaagattgtatgctcagacactcaatttgtagagcaacttgttttaatcatggctgtgttgaccctcatagtcacattagtctgtgtatttgtgtcatacacatatattgtcaagaccattttaagactcccttcagttcagcaaaggaaaaaggctttctccacttgttcttcccatatgattgtagtttctatcacctatggaagttgcatcttcatctatatcaaacctgcaaaggaaggagtggctcttaataaggtagtgtcattgctcaatacctcaatcatccctttgatgaaccctttcatttatacactacggaataagcaagtcaaacaagcctttaaggactcaattaaaaagatggcctttctttcaaaggattag

SEQ ID NO: 1664 - protein, 310 aa, Canis familiaris
MKNHSAITFILLGLTDDPRLQVFLSLFLFFTYIFTVAGNLIIILLTLVDSHLKTPMYFFLRNFSILEIIFTTVCVPRFLYSLTTGDKSVTYNACVIQLFFVILIGATEFFLLTAMCYDRYVAICKPLHYTIIMNERVCTILVLCCWLIGLIVILPPLSLGVQLDFCNSNLIDHFGCDASPLLKIVCSDTQFVEQLVLIMAVLTLIVTLVCVFVSYTYIVKTILRLPSVQQRKKAFSTCSSHMIVVSITYGSCIFIYIKPAKEGVALNKVVSLLNTSIIPLMNPFIYTLRNKQVKQAFKDSIKKMAFLSKD

SEQ ID NO: 1665 - DNA, 939 bp, Canis familiaris
atgagaaatcacacagcaataacaacattcatcttgttgggacttacagaggacccacagctgcaagttcttctttttatcttcttatttctcagctacgtgctgagcattactggaaatttgaccattatcattcttacatttatggattctcatcttaaaacacctatgtatttttttctctgcaatttctccatcttagaaatctcattcacaacagtatgcattcccagattcttgtacagtataacaactggagacaacactattacgtataatgcttgcgcttgccaaatattttttattgggctttttggggtcacagaattttttctcctggcagccatgtcctatgaccgctatgtggccatctgcaaaccccttcattatatgaccatcatgaataacaaagtctgtaccatccttgtcctctgttgctggatttctgggctgctgatcatcatcacaccccttggtatgggcctccagctggaattctgtgactccaatgccattgatcattttggctgtgatgcatctcctctttttaagatttcatgctcggatacatgggttatagaacaggtggttataatctgtgcagtactgacattcattattacactgataggtgtcattctttcctatatatatatcatcaggacaattctaagattttcttctgcttctcaaagaaaaaaagctttctccacctgttcttcacacatgcttgttgtttccattacatacggcagctgtattttcatctatatcaagccttcggccaaagaagaggtggatatcaataaaggggtatccgtgctcactacatctgttgctcctttgttgaaccctttcatttatactttgaggaacaagcaagtgaaacgagctttcaatgacacaatcaaaaaaattgcatttatcttacacaaataa

SEQ ID NO: 1666 - protein, 312 aa, Canis familiaris
MRNHTAITTFILLGLTEDPQLQVLLFIFLFLSYVLSITGNLTIIILTFMDSHLKTPMYFFLCNFSILEISFTTVCIPRFLYSITTGDNTITYNACACQIFFIGLFGVTEFFLLAAMSYDRYVAICKPLHYMTIMNNKVCTILVLCCWISGLLIIITPLGMGLQLEFCDSNAIDHFGCDASPLFKISCSDTWVIEQVVIICAVLTFIITLIGVILSYIYIIRTILRFSSASQRKKAFSTCSSHMLVVSITYGSCIFIYIKPSAKEEVDINKGVSVLTTSVAPLLNPFIYTLRNKQVKRAFNDTIKKIAFILHK

SEQ ID NO: 1667 - DNA, 972 bp, Canis familiaris
atggttagatttcaaaagtcagtgatgagaaactatacagcaataacaacttttatcctgctgggactgacagacgacccacaactgcaaatcctgctctttatctttctatttctcacctacatcttgagcgtaacagggaaccggactattatcaccctcacactggtgaactcccatcttaaaactcctatgtacttttttctgagaaatgtttccttcttagaagtgtcattcaccactgtctgcattcctagattcctgtatagcatatcaacaggggccaatactattacctacaatgcttgtgcaagtcaaatatcttttgttattctctttggagcaactgaattttttctcctggcagccatgtcctatgatcgctatgttgctatctgtaaaccacttcattacatgaccatcatgagcaatagggtgtgtagcttattagtcttctgctgttgggtgtctggcttgatgatcattctcccaccccttagcttgtgcctccagctggaattctgtgactcgaatgccatcgatcattttagctgtgatgcaggtcccctcctgaagatctcatgttcagatacatggatgatagaacaaatggttatccttgtggctgtatttgcactcattatcaccttagtgtgtgtatttctgtcctacacatacatcatcaggacaattctgagattcccctctgtccaacaaagaaaaaaggccttttccacctgctcatcccacatgattgtagtttccatcacctatggaagcggcatcttcatctatatcaagtcatcagcaaaagaagagatagccataaataaaggtgtttcggtgctcactacttctgttgcacccttgctgaaccccttcttttacaccttgagaaataagcaagtgaaacaagcttttaatgacttcataaagaagatgacatttcactcaaagaaactgaagttttga

SEQ ID NO: 1668 - protein, 323 aa, Canis familiaris
MVRFQKSVMRNYTAITTFILLGLTDDPQLQILLFIFLFLTYILSVTGNRTIITLTLVNSHLKTPMYFFLRNVSFLEVSFTTVCIPRFLYSISTGANTITYNACASQISFVILFGATEFFLLAAMSYDRYVAICKPLHYMTIMSNRVCSLLVFCCWVSGLMIILPPLSLCLQLEFCDSNAIDHFSCDAGPLLKISCSDTWMIEQMVILVAVFALIITLVCVFLSYTYIIRTILRFPSVQQRKKAFSTCSSHMIVVSITYGSGIFIYIKSSAKEEIAINKGVSVLTTSVAPLLNPFFYTLRNKQVKQAFNDFIKKMTFHSKKLKF

SEQ ID NO: 1669 - DNA, 936 bp, Canis familiaris
atgaaaaattatacagcaataacaacattcatcttggtgggattaacaaatgacccacatctacagattctgctttttatttttctatttctaacctacttgttgagtgttgtagggaatctgaccattatcagcctcacgttggtggattcccaccttaaaacacccatgtattttttcctccagaatttctccatcttggaagtgttctttaccactgtctgcattcctagattcctctacacaatggcatctggggacaataccgttacctacgatgcatgtgccactcaattattttttgttgtcatattgggtgtgactgaatttttcctcctcacagccatgtcctatgaccgctatgtggccatctgcaaacccctgcattacatgaccatcatgaacaacagggtctgcatcaagttccttattggatgttatatgttagctctgctcatcgtcctcccaccctatatcatgggcttcaagctcgagttttgtgactccaatgtcatagatcactttggctgtgatgctgctcccatcctgaagattacctgctcagacacagagtttatcgagcgatttgtcttggtcctggctgtgttgaccctcattttcaccttggtgtgtgtaattctgtcctacacatacatcattaggaccattctcagatttccttctgtccagcaaaggaaaaaggctttttctacttgttcttcccatataattgtggtttctattacttatggaagctgcatctttatctatatcaaacctcatgcaaaagaaggggttgctattaataaggtggtgtcagtgcttaccacttcagttgccccagtgatgaatccctttatttatactctgaggaacaagcaagtggtacaagctttcaaagacatgatcaaaagagttgcatctatctcaaagaat

SEQ ID NO: 1670 - protein, 312 aa, Canis familiaris
MKNYTAITTFILVGLTNDPHLQILLFIFLFLTYLLSVVGNLTIISLTLVDSHLKTPMYFFLQNFSILEVFFTTVCIPRFLYTMASGDNTVTYDACATQLFFVVILGVTEFFLLTAMSYDRYVAICKPLHYMTIMNNRVCIKFLIGCYMLALLIVLPPYIMGFKLEFCDSNVIDHFGCDAAPILKITCSDTEFIERFVLVLAVLTLIFTLVCVILSYTYIIRTILRFPSVQQRKKAFSTCSSHIIVVSITYGSCIFIYIKPHAKEGVAINKVVSVLTTSVAPVMNPFIYTLRNKQVVQAFKDMIKRVASISKN

SEQ ID NO: 1671 - DNA, 942 bp, Canis familiaris
atgttagcaatgaaaaaccaaacccttctgacagaattcattctcctgggactaacagaaatcccagagatccaatttgtagtctttctatttctcttcctcacctacatattcagcatcattggaaacctcacaatcatcacacttacactactggactcacacctccagactcccatgtatttcttcctccggaatttctccttcctagaaatttcctttacaaccacctttactcctaggctgctgttcagcatcacaactggcaacaagagcattagctttgctggctgcttcactcagtatttctttgccatcttctttggagccacagagttttaccttctggctgccatgtcctatgaccgctatgtggctatatgcaaacccctgcattacatgaccattatgagcaacagagtctgcattcagctggttttcttctcttggttggctggatttctaatcatcatatccccaatcatcctgaccagtcagctggatttctgtgcctccaacatactgaatcattattattgtgactacggacccctgctagaaatatcttgctcagacacaagactcttagagctggttgactttatcttagcagctgtgacgttggtggtcaccctggtgctggtgattctctcctacacaagcatcatctggaccatcctcaagatcccatctgctcagcaaaggaaaaaggccttttccacatgtttttcccacatgattgtcattgccctttcttatggcagctgcatcttcatgtatataaaaccctcagccaaagaaggagttgccttcaataagggggtagctgtgctcaatacctcagttgcccctttattgaacccattcatttacactttaaggaataaacaagtaaaacaggccttcaaggatgtcatcaaaaaggttatgagcatttggtga

SEQ ID NO: 1672 - protein, 313 aa, Canis familiaris
MLAMKNQTLLTEFILLGLTEIPEIQFVVFLFLFLTYIFSIIGNLTIITLTLLDSHLQTPMYFFLRNFSFLEISFTTTFTPRLLFSITTGNKSISFAGCFTQYFFAIFFGATEFYLLAAMSYDRYVAICKPLHYMTIMSNRVCIQLVFFSWLAGFLIIISPIILTSQLDFCASNILNHYYCDYGPLLEISCSDTRLLELVDFILAAVTLVVTLVLVILSYTSIIWTILKIPSAQQRKKAFSTCFSHMIVIALSYGSCIFMYIKPSAKEGVAFNKGVAVLNTSVAPLLNPFIYTLRNKQVKQAFKDVIKKVMSIW

SEQ ID NO: 1673 - DNA, 891 bp, Canis familiaris
atgaaaaatcattctgcaataacattcatcctactaggattaacagatgatccacgactacaggtttttctttcattatttctgtttttaacctacattttcactgttgctggaaatctaatcattatcctcctcactcttgtagactctcacctcaaaacatccatgtactttttccttcggaatttttccatcttagaaataatatttacaactgtctgtgttcctcgattcttatacagcctgacaactggggacaaaagtgttacctataatgcttgtgtcatccaattattttttgttatcctcattggagcaacagaattttttcttctaaccgccatgtgctatgactgctatgttgccatctgcaagcccttgcactacactatcatcatgaatgaaagaggatgcacaattcttgtcctttgctgttggctgattgggttaattgtcatactcccaccacttatcctgggagttcagctagatttctgtaactccaatctcattgaccattttggttgtgatgcatctcctctcctgaatattgtatgctcagacgctcaatttgtagagcaacttgttttaatcatggctgtgttgaccctcatagtcacattagtctgtgtatttgtgtcatacacatatattgtcaagaccattttaagactcccttcagctcagcaaaggaagaaggctttcttcacttgttcttcccatatgattgtaatttccatcacctatggaagttgcatcttcatcttcatttcattgctcaatacctcaatcatccctttgatgaaccctttcatttatacactacggaataagcaagtcaaacaagcctttaaggactcaattaaaaagatggcatttctttcaaaggat

SEQ ID NO: 1674 - protein, 297 aa, Canis familiaris
MKNHSAITFILLGLTDDPRLQVFLSLFLFLTYIFTVAGNLIIILLTLVDSHLKTSMYFFLRNFSILEIIFTTVCVPRFLYSLTTGDKSVTYNACVIQLFFVILIGATEFFLLTAMCYDCYVAICKPLHYTIIMNERGCTILVLCCWLIGLIVILPPLILGVQLDFCNSNLIDHFGCDASPLLNIVCSDAQFVEQLVLIMAVLTLIVTLVCVFVSYTYIVKTILRLPSAQQRKKAFFTCSSHMIVISITYGSCIFIFISLLNTSIIPLMNPFIYTLRNKQVKQAFKDSIKKMAFLSKD

SEQ ID NO: 1675 - DNA, 936 bp, Canis familiaris
atgaatcacacagtgatcaccaagtttgtcctgctaggcctttctgatgatcctgaccttcagattgtgattttcctcttcttattcgtcacatacttactaagtgtcactggaaacctgactatcatcaccctaaccttggtggactctcatctacagacgccaatgtatttcttcctccgaaacttctctttcttagaaatcttatttacaactgtatgtattcctagatttctgggggcaattatcaccagggataagactatttcctataacgactctgcagtccagctgtttttctttattttaatgggggtgatggaattttacattctcactgccatgtcttatgacggctatgttgccatctgcaagccccttcattacaccaccatcatgatcaggaaggtctgcactctacttgtgctctgtgcatggctcggtgggttcttgaccattttcccaccccttatgcttctactccagctgaattactgtgcttccaatgtcattgaccactttgcatgtgactattttccccttttacaactgtcttgttcagatacgtggctcctagaggtaattggtttctactttgatttagttgccttgctattcactttggccttggtgattttatcttatctgtatataatcagaactattttgagaatcccatctgccagtcagagaaaaaaggctttctccacatgttcttctcatatgattgtcatttccatttcttatgggagctgtatatttatgtatgctaatccctctgcaaaagaaagggcatcattgaccaaaggagtagctattctcaatacttctgttgcccccatgctgaacccttttatttacactctgagaaaccagcaagtaaaacaagctttcaaagatatggtccataaagtagtattttcttcaagtaaatga

SEQ ID NO: 1676 - protein, 311 aa, Canis familiaris
MNHTVITKFVLLGLSDDPDLQIVIFLFLFVTYLLSVTGNLTIITLTLVDSHLQTPMYFFLRNFSFLEILFTTVCIPRFLGAIITRDKTISYNDSAVQLFFFILMGVMEFYILTAMSYDGYVAICKPLHYTTIMIRKVCTLLVLCAWLGGFLTIFPPLMLLLQLNYCASNVIDHFACDYFPLLQLSCSDTWLLEVIGFYFDLVALLFTLALVILSYLYIIRTILRIPSASQRKKAFSTCSSHMIVISISYGSCIFMYANPSAKERASLTKGVAILNTSVAPMLNPFIYTLRNQQVKQAFKDMVHKVVFSSSK

SEQ ID NO: 1677 - DNA, 939 bp, Canis familiaris
atgagaaaccacacagaaataacagattttattctcctgggattgtcagatgacccacagcttcaggaggtgatctttgtctttctgcttatcacctacatgctcagcatcactgggaacctgaccattatcaccctcaccctgctggattcccacctccagacccccatgtatttcttcctcagaaacttctccttactcgagatttcattcacaactgtgagcatacccaagttcctgagcaccctgattacaggagataaaaacatttcctttaaagattgcatggctcagttcttttttctcatcttattgggagtcactgaattttgccttctggctgccatgtcctatgaccgatacattgccatctgcaaacctctgcattacatgaccatcatgaatcccagagtctgcacactccttgtctttgcttcttggtcggcttcattcttaatcatattcccattactcatgctgttcatacagcttgattattgtaagtccaatgttatagaccattttacctgtgactatttccccttactacatctttcttgttcagacactagattcttagagatagtgggtttttcctgtgctgtttttacattaatgttcacattggcattaataattctgtcctacatatatatcctcagaacaattttgaggattccttctactagtcagaggacaaaggccttttccacctgttcttcccacatgattgtcatctccatctcctatggcagctgcattttcatgtatattaacccagcagcaaaagacagagtgtctctgagcaagggagttgctgtgctaaacacctcggtagcccccatgctgaacccctttatttacagcctaaggaaccagcaagtcaagcgagccttcctggacagggcaaggaagattgtatttttctcaagcaaatga

SEQ ID NO: 1678 - protein, 312 aa, Canis familiaris
MRNHTEITDFILLGLSDDPQLQEVIFVFLLITYMLSITGNLTIITLTLLDSHLQTPMYFFLRNFSLLEISFTTVSIPKFLSTLITGDKNISFKDCMAQFFFLILLGVTEFCLLAAMSYDRYIAICKPLHYMTIMNPRVCTLLVFASWSASFLIIFPLLMLFIQLDYCKSNVIDHFTCDYFPLLHLSCSDTRFLEIVGFSCAVFTLMFTLALIILSYIYILRTILRIPSTSQRTKAFSTCSSHMIVISISYGSCIFMYINPAAKDRVSLSKGVAVLNTSVAPMLNPFIYSLRNQQVKRAFLDRARKIVFFSSK

SEQ ID NO: 1679 - DNA, 882 bp, Canis familiaris
ccagagtttcagattgtgatttttctctttttaattctcacatacatattcagtgtcactggaaatttgaccatcatcactctcaccttggtggactcccatctacagacccctatgtattttttcctcaggaacttctctgtattagaaatatcctttacaaccatctgtattcctagatttctgggcacaattatcaccagagactaaactatttcatacaatgattgtacagctcagttgtttttcttcatcttcatgggcataactgagttttatcttctaactgctatgtcctatgatcgctatgtagccatctgtaaacccttgcattacacgactatcatgaacaaaagagtctgcattttacttgtcttttgtgcatggctggcaggattcttaaatatcttcccgccaattattcttttcctccagttagattactgtggctccaatgtcattgatcactttgcttgtgactattttcccctcttgcaattatcttgctcagacacatggctcctagaagtgattggtttttactctgcaatagtgattctgcttttcactctggcactaataattctatcctacatgttcatcattagaacaattctgaaactgccatctgccagtcagagaaaaaaggcattttctacatgctcctcgcacatgattgtcatttccatctcttatggaagctgcatattcatgtatgccaacccctctgcaaaagaaaaggcatccttgaccaaaggagtagctattcttaatacttctgttgctcctatgatgaatccatttatatataccctgaggaatcagcaagtaaagcaagcctttaaggatactatccaaaaggttctgtttttctccagtaaa

SEQ ID NO: 1680 - protein, 208 aa, Canis familiaris
MGITEFYLLTAMSYDRYVAICKPLHYTTIMNKRVCILLVFCAWLAGFLNIFPPIILFLQLDYCGSNVIDHFACDYFPLLQLSCSDTWLLEVIGFYSAIVILLFTLALIILSYMFIIRTILKLPSASQRKKAFSTCSSHMIVISISYGSCIFMYANPSAKEKASLTKGVAILNTSVAPMMNPFIYTLRNQQVKQAFKDTIQKVLFFSSK

SEQ ID NO: 1681 - DNA, 933 bp, Canis familiaris
atgaataatagaacatcagtgaccaacttcatcctcctgggtctgaccgacaatccagaaatacaggctgtaaatttcctctttctatttctcacctacgtactgagtgttactggaaatctcaccatcatcattcttaccctgctggattcccacctggaggctcccatgtattttttcctccgattttttcctccgaatttctccttagaaatttcattcacttctgtctgtaatcctagatttttcatcagcatcgtaactggagacaaatctatttcctataatgcttgtgcagctcagctatttttctttgtcctccttggctaaccagtttttcttctggctgctatgtcctatgatcattatgcggctatctgcaagcttctacattatacaaccaccatgagtaacaagatttgctaccagcttgtagtcagctcttgggtggctggtttcttggtaatcttcccaccactagccatgggtctgcagttggatttctgtgactccaatgtcattgaccacttcacctatgattctgctcctttactccaaatgtcttgcacagacacaagtactctagagctcatgagctttgttttagccatacttactcttatgtccactttgatgttagtaattctctcccactcttacatccttagaacaattctgaaaatcccttcagctcaacaaagaaaaaaggccttctcaacctgctcctcccatatgatagttgtctctatctcttatgggagctgcatcttcatgtatgtcaaaacatcagcaaaggaaggggttgctttgacaaaaggtgtggctatgctcagtacctctgttgctctcatgctgaatccatttatttacactttaaggaaccagcaggtgaaagaagcatttaaggacgttgtgaaaaagatacttttctca

SEQ ID NO: 1682 - protein, 194 aa, Canis familiaris
MSYDHYAAICKLLHYTTTMSNKICYQLVVSSWVAGFLVIFPPLAMGLQLDFCDSNVIDHFTYDSAPLLQMSCTDTSTLELMSFVLAILTLMSTLMLVILSHSYILRTILKIPSAQQRKKAFSTCSSHMIVVSISYGSCIFMYVKTSAKEGVALTKGVAMLSTSVALMLNPFIYTLRNQQVKEAFKDVVKKILFS

SEQ ID NO: 1683 - DNA, 972 bp, Canis familiaris
atggttagatttcaaaagtcagtgatgagaaactatacagcaataacaacttttatcctgctgggactgacagacgacccacaactgcaaatcctgctctttatctttctatttctcacctacatcttgagcgtaacagggaaccggactattatcaccctcactctggtgaactcccatcttaaaactcctatgtacttttttctgagaaatgtttccttcttagaagtgtcattcaccactgtctgcattcctagattcctgtatagcatatcaacaggggccaatactattacctacaatgcttgtgcaagtcaaatatcttttgttattctctttggagcaactgaattttttctcctggcagccatgtcctatgatcgctatgttgctatctgtaaaccacttcattacatgaccatcatgagcaatagggtgtgtagcttattagtcttctgctgttgggtgtctggcttgatgatcattctcccaccccttagcttgtgcctccagctggaattctgtgactcgaatgccatcgatcattttagctgtgatgcaggtcccctcctgaagatctcatgttcagatacatggatgatagaacaaatggttatccttgtggctgtatttgcactcattatcaccttagtgtgtgtatttctgtcctacacatacatcatcaggacaattctgagattcccctctgtccaacaaagaaaaaaggccttttccacctgctcatcccacatgattgtagtttccatcacctatggaagcggcatcttcatctatatcaagtcatcagcaaaagaagagatagccataaataaaggtgtttcggtgctcactacttctgttgcacccttgctgaaccccttcttttacaccttgagaaataagcaagtgaaacaagcttttaatgacttcataaagaagatgacatttcactcaaagaaactgaagttttga

SEQ ID NO: 1684 - protein, 323 aa, Canis familiaris; identical to SEQ ID NO: 1668

SEQ ID NO: 1685 - DNA, 939 bp, Canis familiaris
atgagaaatcacacagcaataacaacattcatcttgttgggacttacagaggacccacagctgcaagttcttctttttatcttcttatttctcagctacgtgctgagcattactggaaatttgaccattatcattcttacatttatggattctcatcttaaaacacctatgtatttttttctccgcaatttctccatcttagaaatctcattcacaacagtatgcattcccagattcttgtacagtataacaactggagacaacactattacgtataatgcttgcgcttgccaaatattttttattgggctttttggggtcacagaattttttctcctggcagccatgtcctatgaccgctatgtggccatctgcaaaccccttcattacatgaccatcatgaataacaaagtctgtaccatccttgtcctctgttgctggatttctgggctgctgatcatcatcacaccccttggtatgggcctccagctggaattctgtgactccaatgccattgatcattttggctgtgatgcatctcctctttttaagatttcatgctcggatacatgggttatagaacaggtggttataatctgtgcagtactgacattcattattacactgataggtgtcattctttcctatatatatatcatcaggacaattctaagattttcttctgcttctcaaagaaaaaaagctttctccacctgttcttcacacatgcttgttgtttccattacatacggcagctgtattttcatctatatcaagccttcggccaaagaagaggtggatatcaataaaggggtatccgtgctcactacatctgttgctcctttgttgaaccctttcatttatactttgaggaacaagcaagtgaaacgagctttcaatgacacaatcaaaaaaattgcatttatcttacacaaataa

SEQ ID NO: 1686 - protein, 312 aa, Canis familiaris
MRNHTAITTFILLGLTEDPQLQVLLFIFLFLSYVLSITGNLTIIILTFMDSHLKTPMYFFLRNFSILEISFTTVCIPRFLYSITTGDNTITYNACACQIFFIGLFGVTEFFLLAAMSYDRYVAICKPLHYMTIMNNKVCTILVLCCWISGLLIIITPLGMGLQLEFCDSNAIDHFGCDASPLFKISCSDTWVIEQVVIICAVLTFIITLIGVILSYIYIIRTILRFSSASQRKKAFSTCSSHMLVVSITYGSCIFIYIKPSAKEEVDINKGVSVLTTSVAPLLNPFIYTLRNKQVKRAFNDTIKKIAFILHK

SEQ ID NO: 1687 - DNA, 963 bp, Canis familiaris
atgagaaaccaaacagcactaacaactttcatcttgctgggactcaccgaggaccctcaactaaaaattttgctttttatgtttctgtttctttcctacatgttgaatgtatctggaaacctaaccatcatcatcctcactctgattgattcccaccttaaaacaccaatgtatcttttcctccaaaatttctccttcctagaaatttcattcacaacttcttgtgtccccagatttttatatagcatatcatcgggggacaaatccattacctataatgcttgtgtcagtcaactgttgtttacagacctctttgcagtaacagaattttttctctttgctactatgtcctatgatcgctatgtggccatctgcaaacccctgcattacatgaccatcatgagcagaagagtctgcaagaacttcatcgtcttctgttgggtagcagcactgatcatcattctcccaccaattagtctagttttgggcctggaattctgtgattcaaacatcattgatcatttttgttgtgatgcatctcctatcctgaagatctcttgctcagacacatggttgatagaacagatggttatagtctgtgctgtgttgacattcatcatcaccctcatgtgtgtagttctttcttacatttatattatagggaccattctaaggtttccctttgctcagcaaaggaaaaaggccttttccacttgttcttcccacatgattgttgtttccattacttatggtagctgtatcttcatttatgtcaaaccttcagccaaggatgaggtagctattaataaagggatttcactccttattacttctatctcaccaatgttgaatccctttatttacacactgagaaacaagcaagtgaagaaagcttttcatgattcaattaaaaaattgcattcctatcaaagatgtaaaggagaaatgagtcaattaatctaa

SEQ ID NO: 1688 - protein, 320 aa, Canis familiaris
MRNQTALTTFILLGLTEDPQLKILLFMFLFLSYMLNVSGNLTIIILTLIDSHLKTPMYLFLQNFSFLEISFTTSCVPRFLYSISSGDKSITYNACVSQLLFTDLFAVTEFFLFATMSYDRYVAICKPLHYMTIMSRRVCKNFIVFCWVAALIIILPPISLVLGLEFCDSNIIDHFCCDASPILKISCSDTWLIEQMVIVCAVLTFIITLMCVVLSYIYIIGTILRFPFAQQRKKAFSTCSSHMIVVSITYGSCIFIYVKPSAKDEVAINKGISLLITSISPMLNPFIYTLRNKQVKKAFHDSIKKLHSYQRCKGEMSQLI

SEQ ID NO: 1689 - DNA, 936 bp, Canis familiaris
atgagaaacggtacaataacaacattcattctgctgggactgacagatgaccctgagctgcaagttctgatttttatctttctatttctcacctacactttgagtataactggaaacctggccatcatcatactcacttttgtggatccccaccttaaaacacccatgtactttttcttaaaaaatttctccttcttggagatctcattcacatctgccattattcccagatatttgtatagcatagcaacaggtgacaatgttattacctataatgcttgtgtcattcaagtgttttttactgacctctgtggagtatcagagttttttctgctggccgccatgtcctatgaccgctatgttgccatctgcaaacccttgcattatgtgatcataatgagtaacagcgtctgcaggattctcaatatctgttgttgggtggctggtttatgtatcataatcccaccacttagcctgggtttaaatctaaaattttgtgactctaacataattgatcattttggctgtgatgcatttcccttagtgaaaatctcatgttcagatacaaggttcatggaatggacagttataatatgtgccatagtgaccttgaatatgactcttacctgtgtggttctgtcatatgcttacatcatcaagacaatttttagattcccttctgttcaacaaaggaaaaaggccttttcgacgtgttcttcccacatgattgtggtatccatcacctatggcacatgcattttcatctatatgaatcctacagcaaaggaaaaagtgaccattaataaagtggtttcactgctcatttcttctatttcacctacattgaacccatttatttataccttgagaaacaatcaagttaagaaagccttcgaggactcaatcaaaagaattgccttgctctcaactaagtaa

SEQ ID NO: 1690 - protein, 311 aa, Canis familiaris
MRNGTITTFILLGLTDDPELQVLIFIFLFLTYTLSITGNLAIIILTFVDPHLKTPMYFFLKNFSFLEISFTSAIIPRYLYSIATGDNVITYNACVIQVFFTDLCGVSEFFLLAAMSYDRYVAICKPLHYVIIMSNSVCRILNICCWVAGLCIIIPPLSLGLNLKFCDSNIIDHFGCDAFPLVKISCSDTRFMEWTVIICAIVTLNMTLTCVVLSYAYIIKTIFRFPSVQQRKKAFSTCSSHMIVVSITYGTCIFIYMNPTAKEKVTINKVVSLLISSISPTLNPFIYTLRNNQVKKAFEDSIKRIALLSTK

SEQ ID NO: 1691 - DNA, 960 bp, Canis familiaris
atggaggagttcaaccattctagagtgtctgaatttgtgttacttggacttacggattctcctgagctccagatttttttctttgtgatattttctgttttctatttgataactatgttgggcaactgtcttattttgctcacagttctatccaccccacaccttcactcccctatgtatttcctcctcagcaacctgtctctcattgacatatgcctgtcctcctttgccactccaaagatgatcatggacttctttgctaaacataagaccatctcctttgagggctgtatttctcagatcttctttttgcacctcttcactgggactgagattgtactattgatctccatgtcttttgacaggtacattgccatatgtaaacctctccattattcaacaattatgaaccaaagagtgtgtgttgggcttgtggtaacttcttggacagtgggcttcctgcatacaacaagccagttagcttttaccctctatttacccttctgtggtcccaatgttgtagacagtttcttctgtgaccttcctttggtcatccagctcgcttgtatagatatatatgttcttggaatcttcatgatctcaaccagtggtgtgattgctcttgtaagttttctgcttttgctcacctcctatatcattgtgcttgtcactattaaggaccgctcctttacaggaacatctaaggctttttctacctgcactgcacatttcatagttgtgttaatgttctttgggccttgtatctttatttatgtgtggcctttcaccaacttcctgatggacaaagttctgtccgttttctataccattttcaccccctttctgaatccacttatctatactttgagaaatcaggaagtgaagatagctgtgaagaagaaactaactaatcaaagcttaaatcttgggaaaactagtccaaattacccagtgcagtga

SEQ ID NO: 1692 - protein, 319 aa, Canis familiaris
MEEFNHSRVSEFVLLGLTDSPELQIFFFVIFSVFYLITMLGNCLILLTVLSTPHLHSPMYFLLSNLSLIDICLSSFATPKMIMDFFAKHKTISFEGCISQIFFLHLFTGTEIVLLISMSFDRYIAICKPLHYSTIMNQRVCVGLVVTSWTVGFLHTTSQLAFTLYLPFCGPNVVDSFFCDLPLVIQLACIDIYVLGIFMISTSGVIALVSFLLLLTSYIIVLVTIKDRSFTGTSKAFSTCTAHFIVVLMFFGPCIFIYVWPFTNFLMDKVLSVFYTIFTPFLNPLIYTLRNQEVKIAVKKKLTNQSLNLGKTSPNYPVQ

SEQ ID NO: 1693 - DNA, 273 bp, Canis familiaris
atggatggagcaaatcactctgtggtgtcagagtttgtgttcctgggactcaccaactcctgggagatccagcttctcctctttgtgttttcctccacgttttatatggcaagcatgatgggaaactccctcatcatgctcactgtgacttctgaccctcacctgcactcccccatgtactttctgttggccaacctctccttcattgacctgggagtttcttcagtcacttctcccaagatgatttatgatctttcagaaaagatacaaatt

SEQ ID NO: 1694 - protein, 91 aa, Canis familiaris
MDGANHSVVSEFVFLGLTNSWEIQLLLFVFSSTFYMASMMGNSLIMLTVTSDPHLHSPMYFLLANLSFIDLGVSSVTSPKMIYDLSEKIQI

SEQ ID NO: 1695 - DNA, 429 bp, Canis familiaris
cccttctgtggtcctaatgtgctggacagcttttactgtgaccttccttggttcatcagacttgcctgcacagagacttaccgactagagtttatggtcatagccaatagtggagttggctccttcttcatactgatcatttcctatatcatcatcattctctctgttcagaaacactcttcagctggttcatccaagtctctgtccacactgtcagctcacatcactgtggtattcttgttctttagtcctttgatatttgtctatatgtggccatttccctccatacacctggataaatttctggccatctttgatgctgttctcactccctttctgaatccagtcatctatacattcaggaatcaagaaatgaaggtggcaatgaggagagtatgcagacagctagtgaattacaggaagatctct

SEQ ID NO: 1696 - protein, 143 aa, Canis familiaris
PFCGPNVLDSFYCDLPWFIRLACTETYRLEFMVIANSGVGSFFILIISYIIIILSVQKHSSAGSSKSLSTLSAHITVVFLFFSPLIFVYMWPFPSIHLDKFLAIFDAVLTPFLNPVIYTFRNQEMKVAMRRVCRQLVNYRKIS

SEQ ID NO: 1697 - DNA, 939 bp, Canis familiaris
atgggtggagcgaatcactctgtggtgtcagagtttgtgttcctgggactcaccaactcctgggagatccagcttctcctctttgtgttctcctccatgttttatgtggcaagcatgatgggaaactccctcatcatgctcactgtgacttttgaccctcacctgcactctcccatgtactttctgttggccaacctctccttcattgacctgggagtttcttcagtcatttctcctaagatgatttacgaccttttcagaaaacgtaaagtcatctcctttggtggttgcatcactcagatcttctttctccatgtcattggtggtgtggagatgatgctgctcatcgccatggcctttgacagacatgtggccatatgtaagcctctccactatttgaccattattaaccgaaaaatgtgtattttgcttctggttgctgcttgggtagttggcttggcccactctatgattcaactggtttttgttataaaattgccattctgtggccctaatgtgctggacagcttttactgtgacttccctcggttcatcaaacttgcctgcacagatactttcagtctagagttcatggtcacagccaacagtggttttatatctctggggtcattcttcatattgattgtctcctatagttttatcctgatcactgttaggaaacactcctcaagaggctcatccaaggccctctccactttgtcagctcatatcatggtggtgattttgttctttggtccttgcatctttgtttatatctggcctcaccccacatcatgcttagacaaatttcttgctgtttttgatgcagttcttactcccttttttaattcagtcatctatacattaaggaacaaagaaatgaaagtggcaatgagtaaaatatgcagtcaatttattatttatagaaggatttcttaa

SEQ ID NO: 1698 - protein, 312 aa, Canis familiaris
MGGANHSVVSEFVFLGLTNSWEIQLLLFVFSSMFYVASMMGNSLIMLTVTFDPHLHSPMYFLLANLSFIDLGVSSVISPKMIYDLFRKRKVISFGGCITQIFFLHVIGGVEMMLLIAMAFDRHVAICKPLHYLTIINRKMCILLLVAAWVVGLAHSMIQLVFVIKLPFCGPNVLDSFYCDFPRFIKLACTDTFSLEFMVTANSGFISLGSFFILIVSYSFILITVRKHSSRGSSKALSTLSAHIMVVILFFGPCIFVYIWPHPTSCLDKFLAVFDAVLTPFFNSVIYTLRNKEMKVAMSKICSQFIIYRRIS

SEQ ID NO: 1699 - DNA, 936 bp, Canis familiaris
atggatggagggaatcactcggctgtgtctgagtttgtgttcctgggactcactcactcatgggagatccagcttctccttctggtgttctcctctgtgctctacgtggcaagcatgactggaaacatcctcattgtgttttctgtgaccattgatcctcacttacactcccccatgtactttctcctggccagtctctctttcactgacttgggagcctgctctgctacctcacccaagatgatttatgaccttttcagaaagcacaaagtcatcccctttggcggctgcatcgcccagatcttcttcatccatgtcattggtggcgtggaaatggtgctgctcattgccatggcctttgacagatatgtggccacatgcaagcccctccactatctgaccatcatgagcccacagaggtgcatcttatttctggctgctgcttgggcccttggtgtcagtcactcactgttccaactggcatttgttgttaatctacccttctgtggtcctaatgtgctggacagcttttactgtgaccttcctcgtctcctcagactggcctgtacagacacctacaggttgcagttcatggtcactgtcaacagtgggtttatctgtgttggttccttcttcatactcctcatctcctacgtcttcatcctgtttactgtttggaaacattcctcaggtggctcatccaaggccctctccactttgtcagctcacatcactgtggtaatttttttctttggtccaaccatgtttgtctatacatggctacaccccaattcccagatggacagatttcttgctctctctgatgcagttctcactccttttttaaatcctgttatctacacattcaggaataaagtgatgaaggcagcaatgaaaagagctttcagaccattaatgatttttagaaagatttca

SEQ ID NO: 1700 - protein, 312 aa, Canis familiaris
MDGGNHSAVSEFVFLGLTHSWEIQLLLLVFSSVLYVASMTGNILIVFSVTIDPHLHSPMYFLLASLSFTDLGACSATSPKMIYDLFRKHKVIPFGGCIAQIFFIHVIGGVEMVLLIAMAFDRYVATCKPLHYLTIMSPQRCILFLAAAWALGVSHSLFQLAFVVNLPFCGPNVLDSFYCDLPRLLRLACTDTYRLQFMVTVNSGFICVGSFFILLISYVFILFTVWKHSSGGSSKALSTLSAHITVVIFFFGPTMFVYTWLHPNSQMDRFLALSDAVLTPFLNPVIYTFRNKVMKAAMKRAFRPLMIFRKIS

SEQ ID NO: 1701 - DNA, 939 bp, Canis familiaris
atggatggagggaatcactcggctgtatctgagtttgtgttcctgggactcactcactcatgggagatccagcttctccttctggtgttctcctctgtgctctacgtggcaagcatgactggaaacatcctcattgtgttttctgtgaccattgatcctcacttacactcccccatgtactttctcctggccagtctctctttcattgacttgggagcctgctctgctacctcacccaagatgatttatgaccttttcagaaagcacaaagtcatctcctttggcggctgcatcgcccagatcttcttcatccatgtcattggtggcgtggagatggtgctgctcattgccatggcctttgacagatatgtggccatatgcaagcccctccattatctgaccatcatgagcccacggaggtgcatcttatttctggctgctgcttgggcccttggtgtcagtcactcactgttccaactggcatttgttgttaatctacccttctgtggtcctaatgtgctggacagcttttactgtgaccttcctcgtctcctcagactggcctgtacagacacctacaggttgcagttcatggtcactgtcaacagtgggtttatctgtgttggttccttcttcatactcctcatctcctacgtcttcatcctgtttactgtttggaaacattcctcaggtggctcatccaaggccctctccactttgtcagctcacatcatggtggtccttttgttctttggtccaaccatgtttgtctatacatggccacaccccaaatcccagatggacaaatttcttgctatttttgatgcagttctcactccttttttaaatcctgttatctacacattcaggaataaagacatgaagtcagcaatgaaaagagtatgcagacagctagtgatttacaggaagatctcatag

SEQ ID NO: 1702 - protein, 312 aa, Canis familiaris
MDGGNHSAVSEFVFLGLTHSWEIQLLLLVFSSVLYVASMTGNILIVFSVTIDPHLHSPMYFLLASLSFIDLGACSATSPKMIYDLFRKHKVISFGGCIAQIFFIHVIGGVEMVLLIAMAFDRYVAICKPLHYLTIMSPRRCILFLAAAWALGVSHSLFQLAFVVNLPFCGPNVLDSFYCDLPRLLRLACTDTYRLQFMVTVNSGFICVGSFFILLISYVFILFTVWKHSSGGSSKALSTLSAHIMVVLLFFGPTMFVYTWPHPKSQMDKFLAIFDAVLTPFLNPVIYTFRNKDMKSAMKRVCRQLVIYRKIS

SEQ ID NO: 1703 - DNA, 840 bp, Canis familiaris
tttctcatgttgatattctccttaatctctttaagagatcatccaaggaaatctcttcattttctttttggtaattttagacttccgttacattttccaatgtacttcctcctggctaatctgcacctcattgatatggatcttttctttatcacagtgtctaagatgattacagaccttttaaatgaatgcaagataattcctttccaaagctgcatgacacagatatgcttcatccacatcatgggaggagtagagatgatgctgctcataaccatggcatttgacaggtacattgcaatctgtaggcctcttcactacctgaacatcaggaatcctacaatatgtgtttcatttgtaactactagctgggtcattgggctgatctacgtgtgtctcactttgttttcattatgaacttgtacttttgaggtcctaataaagcaaaaagcttctgttataactctcctagaataaaaaaacttgcatgcatgtctggagccaagtttgagtttattattgctgccagcagtaatgtcatgagcatgagcaccttctttctgctaatctttcctataccttcattttagtcactgtctggaaatgttcttcaaaagacttatccaggtacttgtcactgagtcagctcacgtcactgtgatggttctatttttcagtccatatatatttctctatgtctggtcttttcccaaatcatcaagtgataaatgcctgttcactgctgactttgctatcaaccatgtcttgaatcctgccatctatacattatagaacaaagatgtaaaggtagcaacaagaagattgtacaagcagggacat

SEQ ID NO: 1704 - protein, 138 aa, Canis familiaris
FLMLIFSLISLRDHPRKSLHFLFGNFRLPLHFPMYFLLANLHLIDMDLFFITVSKMITDLLNECKIIPFQSCMTQICFIHIMGGVEMMLLITMAFDRYIAICRPLHYLNIRNPTICVSFVTTSWVIGLIYVCLTLFSL

SEQ ID NO: 1705 - DNA, 933 bp, Canis familiaris
atgaattactccatggtgactgagttcatttttctgagactctctaattctcaggaattgcagattttcccttttgtgttctttgttgtattctatgtaggaattgtgtgtggaaaccttcctattgtcataactgtggcctctgactcctaccttcactcccccttgtacttcctgctggctaacctctcactcattgacctatgtctgtcttcagtcacagcccccaagatgattgctgacatttttagtaaacacaaagtcatttctttcaagggctgccttgctcagctatttatcctttacttttttggtgggagcaagctggtgatccttatagccatggcctttgacagatatgtaacaatctgtaaaccacctcgctacactacagttatgctacactacagttatgtgtgtgttggccttgtggctgctgcatggggaactggcttcctccattcagtcagccagctggcctttgcagtgaacttacctttctgtggtcccaatgaggttgacagtttttattgtgacctccctagggttatcaaacttccttgtacagatatctataggttggatatcatggtcattgctaacactggtgtgctcactgtgtgttctttattttcctttattttcctaatcatctcctatgctatcatcctagtgaccatccagcaacacccttcagacaagtcatccaaggcactgtccactttgactgctcacgtcacagtagttcttttgttctttggaccatgtatcttcatttatgcctggccattccccatgaagtcattagatgaattccttcctgtgttttattatgtggtcactcctgtcttgaacccaattatatatacactgaggaacaaggacatgaagactgcactgaaatggctgagaaaatggcatgtaaactctagg

SEQ ID NO: 1706 - protein, 311 aa, Canis familiaris
MNYSMVTEFIFLRLSNSQELQIFPFVFFVVFYVGIVCGNLPIVITVASDSYLHSPLYFLLANLSLIDLCLSSVTAPKMIADIFSKHKVISFKGCLAQLFILYFFGGSKLVILIAMAFDRYVTICKPPRYTTVMLHYSYVCVGLVAAAWGTGFLHSVSQLAFAVNLPFCGPNEVDSFYCDLPRVIKLPCTDIYRLDIMVIANTGVLTVCSLFSFIFLIISYAIILVTIQQHPSDKSSKALSTLTAHVTVVLLFFGPCIFIYAWPFPMKSLDEFLPVFYYVVTPVLNPIIYTLRNKDMKTALKWLRKWHVNSR

SEQ ID NO: 1707 - DNA, 939 bp, Canis familiaris
atggaccaagtaaatggctctttggtaactgaatttgtgttactgggacttgcacaatccttgggaatgcagattttcctttttgtttttttctctttattctatgttggaattatcttaggaaacctcttcattatgttaacagtgatttttgattctcacttacactccccaatgtatatcctgctggccaacctatcactcattgatgtgggcctttcatccaccacagttcctagaatgatctctgatcttttcagtggttgtaaaatcatttccttccacaactgcatgatacaaatgttctttattcatgttatgggaggagttgagatggtgttgctcatagccatggcatttgacaggtacacagcgatctgcaagcctctccactatctcactaccatgaataccaaaacgtgcatgcttttggtagtggctgcttggatcattggggtgattcatgctgtatctcagtttgtttttgtcataaatttacctttttgtggccctaataatgtagggagcttttattgtgattttcctagggttattaaacttgcatgcatggacacatacagactagaatttgtggtcactgccaacagtggcttcatatctatgggcacattctttttcttaattgtatcatacatctttattctggccactgttagacagcattcttcaaaagacttgtccaaagcatttgtcactctgtcagctcacatcactgtgttggttttgtttttcactccatgcatgtttctctatgtgtggcctttccctaccaagtcaatggataaattttttgccattgtggattttgttatcactcctgtattaaatcctgccatctatactctaaggaacagagatatgaaggtggcaatgggaaggctgagtcgacaagttgtaagttctagagacataccataa

SEQ ID NO: 1708 - protein, 312 aa, Canis familiaris
MDQVNGSLVTEFVLLGLAQSLGMQIFLFVFFSLFYVGIILGNLFIMLTVIFDSHLHSPMYILLANLSLIDVGLSSTTVPRMISDLFSGCKIISFHNCMIQMFFIHVMGGVEMVLLIAMAFDRYTAICKPLHYLTTMNTKTCMLLVVAAWIIGVIHAVSQFVFVINLPFCGPNNVGSFYCDFPRVIKLACMDTYRLEFVVTANSGFISMGTFFFLIVSYIFILATVRQHSSKDLSKAFVTLSAHITVLVLFFTPCMFLYVWPFPTKSMDKFFAIVDFVITPVLNPAIYTLRNRDMKVAMGRLSRQVVSSRDIP

SEQ ID NO: 1709 - DNA, 939 bp, Canis familiaris
atggatgcagcaaatgactctgtggtatctgaatttgtattgattggactttcaaattcatgggacatgcacctttttctctttttattcttctctgtgttctatgtgggaattatcttaggaaacctcttcattgtgttcacggtaattattgactgtcatttacacacccccatgtacttcttactggccaatctctccctacttgatctaggtttatcatctactacagtccccaaaatgatctctgatcttttcactgaccacaacatcatttcctttccaaaatgcatgatacagatattttttattcatgtcatgggtggagctgagatggtgctgctcatagccatggcatatgaccggtacactgcaatctgtaagcctctccactacctgaccatcatgagctctaaaatgtgtgtctcctttgtagcggctgcctggatagtggggatagttcatgctgtatctcagtttgtttttgtcataaacttgcccttttgtggccctaatgaagtagatagtttttactgtgattttcctcgggtcatgaaacttgcttgtgtagacacttataagctagagtttgtaatcattgctaacagtgggtttatatccatggctaccttcttctctttaattatatcctatatcttcattttggtcactgtctggaaacgttcttcaggggatttatccaaagcatttgtcacactgtcagctcacatcactgtagtgattttgttttttatgccatgcatgtttctctatgtgtggcctttccctacaacatcactggataagtatttattcattgtggacttcgctatcacacccctcttgaatcctgccatctatacattaagaaacaaagacatgagagtggccatgagaagactggccaaaaggattgtgggtcttcatgggatctcataa

SEQ ID NO: 1710 - protein, 312 aa, Canis familiaris
MDAANDSVVSEFVLIGLSNSWDMHLFLFLFFSVFYVGIILGNLFIVFTVIIDCHLHTPMYFLLANLSLLDLGLSSTTVPKMISDLFTDHNIISFPKCMIQIFFIHVMGGAEMVLLIAMAYDRYTAICKPLHYLTIMSSKMCVSFVAAAWIVGIVHAVSQFVFVINLPFCGPNEVDSFYCDFPRVMKLACVDTYKLEFVIIANSGFISMATFFSLIISYIFILVTVWKRSSGDLSKAFVTLSAHITVVILFFMPCMFLYVWPFPTTSLDKYLFIVDFAITPLLNPAIYTLRNKDMRVAMRRLAKRIVGLHGIS

SEQ ID NO: 1711 - DNA, 936 bp, Canis familiaris
atggctcatacaaatgaatcagtggtgtctgagtttgtgcttctgggactttctaattcttgggaacttcagcttttcttttttgccatcttctctttagtgtatgtgacatcagtgctgggcaacattatgatcattgttataatttcctctgattcccatttgaactctcctatgtattttctgctcggtaacctttctttcattgatatctgccaatctaattttgccacccccaagatgcttatggacttctttgttgaacacaagactatctcttttgagggctgtatggcccagatattccttcttcatagttttgttgggagtgagatgctgctgcttgttggtatggcatatgatagatttatagccatctgtaagcccctacactatagcacaattatgaatcggagcctatgtataatttttgtgtttatttcctgggctgtgggtattcttcattctataagtcacttggcttttacagtggatctgccattctgtggccccaatgaggtaaatagcttcttttgtgaccttcccctggtgatagagctggcttgtatggatacttatgaaatggaaattatgaccctaactaacagtagcctgatatcattgggctgttttctagctttagttatttcctacaccataattttgattactgttcgtcaccggtcctctagtgggtcatccaaggcactttctacattaactgctcacatcacagtagtgattcttttctttgggccctgcatttacttctatatatggccttttagcaggctttctgtggataagttcctttctgtattctacactgtctgtacacccttgttgaatcccatcatctactctctaaggaatgaggatgttaaatcagccatgcgaaggctgagaaaccatcatgtgaactcctggaaaaactag

SEQ ID NO: 1712 - protein, 311 aa, Canis familiaris
MAHTNESVVSEFVLLGLSNSWELQLFFFAIFSLVYVTSVLGNIMIIVIISSDSHLNSPMYFLLGNLSFIDICQSNFATPKMLMDFFVEHKTISFEGCMAQIFLLHSFVGSEMLLLVGMAYDRFIAICKPLHYSTIMNRSLCIIFVFISWAVGILHSISHLAFTVDLPFCGPNEVNSFFCDLPLVIELACMDTYEMEIMTLTNSSLISLGCFLALVISYTIILITVRHRSSSGSSKALSTLTAHITVVILFFGPCIYFYIWPFSRLSVDKFLSVFYTVCTPLLNPIIYSLRNEDVKSAMRRLRNHHVNSWKN

SEQ ID NO: 1713 - DNA, 951 bp, Canis familiaris
atggatgcggccaataagtctgtttctgaatttgttttgctgggactctctaaatcctgggaactacagctgtttttcttcatggtgttttcactgttttatgtggcaacaatcattggtaatagcctcatagtcatcacagttatagccgactctcacctacactctcctatgtatttcctgcttactaacctttctgttcttgatatgtcacttgcttcctttgccacccctaagatggttacagactacctcactggacataaaactatctcctttgatggctgtatcacccagatattttttctacacctttttactggtactgagataattttacttatggccatgtcctttgataggtatattgcaatatgcaaacctctccgctatgcttcagtcataagtccctgggtgtgtgttgccctcgtggtggcttcctggattgtgggagtcatgcattcaatgagccaggtcatatttgctctcacattaccattctgtggtcccaatgaagtagacagctttttctgtgaccttcctgtggtgttccagctggcttgtgtggatacttatgttctgggcctctttatgatctcaactagtggcataattgccttatcctgctttattattttattcaattcatatgttattgtcctggttactatcaaacatcattcttcaaaaggatcatctaaggctcttactacatgcacagctcatttcattgttgtccttatgttttttgggccatgcattcttatctatatgtggccactaaacagttttcttatagataagattctgtctgtgttttataccatcttcactcccattctgaacccagtaatatataccttaaggaatcaagaagtgaagacagctatgaggaaactgaaaaataggcttctaaatcccaacaagacaactcctttgcattatttttag

SEQ ID NO: 1714 - protein, 316 aa, Canis familiaris
MDAANKSVSEFVLLGLSKSWELQLFFFMVFSLFYVATIIGNSLIVITVIADSHLHSPMYFLLTNLSVLDMSLASFATPKMVTDYLTGHKTISFDGCITQIFFLHLFTGTEIILLMAMSFDRYIAICKPLRYASVISPWVCVALVVASWIVGVMHSMSQVIFALTLPFCGPNEVDSFFCDLPVVFQLACVDTYVLGLFMISTSGIIALSCFIILFNSYVIVLVTIKHHSSKGSSKALTTCTAHFIVVLMFFGPCILIYMWPLNSFLIDKILSVFYTIFTPILNPVIYTLRNQEVKTAMRKLKNRLLNPNKTTPLHYF

SEQ ID NO: 1715 - DNA, 936 bp, Canis familiaris
atgggtggattaaatgattctgtggtcacagagattgtgttactggccctttcttgttcttgggagaaaaagctctttctcatcttggtatgttctttgctctatttagcagtcatcttgggaaatctttttattttgtttttggtaatttttgattctcacctacattctcccatgtactttctgctggccaacctgtccctcattgatgtgtgtctttcctctaccacagttcccaaaataatcaaagacctcttaaatgaatacaaagtaatttctttccaaggttgtatggcacagatatgcttcatccacatcataggaggagtggagatggtattactcatagccatggcatttgacagatgtacagcaatatgtaaacctcttcactacttgaaaatcatgaactctaaaatatgtatttcattcgtaatcactggatgggtaacgggagtgattcatgctatgtctcagtttttatttgttataaacttgcctttttgtgggcctaataaagtagacagcttttactgtgactttcctaagatcataaaacttgcatgcacagatgcagtcaagtttgagtttatcgttactgccaacagtggcttcatgagcatgggcaccttcttcctgctaatcctttcctactcattcattttgattacagtctggaaacgttcttcaggagaattatccaaggcatttgttactttgtcagctcacatcactgtggtttttttgtttttcaccccatgcatgtttctgtacgtctggccttctcccccaccttcaattgataaaaatctgttcattgtggattttgctatcatccctgccctgaatcctaccatctatacactaaggaacaaagacacaaaggtagctataaaaagactgagcaaaaagatatcttattccagattttgttga

SEQ ID NO: 1716 - protein, 311 aa, Canis familiaris
MGGLNDSVVTEIVLLALSCSWEKKLFLILVCSLLYLAVILGNLFILFLVIFDSHLHSPMYFLLANLSLIDVCLSSTTVPKIIKDLLNEYKVISFQGCMAQICFIHIIGGVEMVLLIAMAFDRCTAICKPLHYLKIMNSKICISFVITGWVTGVIHAMSQFLFVINLPFCGPNKVDSFYCDFPKIIKLACTDAVKFEFIVTANSGFMSMGTFFLLILSYSFILITVWKRSSGELSKAFVTLSAHITVVFLFFTPCMFLYVWPSPPPSIDKNLFIVDFAIIPALNPTIYTLRNKDTKVAIKRLSKKISYSRFC

SEQ ID NO: 1717 - DNA, 849 bp, Canis familiaris
ttgatattttccttgatctatttagggatcatcctgaaaaatctcttcattttctttttgataatctttgattctcacctacattctcctatgtacttcctacgggccaacctgtccctcattgatgtgggactttcctctacaacagtcccaaagatgattggggaccttttaaatgaatacaagataatttccttccaaggttgcatgacacagatatgcttcatccacatcatgggaggagtggagatggtgctgctcatagccatggaatttgacaggtacacggtgatctgtaagcctcttcactatctgaacatcatgaactctaaaatatgtgtttcatttgtaatcactggctgagtgattggagtgatccatgctatgtctcagtttgatttcattataaacttgcctttttgtggtcctaatgaagtagacagcttttactgtgactttctcaggatcataaagcttgtgtgcacagatggagccaagtttgagtttattattgctgccaacagtggcttcatgactatgggtgccttcttcctgctaatcctttcctatgtcttcattttggtcattgtctggaaatgtgcttcaggagatgtgtccaaagcgtttgtcacactgtcatctcacatctctgtggtggttctatttttcactccatgcatgtttctctatgtctggcctttccccatatcatcaattgacaaatacttgttcattgctgactttgctatcaccccggtcttgaatcctgccatctatacattaaaaaacaaagacataaaggtagccataaaaagactgagcaaatggggacattatctcaaattttgc

SEQ ID NO: 1718 - protein, 155 aa, Canis familiaris
MSQFDFIINLPFCGPNEVDSFYCDFLRIIKLVCTDGAKFEFIIAANSGFMTMGAFFLLILSYVFILVIVWKCASGDVSKAFVTLSSHISVVVLFFTPCMFLYVWPFPISSIDKYLFIADFAITPVLNPAIYTLKNKDIKVAIKRLSKWGHYLKFC

SEQ ID NO: 1719 - DNA, 942 bp, Canis familiaris
atgtcaatggatggactaaataattctgtggtttctgagtttgtgttgctgggactctctacttcttgggaaactaaagtttttctcatgttgacattttccttgatctatttagggataatcctgggaaatctcttcattttctttttggtaatttttgattctcacctacattctcccatgtacttcctcctggccaatctgtccttcattgacatgggggttgcctctacaacagtcccaaagatgattggggaccttttaaatgaatacaagataatttccttccaaggttgcatgacacagatgtgcttcattcacatcatgggaggagtggagatggtgctgctcatagccatggcatttgacaggtacatcgcaatttgtaagcctcttcactatctgaacatcatgaaccctaaaatatgtgtttcgtttgtaatcactggctgggtgattggagtgatccatgctatgtctcagtttgctttcattataaacttgcctttttgtggtcctaatgaggtagacagcttttactgtgactttcccaggatcataaagcttgcgtgcactgatggagttaaatttgagtttattattgctgctaacagtggcttcatgagcatgggcaccttcttcctgctaatcctttcctatgtcttcattttggtcactgtctggaaacgtgcttcaggagatttatccaaagcatttgtcacactgtcatctcacatcactgtggtggttctatttttcactccatgcatgtttctctatgtctggcctttccccacatcatcaattgacaaatacctgttcattgctgactttgctatcacccccattttaaatcccataatatatacattaaggaacaaagacataaaggtatctgtaaagcgactgagcaaatggggacattatggcagacgttgctaa

SEQ ID NO: 1720 - protein, 313 aa, Canis familiaris
MSMDGLNNSVVSEFVLLGLSTSWETKVFLMLTFSLIYLGIILGNLFIFFLVIFDSHLHSPMYFLLANLSFIDMGVASTTVPKMIGDLLNEYKIISFQGCMTQMCFIHIMGGVEMVLLIAMAFDRYIAICKPLHYLNIMNPKICVSFVITGWVIGVIHAMSQFAFIINLPFCGPNEVDSFYCDFPRIIKLACTDGVKFEFIIAANSGFMSMGTFFLLILSYVFILVTVWKRASGDLSKAFVTLSSHITVVVLFFTPCMFLYVWPFPTSSIDKYLFIADFAITPILNPIIYTLRNKDIKVSVKRLSKWGHYGRRC

SEQ ID NO: 1721 - DNA, 918 bp, Canis familiaris
atggatgatgcaaatcagtctgtggtgtccgagttcatttttcatggactttgtgattcaagggagctccagaccttcctcctactgacctcctctatgctctatctgatgactgtggtgggcaacctcatcgtagtgatcttattcatcacggaccctcatctccatttccaaatgtacttcttagccaatctctcatttgtggacttctgccttacctcagtaactacccccaaactgaccacagacttcctaaagcgtcataaaaccatctattttggtagatgcacgagccagatcctctgtgtgcatttatttgcaggaattgagatggtgcttcttgtgacagtggcccatgattgttacatggccatctgcaagccactccgttactccagcatcatggacagacaaaagtacatctggctagttttgatatcatgcatcattggttttgtgcatgtcatgagccgactggctatgattttagatctgcccttctgtggacccagaagagtgggtcacagttttttctgtgacattcctttggtgagcaaactggcctgcacggacacacatactctgaaaatgttgataaattctgacagtggggtcttggcaacaacttgcttccttctcttactggcctcctacatctacatcctagtaacagtctgtcttcactctgaggatggaacatccaagtctacatgcacctcccacattacagtgatgcttctcttctttgtaccctgcatgttcatctatctgtggctacttagcatcacttgggtggacaagttgcttgctgtgttttacacagtaatcacatctctcctgaatccagccacttatactctgagaaataaagagattaggaatgccatcaagagactgataagtaggtttacaaatcca

SEQ ID NO: 1722 - protein, 306 aa, Canis familiaris
MDDANQSVVSEFIFHGLCDSRELQTFLLLTSSMLYLMTVVGNLIVVILFITDPHLHFQMYFLANLSFVDFCLTSVTTPKLTTDFLKRHKTIYFGRCTSQILCVHLFAGIEMVLLVTVAHDCYMAICKPLRYSSIMDRQKYIWLVLISCIIGFVHVMSRLAMILDLPFCGPRRVGHSFFCDIPLVSKLACTDTHTLKMLINSDSGVLATTCFLLLLASYIYILVTVCLHSEDGTSKSTCTSHITVMLLFFVPCMFIYLWLLSITWVDKLLAVFYTVITSLLNPATYTLRNKEIRNAIKRLISRFTNP

SEQ ID NO: 1723 - DNA, 939 bp, Canis familiaris
atgtatgaagcgaattattctgaagtgtctcagtttgtattcttgggactttctacctatagaccagtgcagcattttctccttgccttctctacagtgttttatgtaacaattgttttgggaaatctccttgtagtctttacagtgacctttgatccttacttacattcccctatgtacttccttttagccaatctttcattcgttgacttgtgtctttccaccttaacggttcccaagatgatatctgaccttcaatcagggcacaaaactatatcctttcaaggatgtgtcatccagatatttgcccttcatgtcctgggtggatctgagatggtgctgctcatctccatggccttggatcgatatgtggccatatgtaagcccctccactacctgactatcatgagcccgcagatgtgcattttgcttctgtctggtgcttgggctgttggcctcattcattcagtggtccagttagcttttgttatccatttgcctttttgtggtcctaatgagatagacagcttttactgtgaccttccttggttcatcaaacttgcctgtgcagacacttacagaatggaattcatggtgactgccaacagtgggttcatttccatgggcaccttcttctcgttgcttatctcctatgtcttcattctggtcactgtctggaaacgttcctcagctggtttgtctaaggccttttcaactctgtcagcgcacatcactgtggtggttttgttctttgtaccgtgcatctttgtttacgtgtggccatttccctcagtgccagtggataagtttcttgccgttttgaactttgtgattacacccattctgaatcctattatctacacattgaggaacaaagacatgaagatggcactgaagagactgagtagtcagctcctgagtttgagaatgatctcctaa

SEQ ID NO: 1724 - protein, 312 aa, Canis familiaris
MYEANYSEVSQFVFLGLSTYRPVQHFLLAFSTVFYVTIVLGNLLVVFTVTFDPYLHSPMYFLLANLSFVDLCLSTLTVPKMISDLQSGHKTISFQGCVIQIFALHVLGGSEMVLLISMALDRYVAICKPLHYLTIMSPQMCILLLSGAWAVGLIHSVVQLAFVIHLPFCGPNEIDSFYCDLPWFIKLACADTYRMEFMVTANSGFISMGTFFSLLISYVFILVTVWKRSSAGLSKAFSTLSAHITVVVLFFVPCIFVYVWPFPSVPVDKFLAVLNFVITPILNPIIYTLRNKDMKMALKRLSSQLLSLRMIS

SEQ ID NO: 1725 - DNA, 879 bp, Canis familiaris
ggggacttgagattttctctttttttcatatttttgtagtcctatgcagcgattgtggcaggaaaccttcccatcatggtcactgtgacctctgactcacttctgtactccacaccaatgtacttcctctttggaaacctctcctttctggatatgtctatttccacaatcacaacccctaagatggtcatagatctcctcagggagaacagaacgatttctttgtatggctcagatgttctaactccacctcttagggggcactgaatgactcttctcatagtcatggctgttgatcggtacattgcaatatgcaaacctcttcactacacacccatcataaactgccaggtccttgtgggctctgtgctgctatcctgggctgttggctttgtgcatacgatgagccagatgatttttactgtcaccttgaccttctgtggctccaacatagtggacaatattttttgtatattttttgtccttcctctcattcaaaaacttgcctgcactgagacctatgttctggagttgctagtaattgctgacagtggcctgttgtctttcacctgctttatgctcctgcttatttcctacactgtcattctggtaaccatccgatggcaatcctctagtgccctctcaaaggctctgtccacactgtctcttcacattactgtggtcactctgttctttgggccatgtatcttcatttaagcttggccattcagtggcttttcagtggatagatttctttctgtgttttattcagttatcacacccttagtgaaccccattatttacactctgaggaaccaggagatgaaagcagtcatgaatagactgaggaccaaacacatcagatccagacagaccttc

SEQ ID NO: 1726 - protein, 31 aa, Canis familiaris
EGLSGSDVFGPQSIHDCFHLLVPQSVNNGVH

SEQ ID NO: 1727 - DNA, 927 bp, Canis familiaris
atggagacagagaacagcacagtgttgacagacttcattctcttgggtctgacccagtctcaacatgttcagctcctggtcttcgtgcttgtcttaggtttctatctcatcatcctccctggaaacttccttatcatcctcaccatcagatcagaccctggcctcacagcccccctctacttctttctgggaaacttggctttcctggatgcatcctactctttcattgtggctcccaggatgctggtggacttcctctccaagaagaaaataatctcctacagaggttgcatcactcagctctttttcttgcacttcctgggggcgggggaaatgttccttcttgttgtgatggcctttgaccgctacatcgccatctgtcatcccttgcactattccaccatcatgaaccctagagtctgctacaccttgctgctggccctgtggcttgggggatttgctcattccattgtacaagtagcccttattctccacttgccgttctgtggccccaaccagttggataacttcttctgtgatgtgccgcaagtcatcaagctggcctgcacagacacctttgtggtggagctcctgatggtctccaacagtggcctgctcactctgctgtgcttcctgggacttctggcctcctatgcagtcatcctctgccgtgtgaagggacactcctctgaagggaagaacaaggctctttccacatgtactacacacattatcattgtgtttctcatgtttggacctgccatcttcatctacactcgacccttcagagccttcccagctgacaaagtagtttctctctttcacacagtcatctttcctttgatgaaccctgtgatttatacgcttcgcaaccaagaagtgaaagcttccatgaagaggttattgagtcgtcacatggcttgctga

SEQ ID NO: 1728 - protein, 308 aa, Canis familiaris
METENSTVLTDFILLGLTQSQHVQLLVFVLVLGFYLIILPGNFLIILTIRSDPGLTAPLYFFLGNLAFLDASYSFIVAPRMLVDFLSKKKIISYRGCITQLFFLHFLGAGEMFLLVVMAFDRYIAICHPLHYSTIMNPRVCYTLLLALWLGGFAHSIVQVALILHLPFCGPNQLDNFFCDVPQVIKLACTDTFVVELLMVSNSGLLTLLCFLGLLASYAVILCRVKGHSSEGKNKALSTCTTHIIIVFLMFGPAIFIYTRPFRAFPADKVVSLFHTVIFPLMNPVIYTLRNQEVKASMKRLLSRHMAC

SEQ ID NO: 1729 - DNA, 897 bp, Canis familiaris
atggatcttaaaaatggatctgtagtgactgagtttattttactaggattttctggacgatgggaacttcagattttcctctttgtaacattctcctttatctacagcgctaccgtgtggggaaatattctcattatggtcacagtaacatttgattccacccttcattctcccatgtacttcctccttggaaacctctttttttttggatacgtgtctcttcactgccaccacacctgatcatggacttgctcaatgaacacaagaccatttccatacggggctgcatgactcatgttctttatgcacttgtttgggggtgctgaggcaactcttttgatagccatggccttcgacagatatgtagccatatgtaaccccctgcactataggacaatcatgagccacaggctgatgagtgggtttataatactatcatggacaattggttttgtacacaacatgagccagatggttttaacagtcaacttgcctttctgtggccccaatgtcatagacaatatattctgtgaccttgtgattaggcttgctgcttgcttgatggacacatataccctggaattctttgtcattgctgacagagggctgctctcattcatctgtttcatcttgctgcttgtctcctacactgtcatcctgatcactgtacaacaaagatcatccagggggctcgccaaggctctgccaacactgtctgcacacatcattgtggtcactctgttctttgggccttgtatctttatctatgcctggtcattcaatagttttgcaagcaataaagtccttgctttattttacactgttatcacacccttactgaatcctattatttatacactaagaaatcagaagatgcaaggggccatgagaaaattg

SEQ ID NO: 1730 - protein, 201 aa, Canis familiaris
MFFMHLFGGAEATLLIAMAFDRYVAICNPLHYRTIMSHRLMSGFIILSWTIGFVHNMSQMVLTVNLPFCGPNVIDNIFCDLVIRLAACLMDTYTLEFFVIADRGLLSFICFILLLVSYTVILITVQQRSSRGLAKALPTLSAHIIVVTLFFGPCIFIYAWSFNSFASNKVLALFYTVITPLLNPIIYTLRNQKMQGAMRKL

SEQ ID NO: 1731 - DNA, 942 bp, Canis familiaris
atggatgaaaaccaaacagagatggtgagaaactttgtcctggcaggcttctcacagaccccatctattgaggcagggttatttgtactatttcttttcttctacatgtccacttgggtaggcaatgtgctcatcatggtcacagtggcctctgataactatctgaattcatcacccatgtatttccttcttggcaacctctctttcctggacttatgttattcaacagtaactacccctaagcttctggctgatcttctgaataatgagaagctcattcgctatgaccaatgcatcgtgcagctcttctttctgcattttgtaggggcagctgagatgttcctgctcacagtaatggcctatgatcgttatgttgcaatatgtcgccctctgcattataccactattatgagtcgaggattatgctgtatgttggtagctgcctcctggatgggagggtttgtgcactctactgtccagatgatcctcactatccatttgcctttttgtggaccaaaccatgtggacaacttcttttgtgatgttccccctgtcatcaaacttgcctgcgcagacacatttgttattgaattgctaatggtatctaacagtgggttgatctccaccagttcctttgtggtactgctttcttcctattccactatcctggtcaagattcgctccaaggagggaaggcgaaaggcactcgccacctgtggctcccaccttatggtggtaacactcttctttggaccctgtattttcatctatgctcgtcccttctccacattttctgtggacaaaatggtgtctgtactctacaatgttattacacccatgctgaatcccctcatctacacacttcggaacaaagaggtcaagtcagccatgcggaaactgtgggacaggagtgaacttacttggaaaaagcaggagacataa

SEQ ID NO: 1732 - protein, 313 aa, Canis familiaris
MDENQTEMVRNFVLAGFSQTPSIEAGLFVLFLFFYMSTWVGNVLIMVTVASDNYLNSSPMYFLLGNLSFLDLCYSTVTTPKLLADLLNNEKLIRYDQCIVQLFFLHFVGAAEMFLLTVMAYDRYVAICRPLHYTTIMSRGLCCMLVAASWMGGFVHSTVQMILTIHLPFCGPNHVDNFFCDVPPVIKLACADTFVIELLMVSNSGLISTSSFVVLLSSYSTILVKIRSKEGRRKALATCGSHLMVVTLFFGPCIFIYARPFSTFSVDKMVSVLYNVITPMLNPLIYTLRNKEVKSAMRKLWDRSELTWKKQET

SEQ ID NO: 1733 - DNA, 972 bp, Canis familiaris
atggatggaggaaatcactctgtggtgtctgaatttttgttactgggactcaccagttcttgggagattcagattcttctttttttgttttttactatattttacatagcaagtatgctaggaaaccttctcattgtggtcactatcatctcagaccatcacttacattcacctatgtattttttgctggcaaatctttccatcatcgacacaggtgtttctagcattgcaagcccaaagatgatttatgaccttttcagaaaacataaagtcatctccttgacagggtgcattactcagatgtttttcattcacactgttgggggtacagagatggtgctgctcattgtcatggcctatgaccgatacattgctatctgtaagcccctccactacctgagcattatgagcctaagaatgtgcatttctcttctggctgttgcttggaccattggactcatccattctgtggcccaactggcttttgttgtaaacttgcccttttgtggtcccaacacaatggatagtttttattgtgattttcctcggttcatcaaacttgcatgtacagacacatacagactggagtttctggtcactgccaacagtgggttcatctctatgggtaccttcttcatcttgattgtgtcttatatcttcatcctggtcacagtttgcaaacattcttcaggtggtccatccaaggccctctccactctctctgctcacatcaccgtggtggtctttttctttggtccttgcattattgtctatgtgtggccattccctaccttacccatagataaatttttagccatctttgatgcccttatcactcctttcatgaatcctgttatctatactttcagaaataaggatatgaaagtggcaatgaggagactgtttggtaaggttttaaatttcaggaagagttctttcatgaccagtcaaagacattcagattcatcttga

SEQ ID NO: 1734 - protein, 323 aa, Canis familiaris
MDGGNHSVVSEFLLLGLTSSWEIQILLFLFFTIFYIASMLGNLLIVVTIISDHHLHSPMYFLLANLSIIDTGVSSIASPKMIYDLFRKHKVISLTGCITQMFFIHTVGGTEMVLLIVMAYDRYIAICKPLHYLSIMSLRMCISLLAVAWTIGLIHSVAQLAFVVNLPFCGPNTMDSFYCDFPRFIKLACTDTYRLEFLVTANSGFISMGTFFILIVSYIFILVTVCKHSSGGPSKALSTLSAHITVVVFFFGPCIIVYVWPFPTLPIDKFLAIFDALITPFMNPVIYTFRNKDMKVAMRRLFGKVLNFRKSSFMTSQRHSDSS

SEQ ID NO: 1735 - DNA, 972 bp, Canis familiaris
atggataaggtcaattcttcagtggtgtctgaatttgtattgctgggactctccagttctcaggagctccagcttttcttttttgtttttttctctgtgttatatgtcatcattgtgctgggaaaccttctcataatcatcacagtaacttctgataacagtctgcactcccccatgtacttcctcctaggaaatctctcctttgtggacatctgtcaggcttcttttgctacccctaagatgattgtagatttcctgagtgaacataagaccatttccttcaatggctgcatagctcagatattcttcattcacctttttactggaggagagatggtactacttgtctccatggcctatgatagatatgtagccatatgcaaacctctacactatgtagtcatcatgagtcaaaggacgtgcactgtcctggtaatagtctcctgggctgtgggcttggtgcacacattaagtcagttatcgtttaccgtgaccctacctttttgtggacctaatgtagtagacagctttttttgtgatcttcctcgagtgaccaaacttgcctgcctggactcttacatcattgaaatactcattgtagtcaatagtggtattctctccgtaagcactttctctctcttagttggctctgacatcattattcttgtcactgtctggtttaagtcttccgctgcaatggccaaggcattttctacactggctgcccatatcactgtagtaattttgttctttggaccttgcattttcatctatgtgtggccctttaccacttaccctgtggataaacttcttgccatattttacactgtgttcactcccattctaaaccccattatctatacactaaggaacagggatatgaaggctgccatgaggaatattatgacctattacctgaggcccaagaaaatttctgaaattccactagcagtgaggagttctctttattaa

SEQ ID NO: 1736 - protein, 323 aa, Canis familiaris
MDKVNSSVVSEFVLLGLSSSQELQLFFFVFFSVLYVIIVLGNLLIIITVTSDNSLHSPMYFLLGNLSFVDICQASFATPKMIVDFLSEHKTISFNGCIAQIFFIHLFTGGEMVLLVSMAYDRYVAICKPLHYVVIMSQRTCTVLVIVSWAVGLVHTLSQLSFTVTLPFCGPNVVDSFFCDLPRVTKLACLDSYIIEILIVVNSGILSVSTFSLLVGSDIIILVTVWFKSSAAMAKAFSTLAAHITVVILFFGPCIFIYVWPFTTYPVDKLLAIFYTVFTPILNPIIYTLRNRDMKAAMRNIMTYYLRPKKISEIPLAVRSSLY

SEQ ID NO: 1737 - DNA, 942 bp, Canis familiaris
atggggggaggaaataattcggtagtgtctgagattgtgttggtgggactcaccagttctttggagatgcagcttgtcctatttctagttttctctgtgttctatgtaacaggtattttaggaaacctcctcattgtgctcacagtgatttctgactcacatttacattcccccatgtacctcctgctggccaacctctcctttattgacatatgggtttcctccattgcagctcccaagatgatctctgattttttcaaggagagaaaagtaatctctttccaaggctgcattgctcagatgttcttcattcatgttattggaggaactgagatggttctgctcattttcatggcccttgaccgttatgttgctatatgcaggcctctccactatctagccatcatgaacttcagaacttgcatttcactcctggtggtggcctgggccattgggatcatccactcattgatccaactggtgtttgttgtaaacctgccattttgtggccccaatgaggtggacagcttttactgtgatcttcctcgatttattaggcttgcctgcacagacacctacagattagagctcatggtcactgccaatagtggcttcatctctctgggaactttttccattttggttatttcctatatcttcatcttggtcatcgtttggcaacgttcctcaggtggcttgtccaaggccctctctacactgtcagctcacataacagtggtggtcttattttttggtccatgtatttttgtgtactcatggccatttcccacagtgccagtggataagttccttgccatttttgatgtaattattactccatttctgaaccctgccatctacacttttaggaataaagagatgaaagtggccatgaggagaatattcagtcaggtgttgagcttccagaagctgtttaagtga

SEQ ID NO: 1738 - protein, 313 aa, Canis familiaris
MGGGNNSVVSEIVLVGLTSSLEMQLVLFLVFSVFYVTGILGNLLIVLTVISDSHLHSPMYLLLANLSFIDIWVSSIAAPKMISDFFKERKVISFQGCIAQMFFIHVIGGTEMVLLIFMALDRYVAICRPLHYLAIMNFRTCISLLVVAWAIGIIHSLIQLVFVVNLPFCGPNEVDSFYCDLPRFIRLACTDTYRLELMVTANSGFISLGTFSILVISYIFILVIVWQRSSGGLSKALSTLSAHITVVVLFFGPCIFVYSWPFPTVPVDKFLAIFDVIITPFLNPAIYTFRNKEMKVAMRRIFSQVLSFQKLFK

SEQ ID NO: 1739 - DNA, 936 bp, Canis familiaris
atggctcatacaaatgaatcagtggtgtctgagtttgtgcttctgggactttctaattcttgggaacttcagcttttcttttttgccatcttctctttagtgtatgtgacatcagtgctgggcaacattatgatcattgttataatttcctctgattcccatttgaactctcctatgtattttctgctcggtaacctttctttcattgatatctgccaatctaattttgccacccccaagatgcttatggacttctttgttgaacacaagactatctcttttgagggctgtatggcccagatattccttcttcatagttttgttgggagtgagatgctgctgcttgttgctatggcatatgatagatttatagccatctgtaagcccctacactatagcacaattatgaatcggagcctatgtataatttttgtgtttatttcttgggctgtgggtattcttcattctataagtcacttggcttttacagtggatctgccattctgtggccccaatgaggtaaatagcttcttttgtgaccttcccctggtgatagagctggcttgtatggatacttatgaaatggaaattatgaccctaactaacagtagcctgatatcattgggctgttttctagctttagttatttcctacaccataattttgattactgttcgtcaccggtcctctagtgggtcatccaaggcactttctacattaactgctcacatcacagtagtgattcttttctttgggccctgcatttacttctatatatggccttttagcagactttctgtggataagttcctttctgtattctacactgtctgtacacccttgttgaatcccatcatctactctctaaggaatgaggatgttaaatcagccatgcgaaggctgagaaaccatcatgtgaactcctggaaaaactag

SEQ ID NO: 1740 - protein, 311 aa, Canis familiaris
MAHTNESVVSEFVLLGLSNSWELQLFFFAIFSLVYVTSVLGNIMIIVIISSDSHLNSPMYFLLGNLSFIDICQSNFATPKMLMDFFVEHKTISFEGCMAQIFLLHSFVGSEMLLLVAMAYDRFIAICKPLHYSTIMNRSLCIIFVFISWAVGILHSISHLAFTVDLPFCGPNEVNSFFCDLPLVIELACMDTYEMEIMTLTNSSLISLGCFLALVISYTIILITVRHRSSSGSSKALSTLTAHITVVILFFGPCIYFYIWPFSRLSVDKFLSVFYTVCTPLLNPIIYSLRNEDVKSAMRRLRNHHVNSWKN

SEQ ID NO: 1741 - DNA, 975 bp, Canis familiaris
atgaatgagacaaatcattcccgggtgacggcgtttgtgttgctgggactctctaattcccgggaactccaacctttcttgttcctcctattttcactactttacctagcaatactgctgggaaactttcttatcatccttactgtaacctcagattcccgccttcacacccccatgtactttctgcttgcgaacctctcttttatagatatatgcgttgcctcttttgctactcccaaaatgattgcagactttctggttgagcacaagactatttcttttgatgcctgcctggctcagattttctttgtccatcttttcactggcagtgaaatggtgctccttgtatccatggcttatgaccgttatgtagctatatgcaaacctctccactacatgacaatcatgagccgtcgtgtttgtattattcttgttctcatctcctggtttgtgggtttcatccatactactagtcagttggcatttactgttaacttgcctttttgtggccccaatgaggtagatagttttttctgtgacctccctctagtgaccaagctggcctgcatagacacttatgttgtcagcctacttatagttgcagacagtggctttctttctatgagttcctttctccttttggttgtctcctacactgtgatacttatcacagttaggaaccgctcctctgctagcatggcaaaggcccgctccacattgactgctcacattactgtggtcacactcttctttggaccatgcatcttcatctatgtgtggcccttcagtaattattctgttgacaaagtccttgctgtattttacaccatatttactcctattttaaacccagttatctatactctaaggaacaaagaagtgaagacagctatgaggaaactgaagagtcagtatctgaagcctggccaggtttctacagtcataagaaatgttcttttcctggaaacaaattaa

SEQ ID NO: 1742 - protein, 324 aa, Canis familiaris
MNETNHSRVTAFVLLGLSNSRELQPFLFLLFSLLYLAILLGNFLIILTVTSDSRLHTPMYFLLANLSFIDICVASFATPKMIADFLVEHKTISFDACLAQIFFVHLFTGSEMVLLVSMAYDRYVAICKPLHYMTIMSRRVCIILVLISWFVGFIHTTSQLAFTVNLPFCGPNEVDSFFCDLPLVTKLACIDTYVVSLLIVADSGFLSMSSFLLLVVSYTVILITVRNRSSASMAKARSTLTAHITVVTLFFGPCIFIYVWPFSNYSVDKVLAVFYTIFTPILNPVIYTLRNKEVKTAMRKLKSQYLKPGQVSTVIRNVLFLETN

SEQ ID NO: 1743 - DNA, 942 bp, Canis familiaris
atggatggagccaacgaatctgtggtatctgagtttgtgttcctgggactctccaattcatgggagatccagcttcttcttttcctcattttctctgtgttctacatggcaagcctaatgggaaacctccttatcatgttctctgtgagagttgaccttacattgcactctcctatgtacttccagctggcaaacctctcctttcttgatgtggggatttgctctattgcagcccccaaaatggtttatgaccttttcagaaaacacaaaaccatctcttttggaggttgtataccttctttattcatgctattctttattcatgctattgggggtacagaaaaggtgctgctcattgccatggcctttgacagatatgttgccatatgtaagcctctgcactacctgaccatcatgagcccatgaacgtgcattttgattttggtggcagccttggttctcggcctcattcactccgtggcccaactggcttttgttgtagacttgcccttctgtggtcctaatgtattggacagcttttattgtgaccttcctcaactcattaaacttgcttgcacggagaccaatagattggagttcatggtcacagccaacagtggactcatctctgtgggttccttctttatactgattatttcttacatcatcattctgaccatagtatggaagcactcttcaggtgggttatccaagcccctctccactttgtcagctcatgtcactgtggtggttttattctttgggccattaatcttcttctacacatggccctttctctcatcacacttggacaaatttcttgctatctttgatgcagttctcacctcttttctgaatccggtcatctacacattcaggaacaaagagatgaaggtggcaatgaaaaaactctgtcatcagcttgtgaattacaggaagata

SEQ ID NO: 1744 - protein, 141 aa, Canis familiaris
MDGANESVVSEFVFLGLSNSWEIQLLLFLIFSVFYMASLMGNLLIMFSVRVDLTLHSPMYFQLANLSFLDVGICSIAAPKMVYDLFRKHKTISFGGCIPSLFMLFFIHAIGGTEKVLLIAMAFDRYVAICKPLHYLTIMSP

SEQ ID NO: 1745 - DNA, 357 bp, Canis familiaris
atggatgaaggcaatcactctgtggtgttggagtttgtgttcctgggactctccacctcctgggagatccagctccttctcttcctcttttcctgtgtgtactatatggccagcctgatgggaaacctcctcattgtggctgtgacctctgaccctcgtttacaatcccccatgtacttactactggccaacctttccatcattgacttgatgttttgctcttccacagctctcaagatgatttatgatcttttaagagagtgcaaaaccatctcttttgggagctttgtagctcatatcttctttatccatgcagttaggagccctgagatggtgctgctcatcgccatggccttt

SEQ ID NO: 1746 - protein, 119 aa, Canis familiaris
MDEGNHSVVLEFVFLGLSTSWEIQLLLFLFSCVYYMASLMGNLLIVAVTSDPRLQSPMYLLLANLSIIDLMFCSSTALKMIYDLLRECKTISFGSFVAHIFFIHAVRSPEMVLLIAMAF

SEQ ID NO: 1747 - DNA, 567 bp, Canis familiaris
ctcatcgccatggcctttgacagatatgttgccatatgtaagcctttgcactacctgacgatcatgaccctgaggaagtgcattttatttctagtcgcttcctggattattggccttattcattcagtgactcaactggcttttgttgtggacttgtccttctgtgggcctaatgatttagatagctttttctgtgaccttccttggtttatcaaacttgcttgcacatacacaagcacgttgggattcatggttactggctttatttctgtggcctcctttttcattctaatcatctcttacacctttattttggtgactattcagaaaaagtctttgggaagtaggtccaaggccctctccactttgtcagctcatgtcactgtggttgttttgttctttgggccattaatcttcttctatgtgtggcccttccccacatcacatctggatgaattccttgccgtctttgatgcagttctcactccttttctgagtctggtcatctacgcttttaggaataaggagatgaaggtggcaatgaggagactgtgttctcagttggtg

SEQ ID NO: 1748 - protein, 189 aa, Canis familiaris
LIAMAFDRYVAICKPLHYLTIMTLRKCILFLVASWIIGLIHSVTQLAFVVDLSFCGPNDLDSFFCDLPWFIKLACTYTSTLGFMVTGFISVASFFILIISYTFILVTIQKKSLGSRSKALSTLSAHVTVVVLFFGPLIFFYVWPFPTSHLDEFLAVFDAVLTPFLSLVIYAFRNKEMKVAMRRLCSQLV

SEQ ID NO: 1749 - DNA, 834 bp, Canis familiaris
atggatggaatgaaccagttgatagtatcagagtttgtgttcctgggactcactaattcatgggagatccagcttctcctttttgttttctcctttttgttctacttggcaagcatgatgggaaaccttgtcattgtgctcactgtaaccttggatgctcatctgcattcacctatgtatttcctcctggctaatctctcagtcattgatatattgttttgctcaatcacagcccctaaaatgatctgtgatatttttaaaaaacacaaagccatctctttttgtggatgtattatgcagatcttctttagccatgcttttgcggacactgagatggtgctgctcattgccatggcctttgacagatatgtggccatttgtaagcctctgcactacttgaccatcatgagtccaaagatgtgtctataccttttagttacttcttgggtcattggcctcatccactcattgttattttttttttttttggtccttccactcattggtgtgcctttttgtggccctaatgtattggatagtttttattgtgaccttctctggctcctcagacttgcctgtacagacacccaagaattagagttcatggtcactatcaatattgggctcatttctgtgggctcctttatcctcttggtcatttcatatgtcttaattctgtttactgtttggaaacattcctctggtggctcatctaaggctgtgtccactctgtctactcacatcactgtggtggttttgttctttgggccgctgatgtttttctacacatggccttctcccacatcacacatggataaatatcttgctattttt

SEQ ID NO: 1750 - protein, 278 aa, Canis familiaris
MDGMNQLIVSEFVFLGLTNSWEIQLLLFVFSFLFYLASMMGNLVIVLTVTLDAHLHSPMYFLLANLSVIDILFCSITAPKMICDIFKKHKAISFCGCIMQIFFSHAFADTEMVLLIAMAFDRYVAICKPLHYLTIMSPKMCLYLLVTSWVIGLIHSLLFFFFLVLPLIGVPFCGPNVLDSFYCDLLWLLRLACTDTQELEFMVTINIGLISVGSFILLVISYVLILFTVWKHSSGGSSKAVSTLSTHITVVVLFFGPLMFFYTWPSPTSHMDKYLAIF

SEQ ID NO: 1751 - DNA, 927 bp, Canis familiaris
atgaaaaacaggacgtttactgagtttattctgttgggcttcacaaatcaacctgaggtccaagtcgtgatatgcatctttttgttcctcatctatgtgataagtgtcctgggaaatttgacgattatcattctcactctagtagatcctcacctccagacccccatgtatttcttcctccggaatttctccttcttagaagtttccttcacatccatttttattcccagatttctgaccagtgtgacaacaggaaataaagtcatcagttttgctggatgctttattcaatatttttttgctatatttcttggggcaacagaattttacctcttggcttctatgtcctatgaccgctatgttgccatatgcaaacccttgcattacctgaccattatgagcaatagggtctgcatacaactcgtgttctgctcgtggctgggaggattcctagctatcttacccccaatcatcctgatgagccaggtggatttctgtgcctccaatattctgaatcactatttctgtgactatgggcctctattggagattgcctgctcagacacaagcctcctagaaatgattatcctttttgtggcatctgtgactctagtggttacactgctgctggtgacattttcttatacatacattatcaggaccattttgaggatcccttctgcccagcaaaggaaaaaggctttttccacttgttcctcccacatgattgttgtctccctctcttattgcagctgcatgtttatgtacattaatccctctgcaaaagaagaaggtactttcaacaaaggaatggctgtactcattacctcaattactcccttgttaaaccccttcatttatactctaagaaatcagcaagtgaagcaagcattcaaggacaccatcaaaaagattgtgaagctttaa

SEQ ID NO: 1752 - protein, 308 aa, Canis familiaris
MKNRTFTEFILLGFTNQPEVQVVICIFLFLIYVISVLGNLTIIILTLVDPHLQTPMYFFLRNFSFLEVSFTSIFIPRFLTSVTTGNKVISFAGCFIQYFFAIFLGATEFYLLASMSYDRYVAICKPLHYLTIMSNRVCIQLVFCSWLGGFLAILPPIILMSQVDFCASNILNHYFCDYGPLLEIACSDTSLLEMIILFVASVTLVVTLLLVTFSYTYIIRTILRIPSAQQRKKAFSTCSSHMIVVSLSYCSCMFMYINPSAKEEGTFNKGMAVLITSITPLLNPFIYTLRNQQVKQAFKDTIKKIVKL

SEQ ID NO: 1753 - DNA, 930 bp, Canis familiaris
atggataaggaaaatcaatccttggcaacagagtttatccttataggatttacagatcgtccagtgctgaagagtcttctgttttccgtgttctttgccatctatctggtgaccatggtggggaatctgggcctggtggcattgatccttatggagcgtcgccttcacacacccatgtacatctttctgggcaacctggctctaatggattcctgttgtgcctgtgccattacccccaagatgttagagaatttcttttcgaaggacagaatgatttccctctatgaatgcatggcacagttttattttctctgccttgctgaaactgcagactgctttctcctggcagcaatggcctatgaccgctatgtggccatctgcagcccactgcagtaccacaccctgatgtcgaagaagctctgccttcagatgaccgcaggggcctacatagctagtaacctgcattccatgatccatgtagggcttctattaaggttaactttctgcagatctaatcaaattgaccactttttttgtgacattcttcccctctatagactctcttgtactgacccttctatcaatgaactaatgatctatattttttcaatgccgattcaaatattcaccattgccattgtcttgttctcttatctctgcatccttttcacaattttcaaaatgaagtccaaagaagggagaggtaaagctttttctacctgtgcatcccactttctatctgtttcaatattctacatttgtcttctcatgtatattcgcccatttgaagaaggggataaagatataccagtggcagttttttataccatagtagttcctttattaaatccttttatctatagtctaagaaataaggaggtgataaatgttcttaaaagatgtttaaagaattataatatttttaaataa

SEQ ID NO: 1754 - protein, 309 aa, Canis familiaris
MDKENQSLATEFILIGFTDRPVLKSLLFSVFFAIYLVTMVGNLGLVALILMERRLHTPMYIFLGNLALMDSCCACAITPKMLENFFSKDRMISLYECMAQFYFLCLAETADCFLLAAMAYDRYVAICSPLQYHTLMSKKLCLQMTAGAYIASNLHSMIHVGLLLRLTFCRSNQIDHFFCDILPLYRLSCTDPSINELMIYIFSMPIQIFTIAIVLFSYLCILFTIFKMKSKEGRGKAFSTCASHFLSVSIFYICLLMYIRPFEEGDKDIPVAVFYTIVVPLLNPFIYSLRNKEVINVLKRCLKNYNIFK

SEQ ID NO: 1755 - DNA, 936 bp, Canis familiaris
atggatatgactgaggataattactccttgacaactgaatttattctcataggatttacagatcacccaaagttgaagaccgtcctgtttgtggtgtttctcactatctatctgatcaccatggtggggaatctgggcctggtgccattgatccttatggagcgtcgccttcacacacccatgtacatctttctgggcaacctggctctaatggattcctgttgtgcctgtgccattacccccaagatgttagagaatttcttttcgaaggacagaatgatttccctctatgaatgcatggcacagttttattttttctgccttgctgaaacggcagactgctttctcctggcagcaatggcctatgaccgctatgtggccatctgcagcccactgcagtaccacaccctgatgtcgaagaagctctgccttcagatgaccgcaggggcctacatagcaggaaacctgcattccataattcatatagtgtttctctttcggttaactttctgtaggtctcatcagattaatcactttttttgtgaatttcttccattattcaaactctcctgtgttgacccttatatcaatgaattgttgatgtttatctttccaggttcagttctagtgttctctattatcatagtcataatctcttatctctgcatccttttcatgattttcaaaatgaaatccaaagagggaagaggcagagccttatctacttgtgcatctcactttctctctgtctcaatgttctatggttctcttctctttgtgtacattcgaccaaattcagttaaagaagaggataaagatatatctgttgctattttttatactctagtaatccctttattaaacccttttatttatagtctaagaaataaggaagtgataaatgctatgaaaaaaaacataaagaaaaatttttga

SEQ ID NO: 1756 - protein, 311 aa, Canis familiaris
MDMTEDNYSLTTEFILIGFTDHPKLKTVLFVVFLTIYLITMVGNLGLVPLILMERRLHTPMYIFLGNLALMDSCCACAITPKMLENFFSKDRMISLYECMAQFYFFCLAETADCFLLAAMAYDRYVAICSPLQYHTLMSKKLCLQMTAGAYIAGNLHSIIHIVFLFRLTFCRSHQINHFFCEFLPLFKLSCVDPYINELLMFIFPGSVLVFSIIIVIISYLCILFMIFKMKSKEGRGRALSTCASHFLSVSMFYGSLLFVYIRPNSVKEEDKDISVAIFYTLVIPLLNPFIYSLRNKEVINAMKKNIKKNF

SEQ ID NO: 1757 - DNA, 915 bp, Canis familiaris
atgactgaggataattactccttgacaactgaatttattctcataggatttacagatcacccaaagttgaagaccattctgtttgtggtgtttctcactatctatctggtgaccatggtggggaatctgggcctggtgcctttgattctaatggagcgtcgccttcacacacccatgtacatctttctgggcaacctggctctaatggattcctgttgtgcctgtgccattacccccaagatgttagagaatttcttttcgaaggacagaatgatttccctctatgaatgcatggcacagttttattttctctgccttgctgaaacggcagactgctttctcctggcagcaatggcctatgaccgctatgtggccatctgcagcccactgcagtaccacaccctgatgtcaaagaaactctgccttcagatgaccacaggggcctacatagcaggaaatctccatcccgtaattcatatagtgtttctctttcggttaactttctgtaggtctcatcatattaatcactttttttgtgatgttcttccattattcaaactctcctgtgttgacccttatatcaatgaattgttgatatttatctttccaggctcagttctagtgttctctattatcatagtcataatctcttatctctgcattcttttcatgattttcaaaatgaaatccaaagagggaagaggcaaagccttatctacttgtgcatcccactttctctctgtctcaatgttctatggttctcttctttttgtgtacgttcgaccaaattcagttaaagaggaggataaagatatatctgttgctattttttatactctagtaatccctttattaaacccttttatttatagtctaagaaataaagaagtaataaatgctatgaaaaaaaaataa

SEQ ID NO: 1758 - protein, 304 aa, Canis familiaris
MTEDNYSLTTEFILIGFTDHPKLKTILFVVFLTIYLVTMVGNLGLVPLILMERRLHTPMYIFLGNLALMDSCCACAITPKMLENFFSKDRMISLYECMAQFYFLCLAETADCFLLAAMAYDRYVAICSPLQYHTLMSKKLCLQMTTGAYIAGNLHPVIHIVFLFRLTFCRSHHINHFFCDVLPLFKLSCVDPYINELLIFIFPGSVLVFSIIIVIISYLCILFMIFKMKSKEGRGKALSTCASHFLSVSMFYGSLLFVYVRPNSVKEEDKDISVAIFYTLVIPLLNPFIYSLRNKEVINAMKKK

SEQ ID NO: 1759 - DNA, 930 bp, Canis familiaris
atgactgaggataattactccttgacaactgaatttattctcataggatttacagatcacccaaagttgaagaccgttctgtttgtggtgtttctcactatctatctggtgaccatggtggggaatctgggcctggtggcattgatccttatggagcgtcgccttcacacacccatgtacatctttctgggcaacctggctctaatggattcctgttgtgcctgtgccattacccccaagatgttagagaatttcttttcgaaggacagaatgatttccctctatgaatgcatggcacagttttattttctctgccttgctgaaactgcagactgctttctcctggcagcaatggcctatgaccgctatgtggccatctgcagcccactgcagtaccacaccctgatgtcgaagaagctctgccttcagatgaccgcaggggcctacatagcaggaaacctgcattccatgattcatatagtgtttctctttcgtttaactttctgtaggtctcatcagattaatcactttttttgtgatgttcttccattattcaaactctcctgtgttgacccttatatcaatgaattgttgatatttatcttttctgcttcaattttagtcttctctattatcatagtcataatctcttatctctgcatccttttcatgattttcagaatgaaatccaaagagggaagaggcagagccttatctacctgtgcatctcactttctctctgtctcaatgttctatggttctcttctctttgtgtacattcgaccaaattcagttaaagaagaggataaagataaacctgttgctattttttatactctagtaatccctttattaaatccttttatttatagtctaagaaataaggaagtaataaatgccatgaaaagaaatataaagaaaattttataa

SEQ ID NO: 1760 - protein, 309 aa, Canis familiaris
MTEDNYSLTTEFILIGFTDHPKLKTVLFVVFLTIYLVTMVGNLGLVALILMERRLHTPMYIFLGNLALMDSCCACAITPKMLENFFSKDRMISLYECMAQFYFLCLAETADCFLLAAMAYDRYVAICSPLQYHTLMSKKLCLQMTAGAYIAGNLHSMIHIVFLFRLTFCRSHQINHFFCDVLPLFKLSCVDPYINELLIFIFSASILVFSIIIVIISYLCILFMIFRMKSKEGRGRALSTCASHFLSVSMFYGSLLFVYIRPNSVKEEDKDKPVAIFYTLVIPLLNPFIYSLRNKEVINAMKRNIKKIL

SEQ ID NO: 1761 - DNA, 969 bp, Canis familiaris
atggctgaagaaaatcataccctgaaaagtgagtttatcctcacaggatttacagatcacccagagttgaagacccttctgtttgtggtgttctttgccatctatctcatcaccatggtggggaatctgggcctggtggtactgatatcaaaagagcatcatcttcacatgccaatgtacatctttctgggcaacctggctcttgtggattcttgctgtgcctcggccattactcctaagatgttagagaacttcttttctgagaacaggatgatttccctctatgaatgcatggcacaattttattttctttgccttgctgaaactgcagactgctttctcctggcagcaatggcctatgaccgctatgtggccatctgcagcccactgcagtaccacaccatgatgtcgaagaagctctgccttcagatgaccacaggggcctacatagcaggaaacctgcattccatgattcacgtagggcttctccttaggctaactttctgtgggtctcatcaaattaatcacttttactgtgatattcttcctttatacagactctcctgtattgatccttatgtcaatgaactagtactatttattttttcaggctccatccaagtcttcaccataggcagcgtattaatatcttacttctacattctctttactattttcaaaatgaaatccaaagaaggaagggtcaaagcattttccacctgtgcatctcactttttgtctgtttcattgttctatggatctctttttttcatgtacattagaccaaatttgcttgaacaaggggataaagatatcccagctgctattttgtttacaatagtagttcccttactaaatccttttatttatagcctgagaaataaagaagtaataactgtcctgagaaaaattttgaagaaaaaaaaatctcatgaaagttggaaacaaatgatatcgactgtagcttag

SEQ ID NO: 1762 - protein, 322 aa, Canis familiaris
MAEENHTLKSEFILTGFTDHPELKTLLFVVFFAIYLITMVGNLGLVVLISKEHHLHMPMYIFLGNLALVDSCCASAITPKMLENFFSENRMISLYECMAQFYFLCLAETADCFLLAAMAYDRYVAICSPLQYHTMMSKKLCLQMTTGAYIAGNLHSMIHVGLLLRLTFCGSHQINHFYCDILPLYRLSCIDPYVNELVLFIFSGSIQVFTIGSVLISYFYILFTIFKMKSKEGRVKAFSTCASHFLSVSLFYGSLFFMYIRPNLLEQGDKDIPAAILFTIVVPLLNPFIYSLRNKEVITVLRKILKKKKSHESWKQMISTVA

SEQ ID NO: 1763 - DNA, 915 bp, Canis familiaris
atgaaggcaaacaagacgcaggtgactgagtttgttctcacaggacttacagatcgtccaggactgcaggtccccctgttcctggtgttcttggtcatctacctcaccaccatggtgggcaacctggcactgatttttctcatctggaaggacccccatcttcacacacccatgtacttattccttggcagtttggccctcgcagatgcttcctcatcttctgtgactcccaagatgctaatgaactttttatctaagaatcatatgatatcccactttgagtgcatcacccaattttatatttttgcttccagtgccaccacagagtgtttcctcctggtagtgatggcctacgaccgttacgtagccatatgcaaccctttgcattatccagtggtgatgtccaacaggctctgtgcttggttgataagtttgtcttatgtaattggttttctgcatcccacaattcatgtaggattattatttagattaactttctgcaggtccaatataatacatcacttctactgtgaaatcttgccactatatacaatttcttgcactgacccatctattaatgcattggtgctttttatttttgctgcttttatacaggcttttacttttatgaccatcatagtgtcatatacctgggtcctctttgccatcctgaaaaagaagtctgaaaagggcaggagcaaagccttctccatgtgcagtgcccacctgctctctgtctccttgttctatggcaccctcttcttcatgtatgtgcgtcctgggtctggcccagatcaatatcaggataaaatgtattcactgttctatacgatcatcatccccctgctaaacccctttatttatagcccaagaaacagggaatttttaggtgcactgagaaaaattacaaagaaa

SEQ ID NO: 1764 - protein, 305 aa, Canis familiaris
MKANKTQVTEFVLTGLTDRPGLQVPLFLVFLVIYLTTMVGNLALIFLIWKDPHLHTPMYLFLGSLALADASSSSVTPKMLMNFLSKNHMISHFECITQFYIFASSATTECFLLVVMAYDRYVAICNPLHYPVVMSNRLCAWLISLSYVIGFLHPTIHVGLLFRLTFCRSNIIHHFYCEILPLYTISCTDPSINALVLFIFAAFIQAFTFMTIIVSYTWVLFAILKKKSEKGRSKAFSMCSAHLLSVSLFYGTLFFMYVRPGSGPDQYQDKMYSLFYTIIIPLLNPFIYSPRNREFLGALRKITKK

SEQ ID NO: 1765 - DNA, 921 bp, Canis familiaris
atggaggcaaacaagacgcaggtgactgagtttgttctcataggacttacagatcgtccaggactgcaggtccccctgttcctggtgttcttggtcatctacctcaccaccatggtgggcaacctggcactgatttttctcatctggaaggacccccatcttcacacacccatgtacttattccttggcagtttggccctcgcagatgcttgttcctcatcttctgtgactcccaagatgctaatgaaatttttatctaagaatcatatgatatcccactttgagtgcatcacccaattttatatttttgcttccagtgccaccacagagtgtttcctcctggtagtgatggcctacgaccgttacgtagccatatgcaaccctttgcattatccagtggtgatgtccaacaggctctgtgcttggttgataagtttgtcttatgtaattggttttctgcatcccacaattcatgtaggattattatttagattaactttctgcaggtccaatataatacatcacttctactgtgaaatcttgccactatatacaatttcttgcactgacccatctattaatgcattggtgctttttatttttgctgcttttatacaggcttttacttttatgaccatcatagtgtcatatacccgggtcctctttgccatcctgaaaaagaagtctgaaaagggcaggagcaaagccttctccacgtgcagcgcccacctgctctctgtctccttgttctatggcaccctcttcttcatgtatgtgcgtcctgggtctggcccagatcaatatcaggataaaatgtattcactgttctatatgatcatcatccccctgctaaacccctttatttatagcctaagaaacaaggaagttttaggtgcactgagaaaaattacaaagaaataa

SEQ ID NO: 1766 - protein, 306 aa, Canis familiaris
MEANKTQVTEFVLIGLTDRPGLQVPLFLVFLVIYLTTMVGNLALIFLIWKDPHLHTPMYLFLGSLALADACSSSSVTPKMLMKFLSKNHMISHFECITQFYIFASSATTECFLLVVMAYDRYVAICNPLHYPVVMSNRLCAWLISLSYVIGFLHPTIHVGLLFRLTFCRSNIIHHFYCEILPLYTISCTDPSINALVLFIFAAFIQAFTFMTIIVSYTRVLFAILKKKSEKGRSKAFSTCSAHLLSVSLFYGTLFFMYVRPGSGPDQYQDKMYSLFYMIIIPLLNPFIYSLRNKEVLGALRKITKK

SEQ ID NO: 1767 - DNA, 924 bp, Canis familiaris
atggcagaagaaaacaagacacagatgattgagttcgttctcacaggacttacaggtcatccagggccgcagatccccctcttcctggtgttcttggtcatctacctcatcactatggtgggcaaccttggtctggttgctctcatcaggaaagacccccacctgcacacccccatgtacttattccttggcagtttggcctttgcagatgcttgtacttcatcctctgtgactcccaggatgcttataaattttttatcgaagaatcatgtgatatcactttttgactgtatggctcaattttacatttttggttccagtgccaccacagagtgtttcctcctggtagtgatggcctatgaccgctatgtagccatatgcaaccctttgctttatccagtcatgatgtccaataacctttgtactcagttgatcggagtctcatattttgttggttttctacactcagcaattcacgtgggtttgttatttaggttaactttctgcaggtccaatgaaatacattctttctactgtgaaattttacaactcttcaaaatttcttgtaccgatcctacagttaacacacttctggttttaattttttcggccttcatacaaatctttacgtttatgaccatcatggtttcttatacctgtgtcctctttgccatcctgaaaaagaagtctgaaaagggcaggagtaaagccttctccacgtgcagcgcccacttgctctctgtctccttgttctatggcaccctcttcttcatgtatgtgcgtcctgggtctggccacactgaagatgatgacaaaatgtattctttattttacacaataataattcctctgctaaatccttttatttacagcctgaggaacaaagaggttatagatgctttgagaagaataattaagaaataa

SEQ ID NO: 1768 - protein, 307 aa, Canis familiaris
MAEENKTQMIEFVLTGLTGHPGPQIPLFLVFLVIYLITMVGNLGLVALIRKDPHLHTPMYLFLGSLAFADACTSSSVTPRMLINFLSKNHVISLFDCMAQFYIFGSSATTECFLLVVMAYDRYVAICNPLLYPVMMSNNLCTQLIGVSYFVGFLHSAIHVGLLFRLTFCRSNEIHSFYCEILQLFKISCTDPTVNTLLVLIFSAFIQIFTFMTIMVSYTCVLFAILKKKSEKGRSKAFSTCSAHLLSVSLFYGTLFFMYVRPGSGHTEDDDKMYSLFYTIIIPLLNPFIYSLRNKEVIDALRRIIKK

SEQ ID NO: 1769 - DNA, 981 bp, Canis familiaris
atgactgtgttcttcacttattctttcatttcagtgatcagcttcagtgaatctgatggaaacagaacacaggtgactgagtttgttctcacagggcttacagatcatccaggactgcaggtccccctgttcctggtgttcttgatcatctacctcaccaccatggtgggcaacctggcactgatttttctcatctggaaggacccccatcttcacacccccatgtacttactccttggcagtttggcctttgcagatgcttgttcctcatcttctgtgactcccaggatgctaatggattttttatctaggaatcatatgatatcactggttgagtgcatcacccaattttatatttttgcttccagtgcaaacacagagtgtttcctcctggtagtgatggcctatgaccgctatgtagccatatgcaaccctttgctttatccagtggttatgtccaatatcttctgcattcagttattaagtgtttcatatattattgggtttctgcaccctatgatgcatgtcagtttgttatgtagattaactttctgcaagtctaatgtaatacattatttctactgtgaaattttacaattgtttaagatttcctgtactgaccctagagttaatatgctcctgatttttatattttcagtctttatacagtttttcactttcatgactattatcatctcttattcctatgtcctctttgccatcctgaaaaagaagtctgaaaagggcaggagcaaagccttctccacatgtagcgcccacctgctctctgtctccttgttctatggcaccctattcttcatgtatgtgcgtcctgggtctgggccagctgaaaatcaagataaaatgtattctgtattttacacaataataattcccctactaaatccttttatttacagtctgagaaacaaagaggtgataggtgccttgaggagaataatatacataaatagttcttag

SEQ ID NO: 1770 - protein, 326 aa, Canis familiaris
MTVFFTYSFISVISFSESDGNRTQVTEFVLTGLTDHPGLQVPLFLVFLIIYLTTMVGNLALIFLIWKDPHLHTPMYLLLGSLAFADACSSSSVTPRMLMDFLSRNHMISLVECITQFYIFASSANTECFLLVVMAYDRYVAICNPLLYPVVMSNIFCIQLLSVSYIIGFLHPMMHVSLLCRLTFCKSNVIHYFYCEILQLFKISCTDPRVNMLLIFIFSVFIQFFTFMTIIISYSYVLFAILKKKSEKGRSKAFSTCSAHLLSVSLFYGTLFFMYVRPGSGPAENQDKMYSVFYTIIIPLLNPFIYSLRNKEVIGALRRIIYINSS

SEQ ID NO: 1771 - DNA, 930 bp, Canis familiaris
atggaaattaaaaatgcaacagaactggaagcgtttgttctcacaggactcacatatcaacccaagtggcaaattcctctgttcttggtgttcttggttatctatctcatcaccattgtggggaaccttggtctgattgctctcatctgcaatgaccctcagctttacatccccatgtacttattccttggcagtctggcatttgtggatgcctggatatcatccacagtgacccccaagatgctggtcaacttctttgccaagagctggacgatttctctctctgaatgcatgatacagttttttttctttacaactggtgcaaccacagaatgttttctgctggcaacaatggcatatgatcgctatgtggccatatgcaagcctttactttatccagtgattatgaccaacagactatccatgcagctgttagtttcctcatttgtcggtggctttcttcatgccataattcatgtaggctttttattcagattaaccttctgtaatactaacataatacatcacttttactgtgacatcatgccattatttaaaatttcttgtatggatccttctattaatattctcatagtatatattttttctgggtcaattcagatgctcaccattctgattgttcttatctcttacactttagttctctttataatcttaaaaaagaagtctctacaaggcataaggaaagccttctccacctgtggggcccatctcttatctgtgtctttgtactatggccccctccttttcatgtatgtgcgccctagatctgcacaagcagatgatcaagatatgatggattctctgttttacactgtcataattcctgttttaaatccagttatttacagcctgagaaataagaaagtcatagattcactgagaaaaatattaaagagaaatgcttag

SEQ ID NO: 1772 - protein, 309 aa, Canis familiaris
MEIKNATELEAFVLTGLTYQPKWQIPLFLVFLVIYLITIVGNLGLIALICNDPQLYIPMYLFLGSLAFVDAWISSTVTPKMLVNFFAKSWTISLSECMIQFFFFTTGATTECFLLATMAYDRYVAICKPLLYPVIMTNRLSMQLLVSSFVGGFLHAIIHVGFLFRLTFCNTNIIHHFYCDIMPLFKISCMDPSINILIVYIFSGSIQMLTILIVLISYTLVLFIILKKKSLQGIRKAFSTCGAHLLSVSLYYGPLLFMYVRPRSAQADDQDMMDSLFYTVIIPVLNPVIYSLRNKKVIDSLRKILKRNA

SEQ ID NO: 1773 - DNA, 930 bp, Canis familiaris
atggaaaaggaaaatgcaacattgctgatggagctgattctcacaggactcacacatgaaccacggtggaaaatccctctatttttgatgttcttggttttctatcttctcactattgtggggaaccttggtctgattgctctcatctggaatgatcctcagcttcacatccccatgtacttgttccttggcagtctggcatttgtggatgcttggttatcatccacagtgacccccaagatgctggtcagtttctttgccaaaagcaaaacgatctctctctctgaatgtatgatacagtttttttcctttgcaatcagtgcaacgacagaatgctttttgctggcaacaatggcttatgatcgctatgtggccatatgcaaaccattaacttatccagtgattatgtccaatacactctgcatccggctgatacttttgtcatttttaggaggacttcttcatgccataattcacagttcttttttattcagattaaccttctgcaattctatcatagtacatcatttttactgtgatattataccattgtttaagatctcctgtactgatccttctattaattatctgatggtatttattttctctgggtcaatacaagtcttcaccattttgactgttcttgtctcctacacactagtgctctttacaatattaagaaagaagtcgctacaaggcataaaaaaagccttctccacctgtggggcccatctcttttctgtgtctttatactatggccccctccttttcatgtatgtgcgccctagatctgcacaggcagatgatcaagatatgatggactctctattttacactgtcataattccagtgttaaatccaatgatctatagcctgagaaataagaaagttatagattcaatgagaaaaatgttaaagagacatgcttag

SEQ ID NO: 1774 - protein, 309 aa, Canis familiaris
MEKENATLLMELILTGLTHEPRWKIPLFLMFLVFYLLTIVGNLGLIALIWNDPQLHIPMYLFLGSLAFVDAWLSSTVTPKMLVSFFAKSKTISLSECMIQFFSFAISATTECFLLATMAYDRYVAICKPLTYPVIMSNTLCIRLILLSFLGGLLHAIIHSSFLFRLTFCNSIIVHHFYCDIIPLFKISCTDPSINYLMVFIFSGSIQVFTILTVLVSYTLVLFTILRKKSLQGIKKAFSTCGAHLFSVSLYYGPLLFMYVRPRSAQADDQDMMDSLFYTVIIPVLNPMIYSLRNKKVIDSMRKMLKRHA

SEQ ID NO: 1775 - DNA, 930 bp, Canis familiaris
atggaaaaggaaaatgcaaccttgttgacagagctgattctcacaggactcacatatgaaccacaatggcacattcccctgttcctggtgttcttggttatctatcttctcaccattgtcgggaaccttggtctgattgctctcatctggaatgaccctcagcttcacatccccatgtacttgtttcttggcagtctggcacttgtggatgcttggatatcatccacagtgacccccaagatgctggtcaacttctttgccaagagaaaagtgatctctctctctgaatgtatgatacagtttttttcctttgcaatcagtataacgacggaatgctttttgctggcaacaatggcttatgatcgatatgtggccatatgcaaaccattactttatccagtgattatgtctaatacactgtgcatccggctgttagttttgtcacttttaggtggacttctccatgccataattcatagttcttttttattcagattaaccttctgtgattccatcatagtacatcacttttattgtgacattatacccctgcttaagatcacctgtactgacccttctattaattatctgatagtatttatttttgctgggtcaatacagatgttcaccattctgatagttcttgtctcctacacactagtgctcttcacaatattaagaaagaagtctctacaaggcataaagaaagccttctccacctgtggggcccatctcttttctgtctccttgtactatggtgctctggtcttcatgtatgtgcgtcccgtagctgcacagtcagaagatcaagatatgatggactctctcttttacaccatcataattcctttcttaaacccaattatctacagcttgagaaaccagaaagtcatagattcattgagaaaaacattaaagagaaattcttag

SEQ ID NO: 1776 - protein, 309 aa, Canis familiaris
MEKENATLLTELILTGLTYEPQWHIPLFLVFLVIYLLTIVGNLGLIALIWNDPQLHIPMYLFLGSLALVDAWISSTVTPKMLVNFFAKRKVISLSECMIQFFSFAISITTECFLLATMAYDRYVAICKPLLYPVIMSNTLCIRLLVLSLLGGLLHAIIHSSFLFRLTFCDSIIVHHFYCDIIPLLKITCTDPSINYLIVFIFAGSIQMFTILIVLVSYTLVLFTILRKKSLQGIKKAFSTCGAHLFSVSLYYGALVFMYVRPVAAQSEDQDMMDSLFYTIIIPFLNPIIYSLRNQKVIDSLRKTLKRNS

SEQ ID NO: 1777 - DNA, 930 bp, Canis familiaris
atggaaaaggaaaatgcaaccttgttgacagagctgattctcacaggactcacatatgaaccacaatggcacattcccctgttcctggtgttcttggttatctatcttctcaccattgtcgggaaccttggtctgattgctctcatctggaatgaccctcagcttcacatccccatgtacttgttccttggcagtctggcatttgtggatgcctgggtatcatccacagtgacccccaagatgctggtcaacttctttgccaagagcaaaatgatctctctctctgaatgtatgatacagtttttttcctttgcaataagtgcaacgacggaatgctttttgctggcaacaatggcttatgatcgctatgtggccatatgcaaaccattaacttatccagtgattatgtccaatacactctgcatccggctgatacttttgtcatttttaggaggacttcttcatgccataattcacagttcttttttattcagattaaccttctgcgattccatcatagtacatcacttttattgtgacattatacccctgcttaagatcacttgtactgatccttctattaattatctgatagtatttatttttgctgggtcaatacagatgttcaccattctgatagttcttgtctcctacacactagtgctcttcacaatattaagaaagaagtctctacaaggcataaagaaagccttctccacctgtggggcccatctcttatctgtttccttgtactatagtgctctggtcttcatgtatgtgcgtcccgtagctgcacagtcagaagatcaagatatgatagactctctcttttacaccatcataattcctttcttaaacccaattatctacagcttgagaaaccagaaagtcatagattcattgagaaaaacattaaagagaaattcttag

SEQ ID NO: 1778 - protein, 309 aa, Canis familiaris
MEKENATLLTELILTGLTYEPQWHIPLFLVFLVIYLLTIVGNLGLIALIWNDPQLHIPMYLFLGSLAFVDAWVSSTVTPKMLVNFFAKSKMISLSECMIQFFSFAISATTECFLLATMAYDRYVAICKPLTYPVIMSNTLCIRLILLSFLGGLLHAIIHSSFLFRLTFCDSIIVHHFYCDIIPLLKITCTDPSINYLIVFIFAGSIQMFTILIVLVSYTLVLFTILRKKSLQGIKKAFSTCGAHLLSVSLYYSALVFMYVRPVAAQSEDQDMIDSLFYTIIIPFLNPIIYSLRNQKVIDSLRKTLKRNS

SEQ ID NO: 1779 - DNA, 930 bp, Canis familiaris
atggatactaaaaatgcaacactgctgacaaagtttgttctctcaggattcacatatcaaccacagtggcaaatacccctgttcctggtgttcttggtgatatacctcatcaccattgtgggaaaccttggactaactgctctcatctgcaatgatcctcagcttcacatccccatgtacttactccttgggaatttagcctttgtagatgcttggatatcatccacagtgactcccaagatgctggtcaacttcctaggcaagagtaacattatatctctttctgaatgcatgacacaactgttttcctttgtatttagtgcaaccacagaatgttttctcttggcaacaatggcatatgatcgctatgtagccatatgcaaacctttactttatccaatgattatgacctatagactttgcacctggctgttagtctcatcatttgtatgtggctttcttcattctatagttcatataggctttttattcagattaaccttttgtaattctaaaataatacatcacttttactgtgacatcatgccattatttaagatttcctgtactgacacttcaattaatgttctgatagtttttattttctctgggtcaatacaagtatttaccattctgattgttctggtctcttatacacttgttctctttacaatcttaaaaaagaagtctctacaaggcataaagaaagccttttccacctgtggagcccatctcttatctgtctccttatactatggctctcttctcttcatgtatgtgcgccctggatctgcaaaatcggatgatcaagatatgatggactctctattttacactatcataattcctttgttaaatccaattatctacagtttgagaaataagaaagttatagattcattgagaaaaatgttaaagagaaatgtttag

SEQ ID NO: 1780 - protein, 309 aa, Canis familiaris
MDTKNATLLTKFVLSGFTYQPQWQIPLFLVFLVIYLITIVGNLGLTALICNDPQLHIPMYLLLGNLAFVDAWISSTVTPKMLVNFLGKSNIISLSECMTQLFSFVFSATTECFLLATMAYDRYVAICKPLLYPMIMTYRLCTWLLVSSFVCGFLHSIVHIGFLFRLTFCNSKIIHHFYCDIMPLFKISCTDTSINVLIVFIFSGSIQVFTILIVLVSYTLVLFTILKKKSLQGIKKAFSTCGAHLLSVSLYYGSLLFMYVRPGSAKSDDQDMMDSLFYTIIIPLLNPIIYSLRNKKVIDSLRKMLKRNV

SEQ ID NO: 1781 - DNA, 942 bp, Canis familiaris
atgaaccaggtaaatgaaagcatcccacaggagttcatcctcttaggtttctcagatcgaccatggctagagctcccactctttgtggtcttcctggtttcctatatcttgactatctttggcaatctgacaataattcttgtgtcttatctggaccccaaactccatacccctatgtacttttttcttaccaatctgtcgctcctggacctttgctataccacaagtacagttccacagatgctggtaaacatatgcagcaccaggaaggtgattagttatggtggctgtgtggcccagctcttcattttcctggccttgggttccactgaatgtcttctcttggctgtcatgtcttttgataggtttgtagctatttgtcggcctctctattactcagttatcatgcaccaaaggctgtgcctccagctggcggctgcatcctggctcagtggctttggcaactcagtgttgcaatccacctggacccttcagatgcctctctgtggccatagagaagtagatcacttcttttgtgaagtccctgctctgctcaagttgtcctgtgtagacacaacagcaaacgaggctgaactattctttatcagtgtgctgttccttctaatacctgtaacgttcatccttatatcttatggttttattgtccaagcagtgttgaggattcagtcagccaaaggccggcgaaaagcgtttggcacctgtggctcccatctaattgtggtgtcactgttttatggcactgctatctacatgtatctgcaaccaccatcacccaactcaaaggaccgggggaagatggtgtccctcttctatggaatcatcacacccatgttgaacccccttatatacacactaagaaacaaagatgtaaagggagcatttaggaggttgattctgaagatcttcttaatcaagaaatag

SEQ ID NO: 1782 - protein, 313 aa, Canis familiaris
MNQVNESIPQEFILLGFSDRPWLELPLFVVFLVSYILTIFGNLTIILVSYLDPKLHTPMYFFLTNLSLLDLCYTTSTVPQMLVNICSTRKVISYGGCVAQLFIFLALGSTECLLLAVMSFDRFVAICRPLYYSVIMHQRLCLQLAAASWLSGFGNSVLQSTWTLQMPLCGHREVDHFFCEVPALLKLSCVDTTANEAELFFISVLFLLIPVTFILISYGFIVQAVLRIQSAKGRRKAFGTCGSHLIVVSLFYGTAIYMYLQPPSPNSKDRGKMVSLFYGIITPMLNPLIYTLRNKDVKGAFRRLILKIFLIKK

SEQ ID NO: 1783 - DNA, 945 bp, Canis familiaris
atggacacaaacaatggaagttccacaacagatttcatcctcctggggttttctgattggccccaattagaacccatcatttctggggttgtcttcatcttctacattgtgactctggtaggaaacacaaccatcattcttgtgtcttacctagacacccagctccatactcccatgtatttcttcttatctaatttgtcttttctggacctctgttatacaacaagcattgccccccagatgctggtaaatctatggggtccaacaaagtctattacctatgaagggtgtgtgcttcaatcctttgttgcccttgacctgggatccacagaatgtcttctcttggctgtgatggcctatgaccgctatgctgctgtctgtcaacctcttcactacacagtaataatgcaccctcagctttgccagaagatggtgctcactgcctggttaggtggtcttggcagtgccttaattctctgctccttgactctgaagttgccaagatgtggacaccgagaggtggatcattttttctgtgagacgccagcattgatcaagatggcttgtgtctattcaaaagtaatggagatcactgtctatgctcttggagtgatattacttctaatacctctgtcactaattctcatctcatatgcagttatcactcaagctgtcatgaggatcaagtcagcaacaaggtggcataaggtcctcaatacatgtggttcccacctcacagtagtaactctgttttatggaacaatcatttacatgtacatgaaaccacatagtagcacatcccaagataaggggaagttctttactttcttttacactatcatcacacccacccttaaccctctaatctacactttaagaaacaaagatgtaaagagtgcagtaaagagaatactacatatagaagaatggtcagcaaagtcatga

SEQ ID NO: 1784 - protein, 314 aa, Canis familiaris
MDTNNGSSTTDFILLGFSDWPQLEPIISGVVFIFYIVTLVGNTTIILVSYLDTQLHTPMYFFLSNLSFLDLCYTTSIAPQMLVNLWGPTKSITYEGCVLQSFVALDLGSTECLLLAVMAYDRYAAVCQPLHYTVIMHPQLCQKMVLTAWLGGLGSALILCSLTLKLPRCGHREVDHFFCETPALIKMACVYSKVMEITVYALGVILLLIPLSLILISYAVITQAVMRIKSATRWHKVLNTCGSHLTVVTLFYGTIIYMYMKPHSSTSQDKGKFFTFFYTIITPTLNPLIYTLRNKDVKSAVKRILHIEEWSAKS

SEQ ID NO: 1785 - DNA, 942 bp, Canis familiaris
atggaccaaaacaattatacttctctacacggttttgttttacttggtttctctgactatcccaaactggagatggtgctatcaggagttgtcactgtcttttacttcattacatgggtgggtaacacagccatcatcattgcatctctcctggattcctgtctccatacaccaatgtattttttcctcaggaatttatctttcctggatctatgcttcacaaccagcatcatccctcagatgctggttaacttgtggggacctgacaagaccattagctatataggctgtgtcattcaactctatatttatatgtggttgggttccaccgaatgcctcctcctagctgttatgtcctatgatcgcttcacagctatctgtaagcctttgcattatttgataatcatgaacccacatttctgtctcaagataataatcacagtctggagcattagtttggccaattcggtagcattgtgtacactcaccctgaatttgcctcgatgtggaaacaaccttctggaccatttcctgtgtgagttgccagctatagtcaaaatagcttgtatagacactacaacagttgaaatgtctgtttttgctttaggcattgtctttgtccttacacccctcagccttattcttctatcctatggctacattgccaaagctgtgctgagaataaagtcaaaagcaggccgaaaaaaatcaatgaatacttgtggatctcatctcactgttgtgtccatcttctatggaactataatctacatgtacctacaaccaggtaacagtgcctccttagaccagggcaagttcctcaccctcttttacacgatcatcactccaagtctgaatcctctcatttataccctacggaataaggacatgaagaatgcattgaggaagctggtgagagttgacatgaatctacaaaattga

SEQ ID NO: 1786 - protein, 313 aa, Canis familiaris
MDQNNYTSLHGFVLLGFSDYPKLEMVLSGVVTVFYFITWVGNTAIIIASLLDSCLHTPMYFFLRNLSFLDLCFTTSIIPQMLVNLWGPDKTISYIGCVIQLYIYMWLGSTECLLLAVMSYDRFTAICKPLHYLIIMNPHFCLKIIITVWSISLANSVALCTLTLNLPRCGNNLLDHFLCELPAIVKIACIDTTTVEMSVFALGIVFVLTPLSLILLSYGYIAKAVLRIKSKAGRKKSMNTCGSHLTVVSIFYGTIIYMYLQPGNSASLDQGKFLTLFYTIITPSLNPLIYTLRNKDMKNALRKLVRVDMNLQN

SEQ ID NO: 1787 - DNA, 939 bp, Canis familiaris
atgagcaccaacagctccgtggtgaccgagttcatccttgtgggcttctcccatctggccaacctgcagggctggctcttcacattcttccttgccgtctatctgctcaccgtggcaggcaacctcctcatagtgctgctggtctccacggattctgctctccagtcccccatgtacttcttcctgcgcatgctgtcggccctggagatcagctacacatctgtcaccatgcccctgttgctgcaccacctcctcacaggccagcgccgcatacctcgctcaggctgtgctctccagatgttctttttccttttcttcggtgccacagagtgttgcctcctggctgccatggcctatgaccgctatgcagccatctgcaaaccccttcgctacacacttctgctgagtccccgggtgtgcctgcagctagcagggctggcatgggcctgtggggcaatggtgggcctgggccacacctccttcatcttctccctgcccttctgtggccccaatgccatcccacacttcttttgtgagatccagcccatcctgcagctggtatgtggagacacctcactcaatgagctgcagattatcctagctgctgccctcatcatcctctgtcccttcggcctcatcctgggctcctatgggcatatcctggccacgattttccggatgccgtctgttgctggccgccgcaaggccttctccacctgctcctctcacctgctggtggtctccctcttctatggcacggccatcttcatttacatccgccctaaggccagttataatccagccactgaccctgtgctgtctctcttctatgctgtggtcacccccatccttaatcccatcatctatagcctgcggaatgcggatgtcaaggctgccctgaggcgaacattccagaaaatgaagcctgcggacacttga

SEQ ID NO: 1788 - protein, 312 aa, Canis familiaris
MSTNSSVVTEFILVGFSHLANLQGWLFTFFLAVYLLTVAGNLLIVLLVSTDSALQSPMYFFLRMLSALEISYTSVTMPLLLHHLLTGQRRIPRSGCALQMFFFLFFGATECCLLAAMAYDRYAAICKPLRYTLLLSPRVCLQLAGLAWACGAMVGLGHTSFIFSLPFCGPNAIPHFFCEIQPILQLVCGDTSLNELQIILAAALIILCPFGLILGSYGHILATIFRMPSVAGRRKAFSTCSSHLLVVSLFYGTAIFIYIRPKASYNPATDPVLSLFYAVVTPILNPIIYSLRNADVKAALRRTFQKMKPADT

SEQ ID NO: 1789 - DNA, 819 bp, Canis familiaris
gttgtgttgttcctcactctggtgagcaacaccctcatcatcctgctgtctgtgcgggacccaaggctccactcctcgatgtactttttcctctccaacctgtccttcttggacctgcgcttcaccacaagctccgtcccccagctgctggtcaacctctgcagcccaaagaccaccagcttccttggctgctctgttcagctcttcatctttctgttcctggggaccacagagtgcatccacctgaacatgatggcctttgacctctacatggccatatgccagcctctgcactataccatcatcatgcccccgttgcctgtgccggcagctggcgtccatggcctgggccatcagtctgctggagtcggtggtccagacaccacccactctccacctgcccttgtgtccccaccagcagggggatgagttcgtgtgtgaggtcccagcttaatcagactgtctggtggggacaccacctacaaccagatccagatggctgtcaccagcatcctcatcctgctcatgcccatcggcctcatcctggtctcttactgtgccattgcccaggcagtgctgaggattaactcagccaaccggtggaggaaagcatgtgggacctgcttctcccctctcgtggtggtcaccctcttctacagatcagccatcgctgtctacctccagccccagaatgcctatgcccagaaaggggcatagttcttctgtctgttctgtgccgtgggcactgcagcaatgaaccctcatttacaccctgaaaaccaaggaggtaaagagggctgtcagaaggtcgctggggaa

SEQ ID NO: 1790 - protein, 142 aa, Canis familiaris
VVLFLTLVSNTLIILLSVRDPRLHSSMYFFLSNLSFLDLRFTTSSVPQLLVNLCSPKTTSFLGCSVQLFIFLFLGTTECIHLNMMAFDLYMAICQPLHYTIIMPPLPVPAAGVHGLGHQSAGVGGPDTTHSPPALVSPPAGG

SEQ ID NO: 1791 - DNA, 792 bp, Canis familiaris
cttgtgggtaccaccctcatcatcctgctgtccgtgcgggaccccaggtcccactctctgatgtactttttcctctccaacctgtccttcttggacctctgctttaccacaagctctatcccccagctgctggtcaacctctgcagcccaaagaccaccagcttccttggctgctctgctctgctcttcatctttctgttcctaggaaccacagagtgcatcctcctaactgtgatagcctttgacctccacatggccatctgccagcccctccgctatattaccatcatccacccctgcctgttgtctggcctggggtccatggcctgggccatcggtcttctggagtcagtggtccagttgccacccactctctacctgcccttctgtccacaccggcagggggatgatttcatgtgtgaggtcccagctctaatcagactgtctggtgggcacaccacctacaacgagatccagatggctgtcaccagcatcctcatcctgtttgtgtccgccagcctcatcctggtctcttactgtgccattgcccgggcagtactgaggattaactcaatcagtggagaaaagcatttgggacctgcttctcccctctcgcggtggtcacccttttctacagatcagccgtcgctgtctacctccagccccagaatgcctatgcccagaaaggggcatagttcttctgtctgttctgtgctgtgggcactgcagaactgaaccctcatttacaccctgaaaaccaaggaggtaaagagggctgtcagaaggttgctg

SEQ ID NO: 1792 - protein, 244 aa, Canis familiaris
LVGTTLIILLSVRDPRSHSLMYFFLSNLSFLDLCFTTSSIPQLLVNLCSPKTTSFLGCSALLFIFLFLGTTECILLTVIAFDLHMAICQPLRYITIIHPCLLSGLGSMAWAIGLLESVVQLPPTLYLPFCPHRQGDDFMCEVPALIRLSGGHTTYNEIQMAVTSILILFVSASLILVSYCAIARAVLRINSISGEKHLGPASPLSRWSPFSTDQPSLSTSSPRMPMPRKGHSSSVCSVLWALQN

SEQ ID NO: 1793 - DNA, 774 bp, Canis familiaris
agcacggaggagcgcttcctcctgctggatttctccaactggcccgtgctgcagcccacccttcttcaccctcatcctgctctgctacctcttgacgctggcccgcaacttgagcctcatgctgctggcggcgcactaccgcgcctgcacacacccatgtactacttcctgtgccacctggcacaggtgaacacgggcttcaccacgagcgtggcgcctgcgctgctggctggcctctgtggcctggagctgtgactgctgcgcgccggcctggcccagctgtgggatccactgtgtgcctcctgctggcggcaatggcgctggaccacatggcagccgtggtccactcactgcatcatgcccccgctcgcctcgcctcccctgttgtcacgcgctggacagagcctagtggctgagtagtctggccaactcgggggcgaagaccacactgctggccgcccggcctctgtgagcgccctgctgtccgccatcatcctggcctcctatggccccgtggcccgcgctgtctggggcatcttgttgggggcggctgcaggaaggtaatggacaagtgaggatcccaccgtctgcctcctctatggctcggccatctacacttacctgcagcccacacagcgttatgaccagggccagggcaagctcatttcactcttctacatcgtggtcaccccggcactcaacctgcttatctacaccctcaggaacaaggaagtgaaaaggacagccaggaagctcctggggagtctagggaca

SEQ ID NO: 1794 - protein, 84 aa, Canis familiaris
STEERFLLLDFSNWPVLQPTLLHPHPALLPLDAGPQLEPHAAGGALPRLHTPMYYFLCHLAQVNTGFTTSVAPALLAGLCGLEL

SEQ ID NO: 1795 - DNA, 963 bp, Canis familiaris
atgaatgccagctgttccctgtggcaggacaacagcctgtctgtcaagcacttctcattcgccaagttctctgaggtcactgaacagtgtttccttttattcaccctcatcctactcatgtttttagcatccctgacgggcaacgccctcatagcccttgccatctggaccaacccggtcctctacacgcccatgtacttcttcctggccaacctatctgtcttagagattggctacacttgctcggtcatacccaagatgctgcagagccttgtgagtgaggctcggggcatctccagggagggctgtgctacacagatgtttttcttcacattatttgctatcagcgaatgctgtcttttggcagccatggcttttgaccgctacactgccatatgctccccactccactatgcaactcgaatgagtcgtggtgtgtgttcccagttggctgtggtttcatggggagtgggttgcattgtaggtttgggccagaccaactatattttctccttgaacttctgtggcccctgtgaaatagatcacttcttttgtgacctcccacctatcttggctcttgcctgtggcgatacatcccataatgaagttgcagtctttgtcgtggccattctttgcatttccagcccgtttttactaatcgttgcttcctatggcagaatcctagctgctgttctgatcatgccctcacccgaaggccgccgtaaagctctttccacctgttcttcccacctgcttgtagtgacactcttctatggctctgggtctgtcacctacttgagacccaaggccagccattcaccaggaacagataaactcctagctctgttctacacagtggtgacatccatgctcaatcctatcatctacagtttacggaacaaggaggtcaaggcagctctctggagaaccctgggtagaaaaaatgttttgactcgtgggtag

SEQ ID NO: 1796 - protein, 320 aa, Canis familiaris
MNASCSLWQDNSLSVKHFSFAKFSEVTEQCFLLFTLILLMFLASLTGNALIALAIWTNPVLYTPMYFFLANLSVLEIGYTCSVIPKMLQSLVSEARGISREGCATQMFFFTLFAISECCLLAAMAFDRYTAICSPLHYATRMSRGVCSQLAVVSWGVGCIVGLGQTNYIFSLNFCGPCEIDHFFCDLPPILALACGDTSHNEVAVFVVAILCISSPFLLIVASYGRILAAVLIMPSPEGRRKALSTCSSHLLVVTLFYGSGSVTYLRPKASHSPGTDKLLALFYTVVTSMLNPIIYSLRNKEVKAALWRTLGRKNVLTRG

SEQ ID NO: 1797 - DNA, 939 bp, Canis familiaris
atggagaatcacaacacaagctcttttgaaggcttcatcctggtgggcttctctgaccatccccacctagagctaatcctctttgtggtcatcctcactttttacgggctgactcttcttggcaatatgaccatcatcttactttctgctctggattcccggctgcacacaccgatgtatttctttttggccaacctctcattcctggacctgtgtttcaccatgggcaccatccctcagatgctctacaacctttggggctcagataagactatcagctatctgggttgtgccatccagctctacttcgtcctggctctaggaggggtggagtgtgtcctcctggctgtgatggcgtatgaccgctatgctgcaatctgcagacccctgcactacacagtcatcatgcacccccgactctgtgggcagctggcttcagtggcatggttgagtggctttggcaattctctcataatggcaccccagacattgatgctaccccgctgtgggcacaggcgggtgaaccactttctctgtgagatgccagcactaattggcatggcctgtgtagataccatgagcctcgaggcactggcatttgccttggccatctttatcatcctgacaccactcatcctcatcctcatctcttatgggtatattgcacgagcggtatttaggatcaagtcagctacagggcgaaagaaagcctttaacacgtgcagctcccacctaattgttgtctctctcttctatggcacaatcatatacatgtacctccagccagcaaacacttattcccagcaccagggcaagttcctcactctcttctacacaatcgtcactcccagtgttaaccccctgatctacacactgagaaacaaggatgttaaagaagccatgaagaaggtgctagggaaggggggtacagaagtatag

SEQ ID NO: 1798 - protein, 312 aa, Canis familiaris
MENHNTSSFEGFILVGFSDHPHLELILFVVILTFYGLTLLGNMTIILLSALDSRLHTPMYFFLANLSFLDLCFTMGTIPQMLYNLWGSDKTISYLGCAIQLYFVLALGGVECVLLAVMAYDRYAAICRPLHYTVIMHPRLCGQLASVAWLSGFGNSLIMAPQTLMLPRCGHRRVNHFLCEMPALIGMACVDTMSLEALAFALAIFIILTPLILILISYGYIARAVFRIKSATGRKKAFNTCSSHLIVVSLFYGTIIYMYLQPANTYSQHQGKFLTLFYTIVTPSVNPLIYTLRNKDVKEAMKKVLGKGGTEV

SEQ ID NO: 1799 - DNA, 822 bp, Canis familiaris
ttcatcctcttaagtttctcagatcaaccatggctaaagctcccactctttgtggtcttcttcatttcttacatagtgactatctttgggaatctgaccattattctagtgtcatggctgaaccccaaactccatacccccatgtacttatttcttgccaatctgtcactcctggaccttagctacaccacaagtacagttccatagatgctggtaaatttatacagcactagaaagggaattagttacggtaggtgtggcccaactcttcatgttgtggcccaactcttcatgtttctagctttgggggccactaaatgtgttctggtggctgtcatgtcctttgataggtttgtggctatctgtcagcctctccattattcagttatcatgcaccaaaggctgtgcctccagctggcagaggcagctgatcactttctctgtgaagtccctgctcttctcaagttgtcctgtgtagatacgacagtaaatgagggtgaactattctttgtaagtgtgttattctatctgatacccctgacgctcatcctttatcacatgcttttattgcacaagtagtgttgagaatctagtctgctgaagatagacaaaaagcatttgggacatgtggtccccatctgattgtggtgtcactgttctatggtacagctatctccatgtacctgcaaccaccatcactccaaggaccgggaagagatggtgtcccgcttctaagggatcattgcacccatgctgaatccccttatatacacacttaggaataaagaggtaaaggaggcctttaaaaggttaattgccaga

SEQ ID NO: 1800 - protein, 68 aa, Canis familiaris
FILLSFSDQPWLKLPLFVVFFISYIVTIFGNLTIILVSWLNPKLHTPMYLFLANLSLLDLSYTTSTVP

SEQ ID NO: 1801 - DNA, 930 bp, Canis familiaris
atggaaaaatccaatggcagctcagagtatggttttattttagtgggcttctctgatcgtcccaagctggagctagtgctcttcatagtaaattttattctgtatacagtagctgtgttgggaaattcaaccataatccttgtgtgtatattagactctcgacttcataccccaatgtacttctttctggccaatctttcctttctagatctctgcttcagtactagttgtatcccacagatgctggtgaacctctggggccctgacaagaccatcagctatgctggctgtgtggtccagcttttctccttcctttctgtggggagcattgagtgcatcctcctggctgtgatggcctatgaccgctatgctgcagtctgcaaacccctccactatctggtcattatgcacccccagctgtgtttacgactggtggctgtggcctgggggagcggactggtcaatgccatcgtcatgtccccactcacaatgactcttcccagatgtggccggctccggatcaatcacttcctctgtgaaatgccagcactgattaagatggcttgtgtggacgcccgtgcagtagaaatgctggcctttacctttgccattctcatcgtcctcctgcccctcgttcttattctcctgtcctatggctatatcactgcagcagtgctgaagatcaagtctgctgctggccgctggaaggcattcaatacctgcagctcccacctcaccgtggtctccttattctatgggagcatcatttatatgtacatgcagccaggaaacagctcctctcaggaccaaggcaagtttctcaccctcttctacaacctagtgactcctatgttgaatccactcatatacaccttaaggaataaagaggtaaaaggggcactgaaaaaggttttggggaggcaacaatga

SEQ ID NO: 1802 - protein, 309 aa, Canis familiaris
MEKSNGSSEYGFILVGFSDRPKLELVLFIVNFILYTVAVLGNSTIILVCILDSRLHTPMYFFLANLSFLDLCFSTSCIPQMLVNLWGPDKTISYAGCVVQLFSFLSVGSIECILLAVMAYDRYAAVCKPLHYLVIMHPQLCLRLVAVAWGSGLVNAIVMSPLTMTLPRCGRLRINHFLCEMPALIKMACVDARAVEMLAFTFAILIVLLPLVLILLSYGYITAAVLKIKSAAGRWKAFNTCSSHLTVVSLFYGSIIYMYMQPGNSSSQDQGKFLTLFYNLVTPMLNPLIYTLRNKEVKGALKKVLGRQQ

SEQ ID NO: 1803 - DNA, 321 bp, Canis familiaris
aaagtgggagatagtaaggtgaaacatttcctatgtgaaattgcctgtgtggacaccgtggctgtggaaagcactgttttcttcttatcagtaatgattgtcctgcagcccctggcactcatcctggtctcctatggctacattgtcctggtggtgctgagcatgaagtcagctatgggaagaaggaaaactttcaacacatgtgggtcccacttcactgtgatcttgttttatgggaatattatctataagtatatgcagccagaaaataattcttctcagaaccaaagaaatttctcagaaattccttaccctcttcta

SEQ ID NO: 1804 - protein, 107 aa, Canis familiaris
KVGDSKVKHFLCEIACVDTVAVESTVFFLSVMIVLQPLALILVSYGYIVLVVLSMKSAMGRRKTFNTCGSHFTVILFYGNIIYKYMQPENNSSQNQRNFSEIPYPLL

SEQ ID NO: 1805 - DNA, 978 bp, Canis familiaris
atggagtcctccttcttgcacaggcagagtgcaagagaaagagctaatgacagcaccttctcaggattccttcttctaggattctccaacaggcctcagttggagacgcctctctttgtgctcatcctgatcgtttacttcttgagctttcttggcaatggcaccatcatccttctgtcttggatggaccctcgcctgcacacccccatgtatttcttcctgtccaacctctctttcatggatctttgtttgaccacctgcacggtgcctcagacgctggccaacctccaggggcgggtcaagaccatcacgtatggtggctgtgtgacccagctcttcatcgccctggggcttgggggcgtggagtgtgtgctcctggccgtcatggcctatgaccgctatgccgccgtgtgccgcccactgcactacctggccatcgtgcacccgcagctttgcctgtggctggtgctaactgcttggttcacaggattcggcaactctgtgctacaaacggctctgaccatgattcttcccctgtgtgggagaaaccagctggaccatttcttctgtgaagttccggtgatgctgaagctctcctgtgccgacacctccttcaaccaggctgaactcttcacggtcagcgtcttcttcctcgttgtgcccctgtctctcatcttactgtcctatggccacatcacccgggcagtcctgaagataaagtcagcccaggggaggcagaaggcctttggaacctgtggttcccacctcatggtggtggtcatcttctttggcacactcatctcaatgtacctccagcctccctccagttattcacaggatgtgaacaagagcattgcactcttctacacactggtcactcccctgctgaatcccctcatttatactctgagaaacaaagaggtcaaaggggcactgaggagactgctgagggtgaccatggactccagaaggagctaa

SEQ ID NO: 1806 - protein, 325 aa, Canis familiaris
MESSFLHRQSARERANDSTFSGFLLLGFSNRPQLETPLFVLILIVYFLSFLGNGTIILLSWMDPRLHTPMYFFLSNLSFMDLCLTTCTVPQTLANLQGRVKTITYGGCVTQLFIALGLGGVECVLLAVMAYDRYAAVCRPLHYLAIVHPQLCLWLVLTAWFTGFGNSVLQTALTMILPLCGRNQLDHFFCEVPVMLKLSCADTSFNQAELFTVSVFFLVVPLSLILLSYGHITRAVLKIKSAQGRQKAFGTCGSHLMVVVIFFGTLISMYLQPPSSYSQDVNKSIALFYTLVTPLLNPLIYTLRNKEVKGALRRLLRVTMDSRRS

SEQ ID NO: 1807 - DNA, 975 bp, Canis familiaris
atgtgctaccagaggatggaacagaacaatggtagttctttcactgggtttatcctgctgggtttctctgagcggcctcaactggagctagtcctctttgtggttcttctgatcttctatatgtttactctgctgggaaacacaaccatcattgccttgtcccacctggacccacttcttcagactcccatgtactttttcctctccaacctaagctttctggacttgtgttacacgaccagcactgtccctcagctcctggttcatctcaggagagcagacaagtctatctcctttggtggctgtgtagttcagctcttcatatccctagggttgggatccacagaatgcattctcctaggggtcatggcacttgaccgctttgcagctgtctgcaggcccctgcactacacagtgatcatgcattcccgtctctgtgtcctgatggcttctgcatcatggttcattggttttgccaactcctcattgcagacagtgctcatcttccttgtaccactttgtgggagaaataaaatagatcatttcttttgtgagatccccccactgctcaatcttgcctgcgttgacaccactatatatgagtctgagatcttctttgtcagtgtgatcattctctttatacctgtgacattaatcaccgtctcctatggttggattgtcagggcaatctttagaataaaatcatctgcagggcaaaggaaagcatttgggacatgtgggtcccacctcacagtggtctccctgttctatggtacagccatctacgcttacctccagcccagcaacaactattcccaggatcagggcaagttcatttctctcttctacaccatcatcacccccatggtcaatcctgtcatatatacactgaggaacaaggatgtgactggagcaatgaagaaggtgctttggcgagtcctaactccagatgactgggtgggaaagaccctttga

SEQ ID NO: 1808 - protein, 324 aa, Canis familiaris
MCYQRMEQNNGSSFTGFILLGFSERPQLELVLFVVLLIFYMFTLLGNTTIIALSHLDPLLQTPMYFFLSNLSFLDLCYTTSTVPQLLVHLRRADKSISFGGCVVQLFISLGLGSTECILLGVMALDRFAAVCRPLHYTVIMHSRLCVLMASASWFIGFANSSLQTVLIFLVPLCGRNKIDHFFCEIPPLLNLACVDTTIYESEIFFVSVIILFIPVTLITVSYGWIVRAIFRIKSSAGQRKAFGTCGSHLTVVSLFYGTAIYAYLQPSNNYSQDQGKFISLFYTIITPMVNPVIYTLRNKDVTGAMKKVLWRVLTPDDWVGKTL

SEQ ID NO: 1809 - DNA, 753 bp, Canis familiaris
atagaaaaaggaaatcaaatcagtgtctctgactttcttctcttgggcttctcaagctggccagagtgacaggctctccttttcatacttttcctgtgtctctacttaacagggctgtttggaaacttgttcatcttgctagctatcgtctcagactgccacctccacacacccatgtatttcttccttgccaatctgtctgtggtagacctctgccttccttcatctacagtccccaagatgctgctgaacatccaagcacagactcagaccatctcctatcctggctgcctgggcagacagatgtatttctgtatgatgtttgctaacatggacaaattccttcccacagtgatggcatatgaccgttatgtggccatctgtcaccctttgtgttactccaccattatgactcagcacctttgtgcctctctggtgactgtgcctgggttctttgccactttgtatcccttcttacacacccttatgctcacctgtctgcacttttgctctaacatcacccaccattccttctgtgataacaactctctcctccccctctcctgttctgacaccagtctcaatcagttcatcgttctggctgcagtgggattgatctttgtggtaccttcagggtgtatcctgacatcctatagcttcatcatctcctctgtgatgaaaatcccttctgcccaaggaaaactcagggctttctccacctgtggatctcaccttgccttggtcattcttttt

SEQ ID NO: 1810 - protein, 193 aa, Canis familiaris
MYFFLANLSVVDLCLPSSTVPKMLLNIQAQTQTISYPGCLGRQMYFCMMFANMDKFLPTVMAYDRYVAICHPLCYSTIMTQHLCASLVTVPGFFATLYPFLHTLMLTCLHFCSNITHHSFCDNNSLLPLSCSDTSLNQFIVLAAVGLIFVVPSGCILTSYSFIISSVMKIPSAQGKLRAFSTCGSHLALVILF

SEQ ID NO: 1811 - DNA, 843 bp, Canis familiaris
ctacatgtgcacagttggaaaatattgctattattctggtttctccactagattcccaacttcaaagtcctatgtatttcttcctcatgagcctctcctttttggatctctgtttaccacaactgggataccacaactgtatcccaaatgctattcaacttggtgggccccaacaagaacattatttatataggctgtatggcccaggcctatatattccactggctaggctgtactgaatgtgtcctgcttggaatcatggccttagactatgtggctgtgcttaagcctctgaggtactctgtagtcatggaccacaagcactgctggcagctctccagcactgcctggctcaatggtctggcaaattcactgctgcagtccatactcatggtccagctgcccctgtgtgggaaccaggagctagaccacttcttttgtgagctgcctgtggttattaagatggtttatgtggacaccataatcaacaaggttactttagctgtggtggccacctttctgataatgggtcccctctccatgattcttgtcccttatagttgtattgcccaagccgtatttcgaatcccctctgttgataagagacttaatgccttcgacacttgttcttcacgtttactggtggtatctttattttatggccctggcatctacatctatatgcagcttttgggggatagctttcaagaccttaccaaagttctaatgctgttttactgtgttattactcctatggccaacccattcatctacaccctgaggagcaaggatgttaaagaagctttgaggagacttctcagaagagccttttagtacaaaaga

SEQ ID NO: 1812 - protein, 78 aa, Canis familiaris
TCAQLENIAIILVSPLDSQLQSPMYFFLMSLSFLDLCLPQLGYHNCIPNAIQLGGPQQEHYLYRLYGPGLYIPLARLY

SEQ ID NO: 1813 - DNA, 924 bp, Canis familiaris
atgcagggacacaacctcacagaggtgacccagtttgttttcctgggattctccagatttcgtgaacatcagaccatcctgtttgtggttttcctcatcctgtacaccttcaccctggctggcaatgccatcattgtgaccgtcgtctgcacggaccgccacctgcacacgcccatgtacgtcttcctgagcgtgctggctggttcggagaccgcgtacacactggtcaccattccacggatgctgtctggtctcctagcccagaaccagcccatctcctcggcgggctgtgccacccagatgttcttcatcgccttggccatcaacaactgcttcctgctcacggccatgggctacgaccgctacgtggccatctgcgaccccctgcggtacacggtcgtcatgagcaagagggtgtgtgtccagctgatgtgtggagtctctggcatcggccttgccatggcagttgtccaggtgacctccatatttaccttacccttctgtcacagagtgattggacatttcttctgtgacatcctcccggtcctaaaactctcctgtattgataccaccgtcaatgagatcatcaattttgtcgtcagttcatttgtgatcctggtccccgtggggctggtcttcgtctcctacgtcctcatcatctccaccatcctcaggatccgctctgcccagggccggaagaaggcctttgccacctgcgcctcccacctcaccgtggtcatcgtccactacggctgcgcctccatcgcctacctcaagcccaagtcggagaactccatagaacaagacctcctcctctcggtgacttataccatcatcacgcccctgctcaaccctgttgtctacagcctaaggaacaaggaggtcaaagacgccctccgcagagctgtgggaagaaacatctaa

SEQ ID NO: 1814 - protein, 307 aa, Canis familiaris
MQGHNLTEVTQFVFLGFSRFREHQTILFVVFLILYTFTLAGNAIIVTVVCTDRHLHTPMYVFLSVLAGSETAYTLVTIPRMLSGLLAQNQPISSAGCATQMFFIALAINNCFLLTAMGYDRYVAICDPLRYTVVMSKRVCVQLMCGVSGIGLAMAVVQVTSIFTLPFCHRVIGHFFCDILPVLKLSCIDTTVNEIINFVVSSFVILVPVGLVFVSYVLIISTILRIRSAQGRKKAFATCASHLTVVIVHYGCASIAYLKPKSENSIEQDLLLSVTYTIITPLLNPVVYSLRNKEVKDALRRAVGRNI

SEQ ID NO: 1815 - DNA, 945 bp, Canis familiaris
atggatcggctgaaccgcacgtggccgcagaccttcgttctcacggggttcggggcccccgggcccgtgcggccgctcgccttcctggctaccctgggcgtgtatgtcctcacactggcctcgaactcgttcatcattgtgctggtgcaggcggatgcgggcctgtccacgcccatgtacttcttcctcggcgtgctctccttcctggaggtctggtacgtcagcgccacggtgcccacgctgctgctcacctggctccgcgggcgcccccccatcccggcggccggctgcttcctccagctgtacgccgtgcactccctgggcatgacggagtgctccctgctggccgtcatggctctggaccgccacctggccatctgccgcccgctgcactaccccgcgctcatgagcaggaaggcgcagctggggctggcgggggccgcttgggtggccggcttctcggcggccctggtgccagccggcctcacggccgccctgcccttctgccggaagcaggtggcccactacttttgtgacctggcccccctgatgaggttggcgtgtgtggacacggcctggcacgctcgagtgcacggggcggtgatcggtgtggccacgggctgcaactttgtgctgattttaggactgtacgggggtatcctgagggcggtgctgaagctgccctcggccgccagccgggccaaggccttctccacctgcgcctcgcacgtgaccgtggtggccctgttctttggctctgcctttgttgtctacgtggggctgcccgggagtcaagccgagggcacagataagtgtatcgccttggtgtacacctttctgacccccttcctcaaccccatcatctatacccttcgcaacaaggaggtgagggcggcggtgaagagggtcaccatcagggtcggaactgctctgaatcaacactga

SEQ ID NO: 1816 - protein, 314 aa, Canis familiaris
MDRLNRTWPQTFVLTGFGAPGPVRPLAFLATLGVYVLTLASNSFIIVLVQADAGLSTPMYFFLGVLSFLEVWYVSATVPTLLLTWLRGRPPIPAAGCFLQLYAVHSLGMTECSLLAVMALDRHLAICRPLHYPALMSRKAQLGLAGAAWVAGFSAALVPAGLTAALPFCRKQVAHYFCDLAPLMRLACVDTAWHARVHGAVIGVATGCNFVLILGLYGGILRAVLKLPSAASRAKAFSTCASHVTVVALFFGSAFVVYVGLPGSQAEGTDKCIALVYTFLTPFLNPIIYTLRNKEVRAAVKRVTIRVGTALNQH

SEQ ID NO: 1817 - DNA, 945 bp, Canis familiaris
atggatcggctgaaccgcacgtggccgcagaccttcgttctcacggggttcggggcccccgggcccgtgcggccactcgccttcctggctaccctgggcgtgtatgtcctcacactggcctcgaactcgttcatcattgtgctggtgcaggcggatgcgggcctgtccacgcccatgtacttcttcctcggcgtgctctccttcctggaggtctggtacgtcagcgccacggtgcccacgctgctgctcacctggctccgcgggcgcccccccatcccggtggccggctgcttcctccagctatacgccgtgcactccctgggcatgacggagtgctccctgctggccgtcatggctctggaccgccacctggccatctgccgcccgctgcactaccccgcgctcatgagcaggaaggcgcagctggggctggcgggggccgcttgggtggccggcttctcggcggccctggtgccagccggcctcacggccgccctgcccttctgccggaagcaggtggcccactacttttgtgacctggcccccctgatgaggttggcgtgtgtggacacggcctggcacgctcgagtgcacggggcagtgattggcatgatcaacacatgcaactttgtgctgattttaggactgtacgggggtgtcctgagggcggtgctgaagctgccctcggccgccagccgggccaaggccttctccacctgcacctcgcacgtgaccgtggtggccctgttctttggctctgcctttgttgtctatgtggggctgcccgggagtcaagccgagggcacagataagtgtatcgccttggtgtacacccttctcacccccttcctcaaccccatcatctatacccttcgcaacaaggaggtgaagagggctgtcaggagggtcatccagcagattagggccattttgaaaggaccctga

SEQ ID NO: 1818 - protein, 314 aa, Canis familiaris
MDRLNRTWPQTFVLTGFGAPGPVRPLAFLATLGVYVLTLASNSFIIVLVQADAGLSTPMYFFLGVLSFLEVWYVSATVPTLLLTWLRGRPPIPVAGCFLQLYAVHSLGMTECSLLAVMALDRHLAICRPLHYPALMSRKAQLGLAGAAWVAGFSAALVPAGLTAALPFCRKQVAHYFCDLAPLMRLACVDTAWHARVHGAVIGMINTCNFVLILGLYGGVLRAVLKLPSAASRAKAFSTCTSHVTVVALFFGSAFVVYVGLPGSQAEGTDKCIALVYTLLTPFLNPIIYTLRNKEVKRAVRRVIQQIRAILKGP

SEQ ID NO: 1819 - DNA, 954 bp, Canis familiaris
atggaacggcacaaccgctcaagcctggtcgagttcgtgctccttggtttccccaaagtgggacacgtcagaggctggctttttgtcctgctgctgttggcatacctgttcactatctgcggcaacatgctcatcttcttagtcatacgactggatgcagccctgcacacacccatgtaccactttgtcagtgtactctccgtcttggagctgtggtacacggccactaccatccccaagatgctggccaatcttctcagtgagaagaagaccatttcttttgcaggatgcctccttcagacctacttcttccactccctaggggcctctgaatgctaccttcttacagccatggcctatgaccggtatctggccatctgccggcccctccactaccctgcaattatgacgccaaccctctgtagcaagatggctgctggctgttggacttgtggcttcctgtgtcccatttccgaagtcatcctggtctcccggctccccttctgtggctacaatgaaattcaacacatcttctgtgactttccgcctctgctgagcctggcctgcaaggacacatccactaatgtccttgtggactttgccatcaatgccttcatcatcctaatcacctttctctttattatggtttcttatggaagaatcattggtgctgtactgaagataaaaacagcagcagggagaaggaaggccttctctacatgtgcctcgcatctcactgtggttctcatcttctttgggagcatcatcttcatgtatgtgcgcctaaagaagagctattccctgacccttgaccgaacacttgctgttgtctactctgtactgacgccactggtcaacccaattatctacagccttcgtaacaaggaactcattaaggccatcaagaggaccgtcttccggaaaggggagagagctagtcctactcaccactga

SEQ ID NO: 1820 - protein, 317 aa, Canis familiaris
MERHNRSSLVEFVLLGFPKVGHVRGWLFVLLLLAYLFTICGNMLIFLVIRLDAALHTPMYHFVSVLSVLELWYTATTIPKMLANLLSEKKTISFAGCLLQTYFFHSLGASECYLLTAMAYDRYLAICRPLHYPAIMTPTLCSKMAAGCWTCGFLCPISEVILVSRLPFCGYNEIQHIFCDFPPLLSLACKDTSTNVLVDFAINAFIILITFLFIMVSYGRIIGAVLKIKTAAGRRKAFSTCASHLTVVLIFFGSIIFMYVRLKKSYSLTLDRTLAVVYSVLTPLVNPIIYSLRNKELIKAIKRTVFRKGERASPTHH

SEQ ID NO: 1821 - DNA, 951 bp, Canis familiaris
atgagtggtgagccatggacccccgggaactggagctgggtgacagagttcatcatcttgggctttcctcatgtccagggggtgcaggcttacctcttcgtcttgctacttctcatttacgtcaccaccgtcctgggaaacctgctgatattcctggtggtgcgcctggacccccggctccacactcccatgtaccactttgtcagcgcgctctcgctgctggagctcggctatacagcggccaccatccccaagatgctgtcgaacctgctcagcgaggagaagaccatttccttctccggatgccttctgcaaatctatttctttcactctcttggggctgctgagtgctacctcctcacagccatggcttatgacaggtacttagccatctgccagcctctccactaccccaccctcatgaccccggcgctctgtgcccggattgccgttggctgttggttgggaggcctggctgggccggtggctgaaatttctctggtgtcccgtctccctttctgtggccccaatcacattcagcacatcttttgtgatttccctcctgtgctgagcttggcctgtacagacacatctgtcaatgtcctagtggacttcgttatcaactcctgcaaaatcctggccaccttcctgttgatcctcagctcctatgtccagatcatccgcacggtactcaggattccttcagttgcaggcaagacaaaggccttctccacctgtgcctcccacctgaccgtggttctcatcttctacgggagcatcctcttcatgtatgtgcggctgaagaagagctactcgctggactatgaccgcgcactggctgtgatctactcggtgctcacgccttttctcaaccccttcatctacagcttgcgcaacaaggatattaaggaggctgtgaggaggcagttgaggaggtcagggatactgtga

SEQ ID NO: 1822 - protein, 316 aa, Canis familiaris
MSGEPWTPGNWSWVTEFIILGFPHVQGVQAYLFVLLLLIYVTTVLGNLLIFLVVRLDPRLHTPMYHFVSALSLLELGYTAATIPKMLSNLLSEEKTISFSGCLLQIYFFHSLGAAECYLLTAMAYDRYLAICQPLHYPTLMTPALCARIAVGCWLGGLAGPVAEISLVSRLPFCGPNHIQHIFCDFPPVLSLACTDTSVNVLVDFVINSCKILATFLLILSSYVQIIRTVLRIPSVAGKTKAFSTCASHLTVVLIFYGSILFMYVRLKKSYSLDYDRALAVIYSVLTPFLNPFIYSLRNKDIKEAVRRQLRRSGIL

SEQ ID NO: 1823 - DNA, 960 bp, Canis familiaris
atgacacggctggagaccctggggaatcagactatggtgactgagttcttgttctctgtgttcccacctctgcatcaaggtggcctcctgtttttcatccccctgcttctcgcctatggattcatcatcactgggaacctggtgatagtcattgtggtccagctggacatggccctgcacactcccatgtacttcttcatcagtgtcctctccttcctggaggtcgggtacaccacgaccaccatccccaagatgctctccagcctggtcaatgagcagaagaccatctctctggccggctgcctcctgcagatgtacttcttccactccctgggcatcacggaaggctgtgtgctgacagcaatggccattgacaggtacgtcgccatctgcagtcctctccgttacccgaccatcatgactcccaagctgtgcacccagctaacagctgggtcctgcctctgtggcttcctccttgtgctccctgagatcgcgtggattgccaccttgcctttctgtggccccaaccggatccagcagatcttctgtgacttcacacctgtgttgagcttggcctgcacagacacatcgctggtggtcatcgtggacgctatccacgcagtggagatcgtggcctccttcctggccatcgccctatcctacgtccggatcatcgtggtgattctggggatgccctctgctgagggccgccgcaaggccttctccacctgtgccgctcaccttgctgtgttcctgctcttcttcggcagtgtggctgtcatgtatctgcggttctcagccacctactcagtgttttgggacacagcaattgctgtcagctttgtaatccttgctcccttcctcaaccccattatctacagcctgagaaacaaggacatgaaagatgctattagaaggtttttctgccgtcggaggagggctggtggggtcagggggtag

SEQ ID NO: 1824 - protein, 319 aa, Canis familiaris
MTRLETLGNQTMVTEFLFSVFPPLHQGGLLFFIPLLLAYGFIITGNLVIVIVVQLDMALHTPMYFFISVLSFLEVGYTTTTIPKMLSSLVNEQKTISLAGCLLQMYFFHSLGITEGCVLTAMAIDRYVAICSPLRYPTIMTPKLCTQLTAGSCLCGFLLVLPEIAWIATLPFCGPNRIQQIFCDFTPVLSLACTDTSLVVIVDAIHAVEIVASFLAIALSYVRIIVVILGMPSAEGRRKAFSTCAAHLAVFLLFFGSVAVMYLRFSATYSVFWDTAIAVSFVILAPFLNPIIYSLRNKDMKDAIRRFFCRRRRAGGVRG

SEQ ID NO: 1825 - DNA, 951 bp, Canis familiaris
atggatccggagaatcagacaggggtggccgagttctatttctccgatttccctccatttgggaatggcagcctcttactcttcactcctctgctctttatttatgcgttcattattgtgggaaacttcaccatcttctctgctgtccgtctggacacccgcctccacaaccccatgtacaatctcatcagcgccttctccttcctggaggtctggtacaccacagccaccatccccaagatgctctccaacctggtcagtgagaagaaggccatctctttcactggctgcctcctgcagatgtatttcttccactcgcttggggtcacagaagccctagtcctcacggtgatggccatcgacaggtacattgccatctgcaaccccctccgctatgcaatcattatgacccctcggctatgtgtccagctttccaccgggtcttgcatctttggcttccttatgctgctgccagagattgtgtggatttctactcttcccttctgtggccccaaccaaatccatcaactcttctgtgactttgaacccatgctgcgcttggcctgtacagacacgtccatgattctggttgaagacgtgatccatgctatttccatcctgacttctgtgactgtcatcagcctttcgtatttaagaatcatcacagtgatcctgaggattccctcaggggcgagccgtcagaaggcgttctccacttgtgcggcccacattactattttcttgctgttttttggcagcgtggccctcacgtacctgcgcttctctgtcacgttcccacctctactggacaaggccattgcactgatgtttgctgtccttgccccgcttttcaacccaataatttatagcctgaggaacaaagacatgaaagatgccatcaggaaagttctctgtttccgatcaatgttcaatgtctctggtagccaatga

SEQ ID NO: 1826 - protein, 316 aa, Canis familiaris
MDPENQTGVAEFYFSDFPPFGNGSLLLFTPLLFIYAFIIVGNFTIFSAVRLDTRLHNPMYNLISAFSFLEVWYTTATIPKMLSNLVSEKKAISFTGCLLQMYFFHSLGVTEALVLTVMAIDRYIAICNPLRYAIIMTPRLCVQLSTGSCIFGFLMLLPEIVWISTLPFCGPNQIHQLFCDFEPMLRLACTDTSMILVEDVIHAISILTSVTVISLSYLRIITVILRIPSGASRQKAFSTCAAHITIFLLFFGSVALTYLRFSVTFPPLLDKAIALMFAVLAPLFNPIIYSLRNKDMKDAIRKVLCFRSMFNVSGSQ

SEQ ID NO: 1827 - DNA, 957 bp, Canis familiaris
atggtaggagctaaccaaacttctatggtgacagaatttctcttctctggcttccccaagtttgaagatggtagcctcctcctcttcattcctttgttcatcatctacacatttatcattgttgggaatctcactgtattttttgcggtcaggatggatgcccacctccacaatcctatgtacaatttcataagcaccttctccttcttggaggtctggtacaccacagccaccatccccaagatgctctccaacctcatcagtgagaagaggaccatctccatgactggctgcctcctgcagatgtacttcttccattctcttggaaattcagaggggattttgttaaccaccatggccattgacaggtacgttgctatctgcaaccctctccgctacccaaccattatgaccccccggctgtgtgctcagctctctgcgggctcttgcatctttggctttcttgtgttactcccagagattgcatggatttccacactgcctttctgtgggcccaaccaaatccatcagatattctgtgactttgaacctgtgctacgcttggcctgtacagacacgtccatgattctgattgaggatgtgatccatgctgtggccatcatcatcgctgtactgatcattgctctctcttatatcggaatcatcactgtgatcctgaggatcccttctgttgaaggccgccagaaggccttttctacctgtgcatctcatcttggtgtctttctgatgttctatggcagtgtctccctcatgtacctgcgtttctctgccactttcccaccaactttggacacagtcattgcattgatgtttgccgttcttgctccctttttcaaccctatcatttatagcttgagaaacaaggatatgaagattgctattaagaagcttctcttttctggatcacctgggtggcttagttggttaagtgtctga

SEQ ID NO: 1828 - protein, 318 aa, Canis familiaris
MVGANQTSMVTEFLFSGFPKFEDGSLLLFIPLFIIYTFIIVGNLTVFFAVRMDAHLHNPMYNFISTFSFLEVWYTTATIPKMLSNLISEKRTISMTGCLLQMYFFHSLGNSEGILLTTMAIDRYVAICNPLRYPTIMTPRLCAQLSAGSCIFGFLVLLPEIAWISTLPFCGPNQIHQIFCDFEPVLRLACTDTSMILIEDVIHAVAIIIAVLIIALSYIGIITVILRIPSVEGRQKAFSTCASHLGVFLMFYGSVSLMYLRFSATFPPTLDTVIALMFAVLAPFFNPIIYSLRNKDMKIAIKKLLFSGSPGWLSWLSV

SEQ ID NO: 1829 - DNA, 948 bp, Canis familiaris
atggagggtgcaaatctgtcagcagtgatggaatttgtcttcactggcttcccccagctccaggatggtggcctcctgtacttcttccccttactcttcatctacgcctttgttgtcgttgggaatctattgatcttctttgcggtcaggatggatgcccgcctccacaaccccatgtacaacttcatcagcaccttctccttcctggaggtctggtacaccacagccaccatccccaagatgctctccaacctgatcagtgagaagaagaccatctccatgaccggctgcctcctgcagatgtacttcttccattcccttgggaacactgaaggagccctgctgactgtcatggccattgacaggtacgtggccatctgcaacccactccgctacctgaccatcatgacccctcggctgtgtgctcagctctctgcaggctcttgtatctttggtctcctcatccttctacctgagattgtgtggatttctactctgcccttctgtggccccaaccaaatccatcagatcttctgtgacttcacaccgttattacgtttagcctgtactgatgcctctgtgatcctggtgcaagatgtgattcatgctctggccattctgataacaggtctgatcatttccctttcctacatcagaattgtcaccgtgatcctgggcatcccttctgcagagggccgtaaaaaggccttctccacctgtgccgcccacattgctgtcttcctgctatttttcggcagcgtggccctcatgtatcttagattctctgccacgtatacaccattctgggatgctgccattgctctgaccttctctgtcctctccccctttttcaatcccattatatacagcctgagaaataaggatatgaaagatgctattaagaaactcctttgccctcaaaaggtgtttaatgtacctggtaggtga

SEQ ID NO: 1830 - protein, 315 aa, Canis familiaris
MEGANLSAVMEFVFTGFPQLQDGGLLYFFPLLFIYAFVVVGNLLIFFAVRMDARLHNPMYNFISTFSFLEVWYTTATIPKMLSNLISEKKTISMTGCLLQMYFFHSLGNTEGALLTVMAIDRYVAICNPLRYLTIMTPRLCAQLSAGSCIFGLLILLPEIVWISTLPFCGPNQIHQIFCDFTPLLRLACTDASVILVQDVIHALAILITGLIISLSYIRIVTVILGIPSAEGRKKAFSTCAAHIAVFLLFFGSVALMYLRFSATYTPFWDAAIALTFSVLSPFFNPIIYSLRNKDMKDAIKKLLCPQKVFNVPGR

SEQ ID NO: 1831 - DNA, 966 bp, Canis familiaris
atggagagccccaatcaaagcaccactcaggagttcatcttctccgccttcccttgttcctggggaagctccgtctcctgttttgttcccctgctcttcatttacactttcattgtcttcggcaacctggtcatcatcacagtggtccagctgaacgctcacctccacacgcccatgtacttcttcatcagcgccctttctttcctggaaatctggtacaccacagcgaccatcccaaagatgcttgccagcctgctgagtgagaggaagagcatttccttaaatggttgtctcctgcagatgtacttcttccattccactggcatcagtgaggtttgtctgttgacagcaatggcctttgaccactacctggccatctgcagccctcttcattatcccactaccatgacccccaggctgtgtgcccaactgactttaagttgctgtgtttgtggctttatcacgcctctccctgagattgcctggatctccacactgccattttgtggctctaatcatcttgagcacatcttctgtgacttcctccccatgctacgcttggcctgcacagacacacaagccatcgtcatgattcaggtagtggatattgtccatgcggtggagattattacagctataatgctcattttcatgtcctatgttggtattgtggctgtaattctacatattaggtcagctgaaggccgacgcaaggcgttttccacgtgcgtctcccacctcactgtttttttgcttttttttggcaatgtggccctcatgtacctacgcttctctgccacctactccttattctgggatacagtcattgctctggcctttgcagttttgtctcccttcttcaaccccatcatttatagcctgaggaacaaagagataaaggaagcgataaaaaaacactggggtcaagctaaaatctttttttataagaccaaggacctcaagtaa

SEQ ID NO: 1832 - protein, 321 aa, Canis familiaris
MESPNQSTTQEFIFSAFPCSWGSSVSCFVPLLFIYTFIVFGNLVIITVVQLNAHLHTPMYFFISALSFLEIWYTTATIPKMLASLLSERKSISLNGCLLQMYFFHSTGISEVCLLTAMAFDHYLAICSPLHYPTTMTPRLCAQLTLSCCVCGFITPLPEIAWISTLPFCGSNHLEHIFCDFLPMLRLACTDTQAIVMIQVVDIVHAVEIITAIMLIFMSYVGIVAVILHIRSAEGRRKAFSTCVSHLTVFLLFFGNVALMYLRFSATYSLFWDTVIALAFAVLSPFFNPIIYSLRNKEIKEAIKKHWGQAKIFFYKTKDLK

SEQ ID NO: 1833 - DNA, 942 bp, Canis familiaris
atgggacaggccaatgcaaccatctggaggggattcgtcttcctgggcttctccagctttggggagctgcagctcctgctctttgcactattcctctccctgtatcttgtcaccctgaccagcaatgtcttcattatcgtagtcatccggctggacagccatctgcacagccccatgtacttcttcctttcctttctgtctttctctgagacctgttatacactgggcatcatccctcggatgctctccagcctggtcatggggagccaggccatctcctatgagggctgtgctgcccagatgttcttctccgcttcgtgggcctgtaccaactgcttccttctggctgtcatgggctttgacagatacgtggccatctgtgccccactgcactataccagccacatgaatcctaccttctgtgcccagctggttggcacctccttcttgactggatatctctttgggctgggaatgacactggtcattttccaactcccattctgtggttcccacgagatccagcactttttctgtgacacgcctccagtgctgagcctggcctgcggggacacggggccaagtgagctgggcatcctcatccttagcctgctggtcctcctggtctctttctgctccattaccatctcctatgcctacattctgacagcaatactgcggatcccctctgccaaggggcggaagaaggccttctccacctgcgcctcgcacctcaccgtggtcattgtgcactatggctgtgcctccttcatgtacttgaggcccaaagccagttactctctggagcgagatcagcttattgctgtcacctacaccgtggtgactcccctcctcaaccccattgtttacagtctaaggaatcgggctgtgcagacagccctgagaagtgccttccgaggaaaattgctgggtagaggatga

SEQ ID NO: 1834 - protein, 313 aa, Canis familiaris
MGQANATIWRGFVFLGFSSFGELQLLLFALFLSLYLVTLTSNVFIIVVIRLDSHLHSPMYFFLSFLSFSETCYTLGIIPRMLSSLVMGSQAISYEGCAAQMFFSASWACTNCFLLAVMGFDRYVAICAPLHYTSHMNPTFCAQLVGTSFLTGYLFGLGMTLVIFQLPFCGSHEIQHFFCDTPPVLSLACGDTGPSELGILILSLLVLLVSFCSITISYAYILTAILRIPSAKGRKKAFSTCASHLTVVIVHYGCASFMYLRPKASYSLERDQLIAVTYTVVTPLLNPIVYSLRNRAVQTALRSAFRGKLLGRG

SEQ ID NO: 1835 - DNA, 960 bp, Canis familiaris
atgcagagaaagaacttcacggaagtgacagatctcatcttcctgggattttctatctttggaaagcaccagctaacgctctttgtggttttcctgactgtctacattttaactctaactagtaatgtcatcattgtgaccatcatccgtgttgaccgccacctgcacacgcccatgtacttcctcctgagcatgctggccagttctgagactgtgtacacactggtcattgtcccacgaatgctttccagtctcctttttcataaccagcccatctccttggcaggctgtgcaactcagatgttcttctttgtcaccttggccaccagtaactgcttcttgcttacagcgatgggctatgaccgctacctggcgatctgcagccccctgtggtacacggtcctcatgagcaaaggagtgtgtgccaccttggtatgcgggtccttcggtaccggcctggctatggcagttctccatgtggcagcaatgttcaacttgcccttctgtggcacagtggtggagcacttcttctgtgacatttacccagtcatgaaactttcctgtgttgataccactatcaatgagatgatcaattatgctgtcagttcatttgtgatcctggtccctgtgggcttgatcttcatctcctatgtcttcatcatctctgccattctcaagattgcctccgcagaaggccggaagaaggcctttgccacctgcacctcccacctcaccgtggtcatcgtccactacggctgcgcctccatcgcctacctcaagcccaagtcggagaactccatagaacaagacctccttctctcggtgacttataccatcatcacgcctctgctcaaccctgttgtctacagcctgaggaacaaggaggtcaaagatgccctccgcagagctgtgggcaaaaacatcataacagatcgaatcgctttgtcaggagacgtttag

SEQ ID NO: 1836 - protein, 319 aa, Canis familiaris
MQRKNFTEVTDLIFLGFSIFGKHQLTLFVVFLTVYILTLTSNVIIVTIIRVDRHLHTPMYFLLSMLASSETVYTLVIVPRMLSSLLFHNQPISLAGCATQMFFFVTLATSNCFLLTAMGYDRYLAICSPLWYTVLMSKGVCATLVCGSFGTGLAMAVLHVAAMFNLPFCGTVVEHFFCDIYPVMKLSCVDTTINEMINYAVSSFVILVPVGLIFISYVFIISAILKIASAEGRKKAFATCTSHLTVVIVHYGCASIAYLKPKSENSIEQDLLLSVTYTIITPLLNPVVYSLRNKEVKDALRRAVGKNIITDRIALSGDV

SEQ ID NO: 1837 - DNA, 942 bp, Canis familiaris
atgcaaacaatgaaggtcaaccagacagtcctgaaggaattcattcttgttggcttttccgtgtacccccatgtgcaggctttcctcttcgtggtcttcctttgcctctatcttctcaccctcacaggtaacctggctatcatgggtctaacttgggtggacagatctctccacacccctatgtacctcttccttggtgccctctctttctccgagacctgctacacactgaccatcatccccaagatgctggccgatctgctgactgaaaacaagagcatctcagtcatggggtgtggcttgcagatgtgtttcttcttgggactcggtggcacaaattgtatcatcctcaccttgatgggatatgatcgctttctggccatctgcaaccctctcagatatccactgcttatgaccaatggggtgtgtggacagcttgtggcctctgcttgggggggaggctttctcatctctctgatagagactgcactgatattcaggggctccttctgcagccccaacctcgtcaaacacttcttctgccacatgcggacagtggcgaggctggcctgtatagacagcaacctcactgaatccattgtgacgatgatctcagtgtcaggcttgatgggcaccttcctgctcatcatcatcacttacgtgttcattctctccactgtattcaggatcccatcagccaagggcaagcagaaggccttctctacctgcgcctcgcatctcacagtggtcattatccactttgggtttgccgctattgtctatatgaagccagaaacttcggggggagatgataccctcatgtctgtcccttatacagtcattactcctttcctcagccccctcattttcagcctcaggaataaggacatgaagaatgcctttaggaaggtgcttggaaagagaagtttcttaaataaataa

SEQ ID NO: 1838 - protein, 313 aa, Canis familiaris
MQTMKVNQTVLKEFILVGFSVYPHVQAFLFVVFLCLYLLTLTGNLAIMGLTWVDRSLHTPMYLFLGALSFSETCYTLTIIPKMLADLLTENKSISVMGCGLQMCFFLGLGGTNCIILTLMGYDRFLAICNPLRYPLLMTNGVCGQLVASAWGGGFLISLIETALIFRGSFCSPNLVKHFFCHMRTVARLACIDSNLTESIVTMISVSGLMGTFLLIIITYVFILSTVFRIPSAKGKQKAFSTCASHLTVVIIHFGFAAIVYMKPETSGGDDTLMSVPYTVITPFLSPLIFSLRNKDMKNAFRKVLGKRSFLNK

SEQ ID NO: 1839 - DNA, 957 bp, Canis familiaris; identical to SEQ ID NO: 12

SEQ ID NO: 1840 - protein, 318 aa, Canis familiaris; identical to SEQ ID NO: 42

SEQ ID NO: 1841 - DNA, 909 bp, Canis familiaris
ttcattctcctgggatttccaacacggccagccttccagctgttcctcttttttgtgttcctggcagcttacctgctgaccctgctggagaacgctctcatcatcctggccattcgcagtgatggacagttgcacaaacccatgtacttcttcctgagcaacctctccttcctggagatgtggtatgtcacggtcatcagccccaagatgctggtcgacttcctcagccatgacaagaccatctccttcaatggctgcatgactcaactgtacttctttgtgacctttgtctgcacggagtacatcctccttgctgttatggcctttgaccgccatgtagccatttgtaatcctctacgctatccagtcatcatgaccaaccagctgtgtggtacattggctgcgggatgctggctctgtgggctcgtgactgccatgattaagatggttttcatagcccgactccactactgtggcaccccccacatcaatcactacttttgtgatatttctccgctcctcaatgtctcttgtgaggactcctcacaggctgagctagtggacttcttcttggccctcatggtcattgccgtccccctttgtgtagtggtggcatcttacgccaccattctcagcaccatcatcaggatcccttctacacagggccgccaaaaggcgttttccacctgtgcctctcacctgacggttgtaatcctcttctactctacaacccttttcacctatgcccgccccaagctcatgtacgcctataactccaacaaagcggtgtctgtgctctacactgtcatcgtccccctgctcaaccccatcatctactgtctgaggaaccgtgaagtaaaggcagccctcaagaagaccatactttgcaaaggaagtgggcccggggaa

SEQ ID NO: 1842 - protein, 303 aa, Canis familiaris
FILLGFPTRPAFQLFLFFVFLAAYLLTLLENALIILAIRSDGQLHKPMYFFLSNLSFLEMWYVTVISPKMLVDFLSHDKTISFNGCMTQLYFFVTFVCTEYILLAVMAFDRHVAICNPLRYPVIMTNQLCGTLAAGCWLCGLVTAMIKMVFIARLHYCGTPHINHYFCDISPLLNVSCEDSSQAELVDFFLALMVIAVPLCVVVASYATILSTIIRIPSTQGRQKAFSTCASHLTVVILFYSTTLFTYARPKLMYAYNSNKAVSVLYTVIVPLLNPIIYCLRNREVKAALKKTILCKGSGPGE

SEQ ID NO: 1843 - DNA, 972 bp, Canis familiaris
ctaatttctccctcctctgtcacagtgttcctattgcttgggttctccaacctttgagaaatccagctcgtcccctttgctgtgtttctctgcctgtatctgattattctgaaggggaacatcgccgttgtcgttgtcatacgcctggatggcagtctccaaggacctatgtacttcttcctggggatcctctccatctctgagacatgctacgtctttgtcatcctgcccaagatgctcataaatctgttgtctctgctcagaacaatctcatttattaactgtgctactcagatcttgttcttcctcggttttgctgtcactgattacatgctgctcagggtcatgggttatgaccgctttgctgccacttgtcatccacttcagtaccctaccctaatgagctggcaggtatgtagacaactggtagccacctgtgctgtgattgtttttttatcctcattgacaggctcccgttttagtctttgaactccctttttagtctttgaactccctttttgtggccccaatataatcaaccactacttctgtgacatctcctggcttgcctgtattgaaacctatgtcaacgagccggtcgtcctcattggtggagttctagccctcctggtccccctgacttacatctgcatctcttactgctgcattgtccataccatcctaaagatcttgtccataccatcctaaagatctcaccctgatggcaagcagaaagccttctccacctgtgtctcccaccccactgtggtcatcgtccacaatggctgtgcctcctctgtctacctgcggccctcagccgagttctcatctaacaaagtcaggcttgtgacaacgacctatacagttgtgactccattgttgagcccaatggtttatagcctcaggaacaaagatgtccagatggccattcagaaagtgattggcagaggaggattttatcctaaagctctg

SEQ ID NO: 1844 - protein, 66 aa, Canis familiaris
NFSLLCHSVPIAWVLQPLRNPARPLCCVSLPVSDYSEGEHRRCRCHTPGWQSPRTYVLLPGDPLHL

SEQ ID NO: 1845 - DNA, 942 bp, Canis familiaris
atggccaattcttcccgggtcactgagttcctgctgctcggtttctccagctttggcgaattgcagcctgtgctctttgtgctctttctcagcctctacttgatcatcctgagtggaaacttcaccatcatctccgtcatccgcctggaccgcagcctccacacgcccatgtacttctttctctgtgtcctgtccacctcggaagtcttctacacaattgttatcctgcccaagatgcttattaacctgctctctgtcctcaggacactctccttcaccagctgtgccacacagatgttcttcttccttggcttcgggatcacgaactgcctgcttctgggagttatgggttatgaccgctgcactgccatctgccagcctttgcgctaccccgttctcatgagctggagggtgtgtgcacagctggcagcaacttgtattgtcagtggcttcctggtatctctggtgggaacaacgttggtcttcagcctccctttctgtggctccaatagggtcaaccactacttctgtgacatctccccagtcatccgacttgcctgtgctgaaacctacatcaacgagctggtcatcttcgtctgtggtgtcctggtgcttgttgtgcctttgatcttcatctgtatctcttatggcttcattgtccgcaccatcctgaagatcccatctgctgatggcaagcgaaaagccttctccacctgtgcctcccatcttattgtggtcatcgtccactatggctgtgcctcctccgtctacctgcggccctcagccaaatcctcatcaggtaaagacaggctggtgacagtgacctacactatcatcaccccactgttgaaccctatggtatacagccttaggaacaaagatgtacagctggccattcggaaagtgattgggaagactgcggtttctcttaagactttatag

SEQ ID NO: 1846 - protein, 313 aa, Canis familiaris
MANSSRVTEFLLLGFSSFGELQPVLFVLFLSLYLIILSGNFTIISVIRLDRSLHTPMYFFLCVLSTSEVFYTIVILPKMLINLLSVLRTLSFTSCATQMFFFLGFGITNCLLLGVMGYDRCTAICQPLRYPVLMSWRVCAQLAATCIVSGFLVSLVGTTLVFSLPFCGSNRVNHYFCDISPVIRLACAETYINELVIFVCGVLVLVVPLIFICISYGFIVRTILKIPSADGKRKAFSTCASHLIVVIVHYGCASSVYLRPSAKSSSGKDRLVTVTYTIITPLLNPMVYSLRNKDVQLAIRKVIGKTAVSLKTL

SEQ ID NO: 1847 - DNA, 240 bp, Canis familiaris
aggtacaaggccttctccacctgtgcctcccacctcattgtggttactgtgcattacggttgtgcctctttcatctacttaaggcccaaatccagctactcttcaagtcaggacacgctcatatctgtgtcctacaccatcctcattgtacttttcaatccaatgattaacagcctgaggaaccaggaattcaaggcagcctttcgaagagtaatgggccagacttcgtatcctcttcac

SEQ ID NO: 1848 - protein, 80 aa, Canis familiaris
RYKAFSTCASHLIVVTVHYGCASFIYLRPKSSYSSSQDTLISVSYTILIVLFNPMINSLRNQEFKAAFRRVMGQTSYPLH

SEQ ID NO: 1849 - DNA, 942 bp, Canis familiaris
atggccaattcttcccgggtcactgagttcctgctgctcggtttctccagctttggcgaattgcaacctgtgctctttgtgctctttctcggcctctacttgatcatcctgagtggaaacttcaccatcatctcggtcatccgcctggaccgcagcctccacacgcccatgtacttctttctctgtgtcctgtccacctcggaagtcttctacacaattgttatcctgcccaagatgcttattaacctgctctctgtcctcaggacactctccttcaccagctgtgccacacagatgttcttcttccttggctttgctgtcacgaactgcctgcttctgggagttatgggttatgaccgctacactgccatctgccagcctttgcgctaccccgttctcatgagctggagggtgtgtgcacagctggcagcaacttgtattgtcagtggcttcctggtatctctggtggcaacaacgttggtcttcagcctccctttctgtggctccaacagggtcaaccactacttctgtgacatctccccagtcatccgacttgcctgtgctgaaacctacatcaacgagctggtcatcttcatctgtggtgtcctggtgcttgttgtgcccttgatcttcatctgcatctcctatggcttcattgtccgcaccatcctgaagatcccatctgctgatggcaagcgaaaagccttctccacctgcgcctcccatcttattgtggtcatcgtccactatggctgtgcctcctccgtctacctgcggccctcagccaaatcctcatcaggtaaagacaggctggtgacagtgacctacactatcatcaccccactgttgaaccctatggtatacagccttaggaacaaagatgtacagctggccattcggaaagtgattaggaagactgcggtttctcttaagactttatag

SEQ ID NO: 1850 - protein, 313 aa, Canis familiaris
MANSSRVTEFLLLGFSSFGELQPVLFVLFLGLYLIILSGNFTIISVIRLDRSLHTPMYFFLCVLSTSEVFYTIVILPKMLINLLSVLRTLSFTSCATQMFFFLGFAVTNCLLLGVMGYDRYTAICQPLRYPVLMSWRVCAQLAATCIVSGFLVSLVATTLVFSLPFCGSNRVNHYFCDISPVIRLACAETYINELVIFICGVLVLVVPLIFICISYGFIVRTILKIPSADGKRKAFSTCASHLIVVIVHYGCASSVYLRPSAKSSSGKDRLVTVTYTIITPLLNPMVYSLRNKDVQLAIRKVIRKTAVSLKTL

SEQ ID NO: 1851 - DNA, 942 bp, Canis familiaris
atggccaattcttcccgggtcactgagttcctgctgctcggtttctccggctttggcgaattgcaacctgtgctctttgtgctctttctcggcctctacttgatcatcctgagtggaaacttcaccatcatctccgtcatccgcctggaccgcagcctccacacgcccatgtacttctttctctgtgtcctgtccacctcggaagtcttctacacaattgttatcctgcccaagatgcttattaacctgctctctgtcctcaggacactctccttcaccagctgtgccacacagatgttcttcttccttggctttgctgtcacgaactgcctgcttctgggagttatgggttatgaccgctacactgccatctgccagcctttgcgctaccccgttctcatgagctggagggtgtgtgcacagctggcagcaacttgtattgtcagtggcttcctgatatctctggtgggaacaacgttggtcttcagcctccctttctgtggctccaatagggtcaaccactacttctgtgacatctccccagtcatccgacttgcctgtgctgaaacctacatcaacgagctggtcatcttcatctgtggtgtcctggtgcttgttgtgcctttgatcttcatctgtatctcttatggcttcattgtccgcaccatcctgaagatcccatctgctgatggcaagcgaaaagccttctccacctgcgcctcccatcttattgtggtcatcgtccactatggctgtgcctcctccgtctacctgcggccctcagccaaatcctcatcaggtaaagacaggctggtgacagtgacctacactatcatcaccccactgttgaaccctatggtatacagccttaggaacaaagatgtacagctggccattcggaaagtgattgggaagactgcggtttctcttaagactttatag

SEQ ID NO: 1852 - protein, 313 aa, Canis familiaris
MANSSRVTEFLLLGFSGFGELQPVLFVLFLGLYLIILSGNFTIISVIRLDRSLHTPMYFFLCVLSTSEVFYTIVILPKMLINLLSVLRTLSFTSCATQMFFFLGFAVTNCLLLGVMGYDRYTAICQPLRYPVLMSWRVCAQLAATCIVSGFLISLVGTTLVFSLPFCGSNRVNHYFCDISPVIRLACAETYINELVIFICGVLVLVVPLIFICISYGFIVRTILKIPSADGKRKAFSTCASHLIVVIVHYGCASSVYLRPSAKSSSGKDRLVTVTYTIITPLLNPMVYSLRNKDVQLAIRKVIGKTAVSLKTL

SEQ ID NO: 1853 - DNA, 942 bp, Canis familiaris
atggagcggggcaacgagaccctggtgagggagttcatcttccttggcttctcttctctggccgggctgcagcggctgctcttcgtcgccttcctgcccctctacctgttcactctgggcaccaatgccatcatcatttccaccatcgtgctggacagagccctgcacacccccatgtacttcttcctggccgtcctctcctgctccgagacctgctacacctttgtcatcgtccccaagatgctggtggacctgctggcccagaagaagaccatctccttcgtgggctgtgccatccagatgttcaccttcctcttcctcggctgctctcactccttcctgctggcagccatggggtatgaccgctacgtggccatctgtaaccctctgcgttacacagagctcatgggacctcgggtgtgtgtgggactcgtggctgctgcctgtgcctgtggcttgactattgcccagattgtcacctccctggtgtttcacctgcccttcctctcctccaaccagctgcatcactacttctgcgacatctctcctgtcctcaaggtggcgtcccatcactcgcgcctcagtcagttggtcatattcatgattggtgtgtgtgtgttggtcgtccccctcctcctcatcctggtctcttacatccgcatcatttctgccattttgaagatcccatcctccaccggcaggtacaaggccttctccacctgtgcctcccacctcattgtggttactgtgcattacggttgtgcctctttcatctacttaaggcccaaatccagctactcttcaagtcaggacacgctcatatctgtgtcctacaccatcctcactccactcttcaatccaatgatttatagcctgaggaaccaggaattcaaggcagcctttcgaagagtaatgggccagactttgtatcctcctcactaa

SEQ ID NO: 1854 - protein, 313 aa, Canis familiaris
MERGNETLVREFIFLGFSSLAGLQRLLFVAFLPLYLFTLGTNAIIISTIVLDRALHTPMYFFLAVLSCSETCYTFVIVPKMLVDLLAQKKTISFVGCAIQMFTFLFLGCSHSFLLAAMGYDRYVAICNPLRYTELMGPRVCVGLVAAACACGLTIAQIVTSLVFHLPFLSSNQLHHYFCDISPVLKVASHHSRLSQLVIFMIGVCVLVVPLLLILVSYIRIISAILKIPSSTGRYKAFSTCASHLIVVTVHYGCASFIYLRPKSSYSSSQDTLISVSYTILTPLFNPMIYSLRNQEFKAAFRRVMGQTLYPPH

SEQ ID NO: 1855 - DNA, 945 bp, Canis familiaris
atgaggagacagaaccagagcatgattacggagttcatccttatcggcttctcaaacctgggagatctgcagatccttctcttcttcctcttcctcctggtttacctgaccactctgatggccaatgccaccatcatgactgtcatccgtctggacaggactttgcacacccctatgtacttctttctctttgtcctctcctgctctgaaacctgctacaccttggtcattgtaccaaaaatgctgaccaacctgctttccacgagtcagactatttcttttcctgcgtgtgctgctcagctctacttcttcgtgggcttggcttgtaccaactgttttctcattgccgtaatgggctacgaccgctacgttgccatctgcaaccctctcaactacacgcttgttgtcagcagagccacctgtgtgcaactggtcctagcctccagctgctgtggcttcctgatctctgtggttgttaatgtcttggtgtttagtgtgcccttctgtgcctccaatcggatcaaccactttttctgtgatattttcccagtcatcaaactaggctgcactgacaccaacgtgaaggagatggtcatcttcttcctcagcattctggtattgctggtccccctagtgctgatcttcatctcctacgtcttcattgtctccaccatcctcaagattgcatccgccgaggggcagcggaaggcctttgctacctgtgcctcccacctcacagtggtcatcgtccactatggctgcgcctccttcatctacctgaggcccacatccctgtactcctcagaaaaggaccggctcgtggcagtgacctacactgtgatcaccccgctgcttaacccccttgtctacaccctgagaaataaagaagtcaagactgcactgagtaaggttctcagcaggtactcattccccaaaactgtatga

SEQ ID NO: 1856 - protein, 314 aa, Canis familiaris
MRRQNQSMITEFILIGFSNLGDLQILLFFLFLLVYLTTLMANATIMTVIRLDRTLHTPMYFFLFVLSCSETCYTLVIVPKMLTNLLSTSQTISFPACAAQLYFFVGLACTNCFLIAVMGYDRYVAICNPLNYTLVVSRATCVQLVLASSCCGFLISVVVNVLVFSVPFCASNRINHFFCDIFPVIKLGCTDTNVKEMVIFFLSILVLLVPLVLIFISYVFIVSTILKIASAEGQRKAFATCASHLTVVIVHYGCASFIYLRPTSLYSSEKDRLVAVTYTVITPLLNPLVYTLRNKEVKTALSKVLSRYSFPKTV

SEQ ID NO: 1857 - DNA, 945 bp, Canis familiaris
atggagcagggcaatgagaccctggtgagggagttcatcttccttggcttctcttctctggccgggctgcagcggctgctcttcgtcgccttcctgcccctctacctgttcactctgggcaccaatgccatcatcatttccaccatcgtgctggacagagccctgcacacccccatgtacttcttcctggccgtcctctcctgctccgagacctgctacacctttgtcatcgtccccaagatgctggtggacctgctggcccagaagaagaccatctccttcgtgggctgtgccatccagatgttcaccttcctcttcctcggctgctctcactccttcctgctggcagccatggggtatgaccgctacgtggccatctgtaaccctctgcgctacacagagctcatgggacaccgggtgtgtgtgggactcgtggccactgcctgtgcctgtggcttgactattgcacagattatcacctccctggtgttttacctgccgttccgctcctccaaccagctccatcactacttctgcgacatccctcctgtcctcaaagtggcatctcaacatacccacttgagtcagattgtcattatcatgctctgtgcattggtcctggttatccctctgctactgattttggtatcctatattcacatcatctctgccatcatccaatttccttccacattaggcagatacaaagctttctccacctgtgcgtcccacctcattgttgtcaccattcattatggttgcgcctcctttatctacttaaggctcaagtccacctactcctcaagccaggatgctctcatatcagtctcctacaccatgctcactccactgttcaacccactgatttatagcctcagaaataaagagttcaggtcagcgcttcacagagctgtgcgaaaaatcattttcctgccacaatgttaa

SEQ ID NO: 1858 - protein, 314 aa, Canis familiaris
MEQGNETLVREFIFLGFSSLAGLQRLLFVAFLPLYLFTLGTNAIIISTIVLDRALHTPMYFFLAVLSCSETCYTFVIVPKMLVDLLAQKKTISFVGCAIQMFTFLFLGCSHSFLLAAMGYDRYVAICNPLRYTELMGHRVCVGLVATACACGLTIAQIITSLVFYLPFRSSNQLHHYFCDIPPVLKVASQHTHLSQIVIIMLCALVLVIPLLLILVSYIHIISAIIQFPSTLGRYKAFSTCASHLIVVTIHYGCASFIYLRLKSTYSSSQDALISVSYTMLTPLFNPLIYSLRNKEFRSALHRAVRKIIFLPQC

SEQ ID NO: 1859 - DNA, 948 bp, Canis familiaris
atgcacagtttcaatagaaccactatggttacacggtttgtcctggtgggcttctctagcctgggggagctccagctactgctgtttgtcatcttccttctcctgtatttgacaatcctactggccaatgcaaccatcatggctgttatccgctgcagccggactctacacactcccatgtatggtttcttattcatcctttccttttctgagtcctgctacacatttgtcatcatccctcagctgctggtccacctgctctcagccaccaagagcatctcctttgtggcctgtgctgcccagcttttcttcttccttggctttgcctgcaccaactgctttctcatcgctgtgatggggtatgaccgctacgtggcaatttgccagcctctgaggtatacacttgtcatgaacaaaaggctagggttggggttggtttccctgtctggagtcacaggtttcttcattgctttggtggccaccaatctcatctgtgacatgcccttctgtggccccaacagggtcaaccactacttctgtgacatggcacctgttattaagttggcctgcacagacacccatgtgaaagaactggctctattcagcctcagcatcttggtgatcatggtgcctttcctgctaattctcatctcctatggcttcatccttaataccatcctgaagatcccctcggctgagggaaaaaggaaggcctttgccacctgcgcctcccacctcacagtggtcatcgtgcactacggctgtgcgtccatcatctacctgaggcccagatccaagtctgcctcagacaaggatcagttggtggcagtgacctatactgtggttactcccctacttaatccccttgtctacagtctgaggaatcaggaggtgaagactgccctcaaaagagttctggggatgcctgtggcaaccaaagtaatctaa

SEQ ID NO: 1860 - protein, 315 aa, Canis familiaris
MHSFNRTTMVTRFVLVGFSSLGELQLLLFVIFLLLYLTILLANATIMAVIRCSRTLHTPMYGFLFILSFSESCYTFVIIPQLLVHLLSATKSISFVACAAQLFFFLGFACTNCFLIAVMGYDRYVAICQPLRYTLVMNKRLGLGLVSLSGVTGFFIALVATNLICDMPFCGPNRVNHYFCDMAPVIKLACTDTHVKELALFSLSILVIMVPFLLILISYGFILNTILKIPSAEGKRKAFATCASHLTVVIVHYGCASIIYLRPRSKSASDKDQLVAVTYTVVTPLLNPLVYSLRNQEVKTALKRVLGMPVATKVI

SEQ ID NO: 1861 - DNA, 900 bp, Canis familiaris
agacaccacacttccagcactgggttgatcttccagggcttctcgagcttctgcggacaccagctcaccccgttcgccgtgttccttgtgctctacaccttcacccagggtggcaacgtcgtcatcgtgaccgttgcctccgaccgttgcctccacatgcccatgtacttcttcctgaacacgctgtccgcctccgagatggtctacatccttgtcattctcccatggatgctctccagcctcgcgggtatgagccaggccatctcacaggcaggctgtgtcaaccagatgttcttttttgtaaccttgggcatcaacaactgcttcctgctcatggccatgggctacgactactacatggccatctgcaaccccttgagatactcagttattatcaacaagagaaagcgtgtccagctggtggggggagcctgcagcattgggttgatggtagcaatcacacaagtgacatctgtgttcaggctgcccttctgtgccacgagggtggcccacttcttctgtgacatccgacccgtgatgaagctctcctgcatcaacaccacagccaatgagatcctgactctgatcatcagtgtgctggtgatcctggtgcccatggggctggtcttcgtctcctatgtcctcatcatctccaccatcttcaagatcccctctgcacaggggtcacctgagcctcccacctcaccatggtcattgtccattatggctgcgcctccatcgcctacctcaagcccaagtcggagaacaccagggatgaggaccagcttgacctcggtgacctacacagtcatcaccctgctgctgaaccctgtggtgtacaccctgaggaacgaggaggtcaaggatgctctgctccgggccactggcaggaagctttcc

SEQ ID NO: 1862 - protein, 300 aa, Canis familiaris
RHHTSSTGLIFQGFSSFCGHQLTPFAVFLVLYTFTQGGNVVIVTVASDRCLHMPMYFFLNTLSASEMVYILVILPWMLSSLAGMSQAISQAGCVNQMFFFVTLGINNCFLLMAMGYDYYMAICNPLRYSVIINKRKRVQLVGGACSIGLMVAITQVTSVFRLPFCATRVAHFFCDIRPVMKLSCINTTANEILTLIISVLVILVPMGLVFVSYVLIISTIFKIPSAQGSPEPPTSPWSLSIMAAPPSPTSSPSRRTPGMRTSLTSVTYTVITLLLNPVVYTLRNEEVKDALLRATGRKLS

SEQ ID NO: 1863 - DNA, 936 bp, Canis familiaris
atgccgaagcccaacaccactgctgtgacggagtttaccttcgaaggcttttccgctttggggtggcagcgcagactcctcctcttcgtggtctttctggccttgcacctggtgacccttggcagcaatgccctcatcctggcggctgttcgcctgagccgtcacctccacacccccatgtacttcctcctgagcgcgctgtccctctctgagacctgctacagcgtggccatcgtcccccgcatgctctccggtctcctgagcccccgggaggccgtctccgttgcgggctgtgccactcagctcttcttctatctcacctttggcgtcaccaactgcttcctgctcgcggccatgggctacgaccgctacgtggccatctgcgaccccctgcggtatgcggtcgtcatgggccaaaggacctgtgtgcacctggcgtgtggctcctggagcgtgggcctgagcacagccatcatccaggtgtcttccgtgttcagcctgcccttctgtgacgccagcgtcatctcccattttttctgcgacatccggcccctcatgaagctggcctgtgccgacaccaccatcaaagagcttctcactttgctcatcagtctgtgcgtgctcgtcttgcccatggtcctcatcttcatctcctatgtcctgatcgtctccaccatcctcaagatggcatcagctgagggccagaggaaggctttcgccacctgcgcctcccacctcaccgtggtcatcgtccactatggctgcacctccttcatctacctaaaacccaaatcgcaaaattccctgcaggacagactcctctctgtgacctacacggtcatcacgcccctgctgaaccccgtggtctacggcctgaggaacaaggaggtcaagcaggccttgctccgagctgtgggcaggaagcctctcccgtag

SEQ ID NO: 1864 - protein, 311 aa, Canis familiaris
MPKPNTTAVTEFTFEGFSALGWQRRLLLFVVFLALHLVTLGSNALILAAVRLSRHLHTPMYFLLSALSLSETCYSVAIVPRMLSGLLSPREAVSVAGCATQLFFYLTFGVTNCFLLAAMGYDRYVAICDPLRYAVVMGQRTCVHLACGSWSVGLSTAIIQVSSVFSLPFCDASVISHFFCDIRPLMKLACADTTIKELLTLLISLCVLVLPMVLIFISYVLIVSTILKMASAEGQRKAFATCASHLTVVIVHYGCTSFIYLKPKSQNSLQDRLLSVTYTVITPLLNPVVYGLRNKEVKQALLRAVGRKPLP

SEQ ID NO: 1865 - DNA, 294 bp, Canis familiaris
cttcttacttcttacctctgtgacgtgagacccctgctgaagctggcctgcatggacaccactgtcaatgagatcatcaactttgttgtcagtatctgtgtcctggttctactcatgggcctggtcttcatctcctatgtccccatcatctccaccatccttaagatcacttcagctgagagccagaaggcctctgccacctgcgcctcccacctcaccgtggtcatcgtcctctatggctgcacttccatcatccacctcaagcccaagtcccagagttccctggggcaggac

SEQ ID NO: 1866 - protein, 98 aa, Canis familiaris
LLTSYLCDVRPLLKLACMDTTVNEIINFVVSICVLVLLMGLVFISYVPIISTILKITSAESQKASATCASHLTVVIVLYGCTSIIHLKPKSQSSLGQD

SEQ ID NO: 1867 - DNA, 930 bp, Canis familiaris
atggagggaaagaatcacactttggtgagcgagttcactttccagggcttctcgagcttcggcgagcaccagctcaccctgttcgttgtgttccttgtgctctacaccttcaccctggctggcaacgtggtcatcgtgaccgtcattagtgttgaccgccgcctccacacgcccatgtacttcttcctgagcacgctgtctgtttcggagaccgtgtacaccctcgtcattatacccaagatgctctgtaacctcctaggcctgagtcagcccatctccttggcaggttgtgccacccagatgttcttcttcatcaccttggccatcaacaactgcttcctgctcacggccatgggctacgaccgctacgtggccatctgtgaccccttgaggtacgcggtcatcatgagcaaaggaatatgcatccagttggtggggggagcctgcagcattggcctgatcgtagccatgacacaggtgctggctgtgttcaggctgcccttctgtgccacgagggtggcccacttcttctgtgacatccgacccgtgatgaagctctcctgcatcgacaccacagccaatgagatcctgactctgatcatcagtgtgctggtgatcctggtgcccatggggctggtcttcatctcctacgtcctcatcatctccaccatcctcaagatcccctctgcccagggccggaagaaggcctttgccacctgcgcctcccacctcaccgtggtcatcgtccactacggctgcgcctccatcgcctacctcaagcccaagtcggagaactccagggatgaggaccagctgatctcggtgacctacacggtcatcaccccgctgctgaaccctgtggtgtacaccctgaggaacaaggaggtcaaggatgctctgctccgggccactggcaggaagctttcctga

SEQ ID NO: 1868 - protein, 309 aa, Canis familiaris
MEGKNHTLVSEFTFQGFSSFGEHQLTLFVVFLVLYTFTLAGNVVIVTVISVDRRLHTPMYFFLSTLSVSETVYTLVIIPKMLCNLLGLSQPISLAGCATQMFFFITLAINNCFLLTAMGYDRYVAICDPLRYAVIMSKGICIQLVGGACSIGLIVAMTQVLAVFRLPFCATRVAHFFCDIRPVMKLSCIDTTANEILTLIISVLVILVPMGLVFISYVLIISTILKIPSAQGRKKAFATCASHLTVVIVHYGCASIAYLKPKSENSRDEDQLISVTYTVITPLLNPVVYTLRNKEVKDALLRATGRKLS

SEQ ID NO: 1869 - DNA, 933 bp, Canis familiaris
atgaagacaaccaaccacacagaagtgacggagtttgttttccaaggtttctccaacttcggagaacatcaactcaccctctttgccgtgtttctggccctctacatcccaactctggctggcaatgtcatcatcgtgactattatccatatcgaccaccacctccacacccccatgtacttctttctgagtgttctttccacgtcagagactttctactccctggtcattatcccacgcatgctttccagcctcataggtctgagccaatccatctccctggtgggctgtgggactcagctctttttcttccttggctttgccatcaccaactgtctcctgctagcagtaatggggtttgatcgttacgtggccatctgtaaccctcttcgttattcgatcatcatgaattggagggtctgtaccattctggcatcttcggtctgtgcctcagggttcttgctctccctggttcaggctgtggccattttcagactgcctttttgcaactcactgattgagcatttcttctgtgatgttcgacctgtgttggacctggcctgtgctactccagtcattaatgacatcctgaccttagttataagtctcttggccattacagcccctgccaccttcctctttgtctcctacatcctcatcatctccaccatccttaagatcgcctcagccgagggccggaagaaggcctttgccacctgcgcctcccacctcaccgtggtcatcatccactacggctgcgcctccattgcctacttcaagcccaagtcggagaacaccagggatcaggaccagctgatctcagtgacttacacggtcataacacctttactgaaccctgtggtgtatagtctgagaaacaaagaagtccaggatgctctgaggagggtggtgggtaggaaatcccttccctaa

SEQ ID NO: 1870 - protein, 310 aa, Canis familiaris
MKTTNHTEVTEFVFQGFSNFGEHQLTLFAVFLALYIPTLAGNVIIVTIIHIDHHLHTPMYFFLSVLSTSETFYSLVIIPRMLSSLIGLSQSISLVGCGTQLFFFLGFAITNCLLLAVMGFDRYVAICNPLRYSIIMNWRVCTILASSVCASGFLLSLVQAVAIFRLPFCNSLIEHFFCDVRPVLDLACATPVINDILTLVISLLAITAPATFLFVSYILIISTILKIASAEGRKKAFATCASHLTVVIIHYGCASIAYFKPKSENTRDQDQLISVTYTVITPLLNPVVYSLRNKEVQDALRRVVGRKSLP

SEQ ID NO: 1871 - DNA, 933 bp, Canis familiaris
atgccaaactccactgctgtgactgagttcctcctggaagggttctccagctttgggtggcagcaccggcttgtcttctttgctgtctttctaactctgtacctactgactctctgcggcaatgtcatcatcgtgactattattcatctggaccgtcacctccacacccccatgtacttcttcctgagcatgctgtccctctctgagacctgctacaccgtggccatcattccccgtatgctttctggcctcctgaatccccaccagcccattgctgtccaaggctgtgccactcagctcttcttctatctcacctttggcatcaacaactgcttcctgctcacagccatgggctatgaccgctacgtggccatctgcaaccccctgcggtactcagtcatcatgagtaaagagacttgtgtccagttggcatatggatcactgggaattggcttgagcatggccatcatccaggtaacatctgtgtttggcctgcccttctgtgatgcatttgtcatctctcacttcttctgtgacgtgagacccctgctgaagctggcctgcatggacaccactgtcaacgagatcatcaactttgttgtcagtgtctgtgtcctggttctacccatgggcctggtcttcatctcctatgttctcatcatctccaccatccttaagatcacttcagctgagggccggaagaaggcttttgccacctgcgcctcccacctcaccgtggtcatcatccactatggctgcgcttccatcatctacctcaagcccaagtcccagagttctctggggcaggacagactcctctctgtgacctacacagtcatcacccccttgctgaaccccgttgtgtacagcctgcggaacaaagaggtcaaggatgctctgcacagagctgtggggcggaatctttcctcttaa

SEQ ID NO: 1872 - protein, 310 aa, Canis familiaris
MPNSTAVTEFLLEGFSSFGWQHRLVFFAVFLTLYLLTLCGNVIIVTIIHLDRHLHTPMYFFLSMLSLSETCYTVAIIPRMLSGLLNPHQPIAVQGCATQLFFYLTFGINNCFLLTAMGYDRYVAICNPLRYSVIMSKETCVQLAYGSLGIGLSMAIIQVTSVFGLPFCDAFVISHFFCDVRPLLKLACMDTTVNEIINFVVSVCVLVLPMGLVFISYVLIISTILKITSAEGRKKAFATCASHLTVVIIHYGCASIIYLKPKSQSSLGQDRLLSVTYTVITPLLNPVVYSLRNKEVKDALHRAVGRNLSS

SEQ ID NO: 1873 - DNA, 933 bp, Canis familiaris
atgaagagcgagaaccacaccgtggtgggtgagttcgttctccagggcttttccagctttagagaacaccagatcatcctctttgttatatttcttaccttgtacctttttactctggctggcaatgtcgtcatcgtgacggttattggctctgcccgtcacctccacacccccatgtacttcttccttagcgtcctctccgtgtccgagaccgtgtacacgctggtcattgtaccgcggatgctctgcagccttatgggtctcagccgacgcatctcacgggcgggctgtgccacccagatgttcttcttcatcaccttggccatcaacaactgcttcctgctcacggccatgggctacgaccgctacgtggccatctgcaaccccctgcggtacacggtcgtcatgagcaagagggtgtgtgccctgctcgtatggggcgctttcagcattgggctgctggtggccataattcagatttcctccgtgttcaggctgcccttttgtgacagagaagtggcccattatttctgtgacatccgcccagttatggaactctcctgtgcagacaccactctacacgacatcattaactttatcatcagctccctggttatcgtggtgcccatggggctggtcttcgtctcctacgtcctcatcatctccaccatcctcaagatcagctctgcccagggccggaagaaggcctttgccacctgcgcctcccacctcatcgtggtcatcgtccactacggctgcgcctccatcgcctacctcaagcccaagtcggagaacaccagggatgaggaccagctgatctcagtgacctacacggtcatcaccccgctgctgaacccggtggtgtacaccctgaggaacaaggaggtcaaggatgctctgcaccgtgctatcagcaaaaatcctcatgcctag

SEQ ID NO: 1874 - protein, 310 aa, Canis familiaris
MKSENHTVVGEFVLQGFSSFREHQIILFVIFLTLYLFTLAGNVVIVTVIGSARHLHTPMYFFLSVLSVSETVYTLVIVPRMLCSLMGLSRRISRAGCATQMFFFITLAINNCFLLTAMGYDRYVAICNPLRYTVVMSKRVCALLVWGAFSIGLLVAIIQISSVFRLPFCDREVAHYFCDIRPVMELSCADTTLHDIINFIISSLVIVVPMGLVFVSYVLIISTILKISSAQGRKKAFATCASHLIVVIVHYGCASIAYLKPKSENTRDEDQLISVTYTVITPLLNPVVYTLRNKEVKDALHRAISKNPHA

SEQ ID NO: 1875 - DNA, 936 bp, Canis familiaris
atgaagagccagctgaacaggaattcctcaggagtgactgagttcattctgctgggcttcagaacccctccgaagctgcagatcttcttgttcttggtgttcttgctggcctacgtggtcactgtggtgggaaataccagcatgataattgtcatcaggatggactcgaggcttcatacacctatgtatttcttccttagaaacttatcctatttagatctctgctactctacagtcattgctcccaaaactttagccaacttcctatctcatgaaaagaagatttcctacaatggctgtgcagcccaatttttcttctttgctctgtttgtcacaactgaaggctttcttctggccgtgatggcatatgatcgcttctcagccatttgctcgccattcctctatcctgtccgtatgtctcaacaggtttgtgttcatttagtaattggctcctacatctgtggaggcatcaactccatggtccagacaggattcaccttcagcttgcgtttctgtggagaaaaccgactggaccacttcttctgtgatgtcccagccctgatcaagatctcatgtgttgacacgtctgtgaacgagatggtgctattcattctctcctccctcatcattgtcaccaccacaagtgtcatcctggtttcctatgcttacatactctccactgtcctgaagatcccctccacctatggtaggggtaagaccttctccacctgtggctcccacatggccacggtgagtttgttctatgggactgtgttcttcatgtacgcccagcctggggccatctcctccccagggcaaaacaaggtcatagctgtgctctacacactcatcatcccaatgctaaaccctctgatatacagtctaagaaacagagacgtgaaagatgctgtgagaagaatgctgtacaggaagtga

SEQ ID NO: 1876 - protein, 311 aa, Canis familiaris
MKSQLNRNSSGVTEFILLGFRTPPKLQIFLFLVFLLAYVVTVVGNTSMIIVIRMDSRLHTPMYFFLRNLSYLDLCYSTVIAPKTLANFLSHEKKISYNGCAAQFFFFALFVTTEGFLLAVMAYDRFSAICSPFLYPVRMSQQVCVHLVIGSYICGGINSMVQTGFTFSLRFCGENRLDHFFCDVPALIKISCVDTSVNEMVLFILSSLIIVTTTSVILVSYAYILSTVLKIPSTYGRGKTFSTCGSHMATVSLFYGTVFFMYAQPGAISSPGQNKVIAVLYTLIIPMLNPLIYSLRNRDVKDAVRRMLYRK

SEQ ID NO: 1877 - DNA, 861 bp, Canis familiaris
atgatgggaaaccagacatcagtgatagaattcattcttcttggactgacgaatgacactgagcttcaagctgtgcttttcctttttctgctgctaacttatgtcttaagcatcatgggaaacttgaccatcatcattctgacccttttggattatcgccttcagactcctatgtatttctttctccggaatttttctgttttggaaatatcttttacttctgtctttgttcccaaaatgctagtcaatattgcaactggagacaagactatctccttcgctggatgtttcactcagtatttttttgccatccttctgggggcaactggattttatcttttagctgccatgtcctatgattgctatgttgccatttgtaaacccctacattatacaactgtaatgagcagcaaactgcattcaacttgttctgtgttcctggttctctggttttttggttactgctgcatctgtcctgttcagacacacagttcattggaaatgatggagtttatctttgcagcagttaccgtcatcttcaccttggtgctagtgattctttcctacacgtacataatcaggacaattctgagaatcccttctgttcaacaaaggaaaaaagccttttctacatgctcctgtcacattattgtggtctcactttcttatggaagttgtatctttatgtacataaatccttctcttaaggatgcagaaacttttaataagagagtggctgttttaaatacctcagttgcccctctgttgaaccctttcatctataccctaaggaaaaagcaagtgaaaatagccttcaaagacatggtcagcaagataatgatgttttcaggaaaatgaaag

SEQ ID NO: 1878 - protein, 285 aa, Canis familiaris
MMGNQTSVIEFILLGLTNDTELQAVLFLFLLLTYVLSIMGNLTIIILTLLDYRLQTPMYFFLRNFSVLEISFTSVFVPKMLVNIATGDKTISFAGCFTQYFFAILLGATGFYLLAAMSYDCYVAICKPLHYTTVMSSKLHSTCSVFLVLWFFGYCCICPVQTHSSLEMMEFIFAAVTVIFTLVLVILSYTYIIRTILRIPSVQQRKKAFSTCSCHIIVVSLSYGSCIFMYINPSLKDAETFNKRVAVLNTSVAPLLNPFIYTLRKKQVKIAFKDMVSKIMMFSGK

SEQ ID NO: 1879 - DNA, 969 bp, Canis familiaris
atggaaaaccgtacaactgtgacagtatttatcttagcaggattgatggaggaccccaaactgaagattgtgctatttgtcttcctgctcctcacttacttgctaagcatctcaggcaacttagttattattaccctcactttgctggactcacatctcaagacccctatgtatttctttcttcgaaatatttctttcttagaaatttcttatatgacagtctgcatccccaaattgcttgtaagcatggcaactggtgacaaaaccatttcttataactgtcgtgcaactcagttgtttgccttccttcttggagcatctgaatgttacctcctggctgtcatgtcctacgatcgttatgtcgccatctgcaggcccctgcattacacaaccattatgagcagcaaaatctgtatccagctagtccttagctcttggatcactggtttcctcatcatctttccaggactcattttaggcttaagcctggacttctgtgattccaatgtcattgatcatttctactgtgacactgctcccctcctgcagatctcctgcacagacagacacgtgttggaaatgatgagtttcatcttagctttggtgactctgctggtcactttggcattagtaaatctatcatacacatatattgccctgacaattttaaaaattccttctgtcaaccagagaaaaaagaaaaaagctttctccacctgttcttctcacatgattgtcatctccctctcatatggcagctgcatctttatgtaccttaaaccctcagtcaaacagaggatatccttgatgaagggagtggcagttctcaatacttctgttgctccacttttgaatccctttatttatactctaaggaaacagcaagtgaagcaagcattttatttttctgttccattgtaagcattctcaatttttaaaaacattttaaaaaatatttttcttatttat

SEQ ID NO: 1880 - protein, 306 aa, Canis familiaris
MENRTTVTVFILAGLMEDPKLKIVLFVFLLLTYLLSISGNLVIITLTLLDSHLKTPMYFFLRNISFLEISYMTVCIPKLLVSMATGDKTISYNCRATQLFAFLLGASECYLLAVMSYDRYVAICRPLHYTTIMSSKICIQLVLSSWITGFLIIFPGLILGLSLDFCDSNVIDHFYCDTAPLLQISCTDRHVLEMMSFILALVTLLVTLALVNLSYTYIALTILKIPSVNQRKKKKAFSTCSSHMIVISLSYGSCIFMYLKPSVKQRISLMKGVAVLNTSVAPLLNPFIYTLRKQQVKQAFYFSVPL

SEQ ID NO: 1881 - DNA, 462 bp, Canis familiaris
attgagctgatggggtacttaaccattatcctcctcactctggtggatcctcacctcaagatgccaatgtatttctttctctgtaatttctcatttttagaaatcatattcacaacggtatgtattcccagatatttgaaaaccgtagtgactaaagaacaaaacatttctaataataactctgtggctcaattattttttattcttttactgggagttgcagagttttaccttctggctgctatgtcctatgaccgctatgttgccatctgtaaacccttgcattacccaatcattatgaacagcagagtgtgctattggcttgtactttcttcctggctgactggattcctaatcatctttcccccattgctcatgggactcaagctggatttctgtgcttccaaaatgactttatgtatgaaacttcccccatcctgcagatatcctgcacagacacac

SEQ ID NO: 1882 - protein, 154 aa, Canis familiaris
IELMGYLTIILLTLVDPHLKMPMYFFLCNFSFLEIIFTTVCIPRYLKTVVTKEQNISNNNSVAQLFFILLLGVAEFYLLAAMSYDRYVAICKPLHYPIIMNSRVCYWLVLSSWLTGFLIIFPPLLMGLKLDFCASKMTLCMKLPPSCRYPAQTH

SEQ ID NO: 1883 - DNA, 930 bp, Canis familiaris
atggctgcagaaaatcactcaacagtgaccgagttcattctcaggggcttgacaagtcagccagatctccagctcccacttctcctcctcttccttgggatctacttggtcaccgtgatggggaacctgggcatgttcacactgatttgtctgaatgctcagcttcacacccccatgtactacttcctcagcaacctgtcacttgtggatctctgctactcctctgccattacccctaaaatgttggtgaactttgtgtcagagaagaacatcatctcctattcagggtgcatgtcacagctctacttcttcctactgtttgtcattgctgagtgttacatgctgacagtgatggcctatgaccgctatgtcgccatctgcagccctttgctctacaatgtcatcatgagtcatcaagtctgctccctgctggtggctgtggtctatgccatggggctcattggctcaacaatagagactggcctcatgttaaaactgtcctattgtgagctcctcatcagccattacttctgtgacatcctccctctcatgaagctctcctgctctagcacctacgatattgagatgacagtcttctttttggccggatttaacatcatactcaccagtttaacagtccttgtttcctatgccttcatcctctccagcatcctccgcatcagcaccacagagggcaggtccaaagccttcagcacctgcagctcccaccttgctgctgtggggatgttctacgggtctactgcgttcatgtacctgaaaccctccacggccagttccctggcccaggagaacatagcctctgtgttctacactacagtgattcccatgctgaaccccctgatctacagcttgaggaataaggaggtaaaggctgctttgcagaaaacactgaggagaaaaatgttctga

SEQ ID NO: 1884 - protein, 309 aa, Canis familiaris
MAAENHSTVTEFILRGLTSQPDLQLPLLLLFLGIYLVTVMGNLGMFTLICLNAQLHTPMYYFLSNLSLVDLCYSSAITPKMLVNFVSEKNIISYSGCMSQLYFFLLFVIAECYMLTVMAYDRYVAICSPLLYNVIMSHQVCSLLVAVVYAMGLIGSTIETGLMLKLSYCELLISHYFCDILPLMKLSCSSTYDIEMTVFFLAGFNIILTSLTVLVSYAFILSSILRISTTEGRSKAFSTCSSHLAAVGMFYGSTAFMYLKPSTASSLAQENIASVFYTTVIPMLNPLIYSLRNKEVKAALQKTLRRKMF

SEQ ID NO: 1885 - DNA, 897 bp, Canis familiaris
cctgtgctccagcaacccctcttcttcctgtttctgatgatctacatcgtcaccatggtgggcaaccttggcttgatcatcctcatcggtctcaattctcacctccacatccccatgtactatttcctcttcaatctatccttcattgatctctgttactcttctgttttcacccccaagatgctgatgaactttgtatcaaaggacaatatcatctcctatgttgggtgcatgactcaactgttcttctttctcttttttgtcatctcagaatgctacatgttgacctcgatggcctatgaccgctacgtggccatctgtaatccattgctgtataaggtcaccatgtcccatcaggtctgttccttgctaactgttgctgcatatatgatgggatttgccggagcctctgcccacacggggtgcatgcttagactaacgttctgcaatgtcaatatcatcaaccattacctgtgtgacatccttcctctcctccaactctcttgcatcagcacctatatcagtgagatagtagttctgatagtcatgggaattaatatcacagtacccagttttaccattctgatttcttatgtcttcattctcactaacatttttcacatcaaaactgctcaaggaaggtcaaaagccttcagtacctgtagctttcacatcattgctctttgcctttttttgctctttgccttttttcttggatcagcagcattcatgtatcttaaatattcttcttctggatctatggacctgggaaaaatttcttcagtgttttatactaatgtgatacccatgctcaatcccctgatctacagtttgtggaacaaggatatcaaagttacactgcagaaaaccttgcttaaaatccagagtagaaacatg

SEQ ID NO: 1886 - protein, 299 aa, Canis familiaris
PVLQQPLFFLFLMIYIVTMVGNLGLIILIGLNSHLHIPMYYFLFNLSFIDLCYSSVFTPKMLMNFVSKDNIISYVGCMTQLFFFLFFVISECYMLTSMAYDRYVAICNPLLYKVTMSHQVCSLLTVAAYMMGFAGASAHTGCMLRLTFCNVNIINHYLCDILPLLQLSCISTYISEIVVLIVMGINITVPSFTILISYVFILTNIFHIKTAQGRSKAFSTCSFHIIALCLFLLFAFFLGSAAFMYLKYSSSGSMDLGKISSVFYTNVIPMLNPLIYSLWNKDIKVTLQKTLLKIQSRNM

SEQ ID NO: 1887 - DNA, 933 bp, Canis familiaris
atgcctcctggaaatgcttctcttgtgactgaattcattctggtggggctcacagacttaccatatctccagctccccctgttctgcctgtttctactcatgtatgtggtcactgtgctgggaaacttatgcttggtcactcttatcaggctgaattctcacctccacacccccatgtactttttcctcttcaatttgtccttcatagacctctgttattcttctgtgtttacacccaaaatgttgattaacttcacatccaagaagaatattatctcctacatggggtgcatgacccagctttactttttctgtttttttgttgtttctgaatgctatgtgctgacatccatggcctatgatcgctatgtggccatctgtaacccacttttgtataatgttgccatgtcccctaatgtgtgttccctccttatgcttggttcatatttgatggcattctcaggtgccatggcccacacaggatgcatgctgagactgatcttctgtgatgcaaacaccatcaaccattatttgtgtgacattctccctctgctccagctctcctgcaccagcacgtatgtgaatgagctggtggttttcattgtggtgggcatcaacatcattgtgcccagtgtcaccgtctttgtgtcttatggtttcatcctttccagcatcctgcgcataagctccactgagggcaggtccaaggcattcagtgcctgtagttcccacataattgctgtttctctcttctttgggtcaggtgcatttatgtatcttaaaccatcatccactgagtctatggatgagggaaaaatctcttctgtcttttataccaatgtggttcccatgatgaaccctttaatctatagcttgaggaacaaagatgttaaaattgctttgcaaaaaaccctcaatagaagaacgttttga

SEQ ID NO: 1888 - protein, 310 aa, Canis familiaris
MPPGNASLVTEFILVGLTDLPYLQLPLFCLFLLMYVVTVLGNLCLVTLIRLNSHLHTPMYFFLFNLSFIDLCYSSVFTPKMLINFTSKKNIISYMGCMTQLYFFCFFVVSECYVLTSMAYDRYVAICNPLLYNVAMSPNVCSLLMLGSYLMAFSGAMAHTGCMLRLIFCDANTINHYLCDILPLLQLSCTSTYVNELVVFIVVGINIIVPSVTVFVSYGFILSSILRISSTEGRSKAFSACSSHIIAVSLFFGSGAFMYLKPSSTESMDEGKISSVFYTNVVPMMNPLIYSLRNKDVKIALQKTLNRRTF

SEQ ID NO: 1889 - DNA, 933 bp, Canis familiaris
atggctcctacaaactcctcttttgtgactgaattcattctggtggggctcacagacttaccagatctccagctcccccttttctgcctgtttctactcatgtatatggtcaccctgttgggaaatttgggtttgatctttctgattgggctgaattcacacctccacacccccatgtactttttcctcttcaatttgtccttcatagacttctgttattcctctgtgtttactcccaaaatgctgattaacttcatatccaaaaagaatattatctcctacaaggggtgcatgacccagctttactttttctgtttttttgctatttctgaatgctatgtgctgacatccatggcctatgatcgctatgtggccatctgtaacccacttttgtataatgttgtcatgtctcctaatgtgtgtttcagtcttatgcttggttcatatttgatggcattctcaggtgccatggcccacacaggacgcatgttgagactgaccttctgtgatgtaaacaccatcaaccactatttgtgtgacatcctcccactgctccagctctcctgcaccagcacgtatgtcaatgaactggtggtttacattgtagtgggtatcaatgtgattgtgcccactgtcaccatctttgtctcttatggcttcatcctctccagcatcctgcgcatcagctccactgaaggcagatccaaagctttcagcacctgcagttcccacataattgcagtttctctcttttttggttcaggtgcatttatgtatcttaaaccatcttctgctgggtctatggatgaagggaaaatctcttctgtcttttacaccactacggttcccttgatgaatcctttcatttacagcttaagaaacaaagacattaaacttgctttgagaagaaaccagagtaggaaaatgttttga

SEQ ID NO: 1890 - protein, 310 aa, Canis familiaris
MAPTNSSFVTEFILVGLTDLPDLQLPLFCLFLLMYMVTLLGNLGLIFLIGLNSHLHTPMYFFLFNLSFIDFCYSSVFTPKMLINFISKKNIISYKGCMTQLYFFCFFAISECYVLTSMAYDRYVAICNPLLYNVVMSPNVCFSLMLGSYLMAFSGAMAHTGRMLRLTFCDVNTINHYLCDILPLLQLSCTSTYVNELVVYIVVGINVIVPTVTIFVSYGFILSSILRISSTEGRSKAFSTCSSHIIAVSLFFGSGAFMYLKPSSAGSMDEGKISSVFYTTTVPLMNPFIYSLRNKDIKLALRRNQSRKMF

SEQ ID NO: 1891 - DNA, 933 bp, Canis familiaris
atggctcctggaaatgcttctcttgtgactgaattcattctggtggggctcacagacctaccagatctccagctccccctgttctgcttgtttctactcatgtatgtggtcactgtgctgggaaatttatgcttggtcactctaatcgggctgaatccacacctccatacccccatgtactttttcctcttcaatttgtccttcatagacctcttttattcatctgtgtttactcccaaaatgctgattcacttcacatccaagaaaaatattatctcctacagggggtgcatgacccaacttttctttttctgtttttttggtatttctgaagcttatgtgctgacatccatggcctatgatcgctatgtggccatctgtaacccacttttgtataatgttgtcatgtcccctaatgtgtgttccctccttatgcttggttcatatttgatggcattctcaggtgccatggcccacactggatgcatgctgagactgaccttttgtgatgcaaacaccatcaaccactatttgtgtgacatcctccctctgctccagctctcctgcaccagcacgtatgtgaatgagctggtggttttgattgtggagggcatcaatgtgattgtgcccactgtcaccatctttgtctcttatggcttcatcctctccagcatcctgcgcatcagctccactgaaggcaggtccaaagccttcagcacctgtactgcccacataattgcagttactctcttctttggttcaggtgcatttatgtatcttaaaccatcttctgctgggtctatggatgaggggaaaatctcctctgtcttttataccaatgtggttcccatgatgaaccctttcatttacagcttgagaaacaaagacattaaacttgctgtgagaaaaactctgagtaagagagtgttttga

SEQ ID NO: 1892 - protein, 310 aa, Canis familiaris
MAPGNASLVTEFILVGLTDLPDLQLPLFCLFLLMYVVTVLGNLCLVTLIGLNPHLHTPMYFFLFNLSFIDLFYSSVFTPKMLIHFTSKKNIISYRGCMTQLFFFCFFGISEAYVLTSMAYDRYVAICNPLLYNVVMSPNVCSLLMLGSYLMAFSGAMAHTGCMLRLTFCDANTINHYLCDILPLLQLSCTSTYVNELVVLIVEGINVIVPTVTIFVSYGFILSSILRISSTEGRSKAFSTCTAHIIAVTLFFGSGAFMYLKPSSAGSMDEGKISSVFYTNVVPMMNPFIYSLRNKDIKLAVRKTLSKRVF

SEQ ID NO: 1893 - DNA, 933 bp, Canis familiaris
atggctcctggaaatgcttctcttgtgactgaattcattctggtggggctcacagacctaccagatctccagctccccctgttctgcttgtttctactcatgtatgtggtcactgtgctgggaaatttatgcttggtcactctaatcgggctgaatccacacctccatacccccatgtactttttcctcttcaatttgtccttcatagacctcttttattcatctgtgtttactcccaaaatgctgattcacttcacatccaagaaaaatattatctcctacagggggtgcatgacccaacttttctttttctgtttttttggtatttctgaagcttatgtgctgacatccatggcctatgatcgctatgtggctatctgtaacccacttttgtataatgttgtcatgtcccctaatgtgtgttccctccttatgcttggttcatatttgatggcattctcaggagccatggcccacactggatgcatgctgagactgaccttctgtgatgcaaacaccatcaaccattacttgtgtgacatccttcctctgctccagctctcctgcaccagcacgtatgtgaatgagctggtggttttcattgtggtgggcatcaatgtgattgtgcctagtgtcaccatctttgtgtcttatggtttcatcctctctagcatcctgagcatcagctccactgagggcaggtccaaagccttcagcacctgcagttcccatgtaattgcagtttctctcttttttggttcaggtgcatttatgtatcttaaaccatcttctgctgggtctatggatgaggggaaaatctcctctgtcttttataccaatgcggttcccatgatgaaccccctcatttacagcttgagaaacaaagacattaaaattgctgtgagaaatactttgaacaggagacagttttga

SEQ ID NO: 1894 - protein, 310 aa, Canis familiaris
MAPGNASLVTEFILVGLTDLPDLQLPLFCLFLLMYVVTVLGNLCLVTLIGLNPHLHTPMYFFLFNLSFIDLFYSSVFTPKMLIHFTSKKNIISYRGCMTQLFFFCFFGISEAYVLTSMAYDRYVAICNPLLYNVVMSPNVCSLLMLGSYLMAFSGAMAHTGCMLRLTFCDANTINHYLCDILPLLQLSCTSTYVNELVVFIVVGINVIVPSVTIFVSYGFILSSILSISSTEGRSKAFSTCSSHVIAVSLFFGSGAFMYLKPSSAGSMDEGKISSVFYTNAVPMMNPLIYSLRNKDIKIAVRNTLNRRQF

SEQ ID NO: 1895 - DNA, 933 bp, Canis familiaris
atggctcctacaaactcctcttttgtgactgaattcattctggcaggcctcacagacttaccagatctccagctccccctgttctgcttgtttctactcatgtatgtggtcactgtgctgggaaatttgggcttgatcattctaatcaggctgaattcacacctccacactcccatgtactttttcctcttcaatttgtccttcatagacttctgttattcttctgtgtttacacccaaaatgctgattcacttcacatctaagaagaatattatctcctacagggggtgcatgacccagctttactttttctgtttttttgttatttctgaatgctatgtgctgacatccatggcctatgatcgctatgtggccatctgtaacccacttttgtataatgttgccatgtcccctaatgtgtgttccctccttatgcttggttcatatttgatggcattctcaggtgccatggcccacactggatgcatgctgagactgaccttttgtgatgcaaacaccatcaaccattacttgtgtgacatcctccctctgctccagctctcctgcaccagcacgtatgtgaatgagctggtggttttcattgtggtgggcgtcaacatcattgtgcccactgtcaccatctttgtgtcttatggtttcatcctctccagcatcctgcgcatcagctccactgaaggcagatccaaagctttcagcacctgcagttcccacataattgcagtttctctcttttttggttcaggtgcatttatgtatcttaaaccatcttctgctaggtctatggatgaggggaaaatctcctctgtcttttataccaatgtggttcccttgatgaaccctttcatttatagcttgagaaacaaagtcattaaacttgctctgagaaaaatccagagtaggagaatgttttga

SEQ ID NO: 1896 - protein, 310 aa, Canis familiaris
MAPTNSSFVTEFILAGLTDLPDLQLPLFCLFLLMYVVTVLGNLGLIILIRLNSHLHTPMYFFLFNLSFIDFCYSSVFTPKMLIHFTSKKNIISYRGCMTQLYFFCFFVISECYVLTSMAYDRYVAICNPLLYNVAMSPNVCSLLMLGSYLMAFSGAMAHTGCMLRLTFCDANTINHYLCDILPLLQLSCTSTYVNELVVFIVVGVNIIVPTVTIFVSYGFILSSILRISSTEGRSKAFSTCSSHIIAVSLFFGSGAFMYLKPSSARSMDEGKISSVFYTNVVPLMNPFIYSLRNKVIKLALRKIQSRRMF

SEQ ID NO: 1897 - DNA, 933 bp, Canis familiaris
atggctctcagaaatgcttcttttgtgactgaattcattctggcaggcctcacagacctaccagatctccagctcccccttttctgcttgtttctactcatgtatgtggtcactgtgttgggaaatttgggcttgatcattctcatcaggctgaattcacacctccacacccccatgtactttttcctcttcaatttgtcctgcatagacctctgttattcttctgtgtttacacccaaaatgctgattaacttcacatccaagaagaatattatttcctacagggggtgcatgacccaactttactttttttgtttttttgctatttctgaatgctatgtgctgacatccatggcctatgatcgctatgtggccatctgtaacccacttttgtataatgttgtcatgtcttctaaagtgtgtttcagtcttatgcttggttcatatttgatggcatttttaggtgccatggctcacacgggatacatggtgagactgaccttctgtaatgcaaacaccatcaaccattatttttgtgacatcctccctctattccagctctcctgcaccagcacgtatgtgaatgagctggtggttttcattgtggggagcatcgacatcattatgccctgtgtcaccatctttgtgtcttatggtttcatcctttccagcatcctgcgcatcagctccactgaaggcaggtccaaagctttcagcacttgcagttcccacataattgctgtttccttgttttttggatcatgtgcatttatgtatcttaaaccatcttctgctgggtctatggatgaggggaaaatctcttctatcttttacaccaacacagttcccttgatgaaccctttaatttacaccttgagaaacaaagatgttaagcttgccttgaggaaaatcctgagtaggagacagttttaa

SEQ ID NO: 1898 - protein, 310 aa, Canis familiaris
MALRNASFVTEFILAGLTDLPDLQLPLFCLFLLMYVVTVLGNLGLIILIRLNSHLHTPMYFFLFNLSCIDLCYSSVFTPKMLINFTSKKNIISYRGCMTQLYFFCFFAISECYVLTSMAYDRYVAICNPLLYNVVMSSKVCFSLMLGSYLMAFLGAMAHTGYMVRLTFCNANTINHYFCDILPLFQLSCTSTYVNELVVFIVGSIDIIMPCVTIFVSYGFILSSILRISSTEGRSKAFSTCSSHIIAVSLFFGSCAFMYLKPSSAGSMDEGKISSIFYTNTVPLMNPLIYTLRNKDVKLALRKILSRRQF

SEQ ID NO: 1899 - DNA, 933 bp, Canis familiaris
atgcctcctggaaatgcttcttttgtgactgaattcattctggtggggctcacagacctaccagatctccagctcccccttttctgcttgtttctactcatgtatgtggtcactgtgctgggaaatttaggcttgatcactctaattgggttgaattcacacctccacacccccatgtactttttcctcttcaatttgtccttcatagacttctgttattcttctgtgtttacacccaaaatgctgactaactttatatccaagaagaatatcatctcctacagggggtgcatgacccagctttactttttctgtttttttggcatttctgaatgctatgtgctgacatccatggcctatgatcgctatgtggccatctgtaacccacttttgtataatgttgtcatgtcctctaaagtgtgttccctccttatgcttggttcatatttgatggcattctcaggtgccatggcccacactggatgcatgctgagactgaccttctgtgatgcaaacaccatcaaccattatttttgtgacatcctccctctgctccagctctcctgcaccagcacgtatgtgaatgagttggtggttttcattgtggtgggcgtcaacatcattgtgcccactgtcaccatctttgtgtcttatggtttcatcctttccagcatcctgcgcatcagctccactgaaggcaggtccaaagctttcagcacctgcagttcccacataattgctgtttctttgttctttggatcaggtgcatttatgtatcttaaaccatcttctgttgggtctatggatgaggggaaaatctcctctgtcttttataccaatgtggttcccttgatgaacccgttcatttacagcttgagaaataaagatgttaaatgttctgtgagaaaaactctgagtaggaggcagttttga

SEQ ID NO: 1900 - protein, 310 aa, Canis familiaris
MPPGNASFVTEFILVGLTDLPDLQLPLFCLFLLMYVVTVLGNLGLITLIGLNSHLHTPMYFFLFNLSFIDFCYSSVFTPKMLTNFISKKNIISYRGCMTQLYFFCFFGISECYVLTSMAYDRYVAICNPLLYNVVMSSKVCSLLMLGSYLMAFSGAMAHTGCMLRLTFCDANTINHYFCDILPLLQLSCTSTYVNELVVFIVVGVNIIVPTVTIFVSYGFILSSILRISSTEGRSKAFSTCSSHIIAVSLFFGSGAFMYLKPSSVGSMDEGKISSVFYTNVVPLMNPFIYSLRNKDVKCSVRKTLSRRQF

SEQ ID NO: 1901 - DNA, 936 bp, Canis familiaris
atggatatgggaaacagttccttagtcactgagtttatccttgtgggtttaaccaaatattcagagattcagctgcccctgttcttccttttcctaggaatctacattgtcactgtgacaggaaacctgggcttggttgctctaattggactgaattctcaccttcacacccccatgtactatttcctctttaatttatcatttattgatctctgttattcttccgtcatcaccccaaaactgttggtaaactttgtgtcaaagctgaacaccatctcttacgcaggatgcatgacgcagctctttttctactgcttctttgttagcgcagagtgctatgtgttgacagtaatggcctatgatcgctatgtggccatttgcaagcccctgctctacacagtcaccatgtccccgcaggtctgttctctgctggctatgattgtatatgtgggggcatttattggtgcctgggcccatacaggatgcatgctgaggttgaccttctgtgatgccaacagcatcaatcactacatgtgtgacatcctccccctcctggagctctcctgcacaaacactcacctcaatgaactggtggttctcattgttgtgggctttgatgttggtgtgcccagcctcactatcattgtctcctacactttcatccttgccagcatcctccgtatccgttccatggaaggaaggtccaaagccttcagcacttgtagctcacatataattgttgtttctgttttctttgggtcaggggcattcatgtatcttcatccttcttctgttttgtccatggaccaggggaaagtgtccacggttttctataccattgtggtgcctatgctcaatcctctgatctacagcctcaggaataaggaggttaaggttgccctgaaaaaaagcttgaatagaaaaacattttcctga

SEQ ID NO: 1902 - protein, 311 aa, Canis familiaris
MDMGNSSLVTEFILVGLTKYSEIQLPLFFLFLGIYIVTVTGNLGLVALIGLNSHLHTPMYYFLFNLSFIDLCYSSVITPKLLVNFVSKLNTISYAGCMTQLFFYCFFVSAECYVLTVMAYDRYVAICKPLLYTVTMSPQVCSLLAMIVYVGAFIGAWAHTGCMLRLTFCDANSINHYMCDILPLLELSCTNTHLNELVVLIVVGFDVGVPSLTIIVSYTFILASILRIRSMEGRSKAFSTCSSHIIVVSVFFGSGAFMYLHPSSVLSMDQGKVSTVFYTIVVPMLNPLIYSLRNKEVKVALKKSLNRKTFS

SEQ ID NO: 1903 - DNA, 801 bp, Canis familiaris
ctccccctcctatttctagagatctatctggtggctgtagttctcaggctgaatttgattatattaatttcactaaatacatactttcatacattcatatgatatttactctttagtctctctgacatcgatgtctatcactcttctgtctttgccctcaaaatactcacgaacattgtatagaggaaaacctcctatccagggtggctgacgcacctttatttcttttgtttctttgtcatttccaaatgttatgtatcaacagcatagcatataatcactatgttgtcatttgcaagccactattgtatggtgttatattgtcctttcagacctgttctctgttggagtttggagcatatgtgatgggatgtctgggtttcctagcccacactctctatggtgagactgcccttctgtgatgccagtatcgtcaaccacgatcttgacatactctctgtgctcagtcagctttcctgcaccaggaccgacaatgagattatggtctttgtcctaatagacatgaacattttggtgcccatcagcactgcttttatctcctatgcttttatcatcaccagcaccttccacatcagctctacagaggtcagggctaaagctttcattcagaacctgtaattcccattaatggctgtttcatttttctttgggcagtaggattcatgtgcctccaaccttctaatgtagtgtctatgaatcaggaaagtggcattagtctttgatataaattttgggttcacatcgaactcatatatctacagcttgaattcattcattctt

SEQ ID NO: 1904 - protein, 37 aa, Canis familiaris
PPPISRDLSGGCSSQAEFDYINFTKYILSYIHMIFTL

SEQ ID NO: 1905 - DNA, 930 bp, Canis familiaris
atggcagctaagaactcttctgtgacagagtttatcctcacaggcttaacagaccagccgggactccagatccctctcttcttgctgtttctaggtttctacatggtcactctgctggggaacctgggcctaataaccctgattgggttgaattctcgcctacacacccccatgtactttttcctcttcaatctgtccttagtagatttctgttactccactaccatcacccccaaaatgctgaagagctttgtctcgaagaacatcatcttgtatgcagagtgtatgactcaactctttttcttctgcttcttcgtcatttctgagtccttcctcctgtcagcaatggcatatgaccgctatgttgccatctgcaaaccattggtgtacaccctcaccatgtctcctcaggtctgtttattccttttgttgggtgtctatgtgatggggttttcaggggccatggtccacatgggaagcatagcaagtctgactttctgtgctgacaatcttgttaatcattttatgtgtgacatctttcctctccttgagctctcctgcaacagcacctatgtgcatgagctggtggtctttgtacgtgtggccatggacattggaatacccattgtcaccatcttcatctcttatgctctgattctctccagcattctccatattcactccactgagggcaggtccaaagctttcagtacgtgcagctctcacataattgtggtttctcttttctttggttctggggcttttgtgtatctcaaaccaccttctattttgccccttaaccaagggaaagtgttctctttgttctacaccattgtggtgcccatgttaaacccgctgatctacagtttgaggaacaaggatgtcaaagttaccttgagaaaaaccttggaaaggaaaatattttcttga

SEQ ID NO: 1906 - protein, 309 aa, Canis familiaris
MAAKNSSVTEFILTGLTDQPGLQIPLFLLFLGFYMVTLLGNLGLITLIGLNSRLHTPMYFFLFNLSLVDFCYSTTITPKMLKSFVSKNIILYAECMTQLFFFCFFVISESFLLSAMAYDRYVAICKPLVYTLTMSPQVCLFLLLGVYVMGFSGAMVHMGSIASLTFCADNLVNHFMCDIFPLLELSCNSTYVHELVVFVRVAMDIGIPIVTIFISYALILSSILHIHSTEGRSKAFSTCSSHIIVVSLFFGSGAFVYLKPPSILPLNQGKVFSLFYTIVVPMLNPLIYSLRNKDVKVTLRKTLERKIFS

SEQ ID NO: 1907 - DNA, 927 bp, Canis familiaris
atggctacttccaatcattcctttgtgactgaatttatccttgaggggttaacaaaatgcccagagcttcaatttccacttttcctactattccttggagtgtatgtggtcacagtggtggggaacctgggcatgatcctcttaattgctatcagttctcaacttcactctccaatgtattattttcttggtcatttgtcattcattgatctctgttactcctctgtcattacgccaaaaatgctggtgaactttgtgtcagagaagaacattatctcctttctggcgtgcatgactcagctttacttcttccttatttttgtaattgcagaaggctaccttctgaccgccatggcgtatgaccgttatgtagccatctgtagcccactgctttacaatgttatcatgtcccatagggtctgctccataattatggctgtggtatattcactgggtttgtttggggctactgtccatactacccacatgtcagtgttgtccttctgtgggtctcatgttgtcagtcattatttttgtgatattctccccttattgactctctcttgttccagcacccacatcaatgagacattgttgtttattattggaggagttaataccttagcacctacactggctgtattcatctcttatgctttcattctttccagcatcctccgtattcgctctgctgagggacggtccaaagcctttggcacttgtagctcccatatcatggctgtggggatcttttttgggtctatcacattcatgtatttcaagcccccttctagcaatactatggaagaggagaaggtgtcctcagtgttctacaccactgtgatccccatgctgaatcccatgatctacagcctgaggaataaagatgtgaagaatgcactgagaaaggtggttgggggaaggtag

SEQ ID NO: 1908 - protein, 308 aa, Canis familiaris
MATSNHSFVTEFILEGLTKCPELQFPLFLLFLGVYVVTVVGNLGMILLIAISSQLHSPMYYFLGHLSFIDLCYSSVITPKMLVNFVSEKNIISFLACMTQLYFFLIFVIAEGYLLTAMAYDRYVAICSPLLYNVIMSHRVCSIIMAVVYSLGLFGATVHTTHMSVLSFCGSHVVSHYFCDILPLLTLSCSSTHINETLLFIIGGVNTLAPTLAVFISYAFILSSILRIRSAEGRSKAFGTCSSHIMAVGIFFGSITFMYFKPPSSNTMEEEKVSSVFYTTVIPMLNPMIYSLRNKDVKNALRKVVGGR

SEQ ID NO: 1909 - DNA, 939 bp, Canis familiaris
atggttgcaggaaatcattctacagcatccgagtttgtgttagtgggtctaacacagcagccagagctccagcagcctctcttcctcctgttcctgggaatctatatcctgacggtggtggggaacttgggcttgattctcctgattaccctgagcccttcccttcacacccccatgtactacttcctcagcagcttatcattcatcgatctctgctattcctctgtcattacccccaaaatgctggtgaacttcttagggaggaaaaatatgatcctttattctgagtgcatgacacagctctttttcttcgtggtctttgtagtggctgagggttacctcctgaccatgatggcatacgatcgctacgttgccatctgtagccccctactttacagtgtggtcatgtccccccgagtgtgctcactgctggtgctggttgccttcagcctgggctttctctccgccgtggcccatacaagtgccatgatgcaactgtctttctgcagatcccacatcatcaaccattacttctgtgatgttcttcatatgctcaatctctcctgctccgatacacacctcaatgagcttctgcttttttatcatgcgggacttaacacttttttatcatgcgggacttaacacttggtaccactctgggcagtctgcatttcctatgccttcatcttctacagcatcgttcgaatccgatcttcagagggacggtccaaagcctttggtacttgcagctctcatctcatggctgtggggatcttctttgggtctatcacattcatgtatttcaagcccccttccagtaattccctggaacaagagaaggtgtcctcagtgttctacaccacagtgatccccatgctgaaccctttaatatacagtctgagaaacaaggatgtcaagaaagcattgaggaaggttttg

SEQ ID NO: 1910 - protein, 213 aa, Canis familiaris
MVAGNHSTASEFVLVGLTQQPELQQPLFLLFLGIYILTVVGNLGLILLITLSPSLHTPMYYFLSSLSFIDLCYSSVITPKMLVNFLGRKNMILYSECMTQLFFFVVFVVAEGYLLTMMAYDRYVAICSPLLYSVVMSPRVCSLLVLVAFSLGFLSAVAHTSAMMQLSFCRSHIINHYFCDVLHMLNLSCSDTHLNELLLFYHAGLNTFLSCGT

SEQ ID NO: 1911 - DNA, 942 bp, Canis familiaris
atggatacagaaaatcattcttcagttactgagtttatccttgaggggttaacagaccagcctggactccagctccctctctttgtcctgtttctacttatctatatggtctgcatcatgggaaatatgggcttgatctttttaatcagaatcagttctcagtttcatatgcccatgtattattttctcagtaatctgtccttcatagatctctgctactccactgtcataattcccaagctgttggtgaactttgtttcagaaaagaatctcacctcctttcctgagtgcatggctcaactctttttcttctgcttctttggtattgatgactcctacatgctgacagcaatggcatatgatcgttatgttgctatctgtaaccccttgctctataatgtcaccatgtccaacagaatctgttttctactggtcaccagtgtgtatacagtgggcgccattggagccttagtccacaccagctacatatctagtcgatccttctgtggaactaatatcatccaccattacttctgtgacatccttcctcttctgaatatatcttgttcaagagactccaccaaggaactcttggtaatgattttggttggattcaatgtatttgcatgtgctttagccatctttatctcttatgccttcattctttccagcatcttatgcatccactcagctgaaggcaggtccaaagctttcagtacctgcagttcccaccttgcagctgttggggtcttctatggctccatcatcttcatgtattttaaaccatcttccagcaacataatacaggagaaggtggcttctgtgttttataccacagtgattcccatgcttaacccccttatctatagccttaggaacaaggatgtcaaggaatcccttaaaaaagtcctaaataatgggttactttctcagtctgcatag

SEQ ID NO: 1912 - protein, 313 aa, Canis familiaris
MDTENHSSVTEFILEGLTDQPGLQLPLFVLFLLIYMVCIMGNMGLIFLIRISSQFHMPMYYFLSNLSFIDLCYSTVIIPKLLVNFVSEKNLTSFPECMAQLFFFCFFGIDDSYMLTAMAYDRYVAICNPLLYNVTMSNRICFLLVTSVYTVGAIGALVHTSYISSRSFCGTNIIHHYFCDILPLLNISCSRDSTKELLVMILVGFNVFACALAIFISYAFILSSILCIHSAEGRSKAFSTCSSHLAAVGVFYGSIIFMYFKPSSSNIIQEKVASVFYTTVIPMLNPLIYSLRNKDVKESLKKVLNNGLLSQSA

SEQ ID NO: 1913 - DNA, 933 bp, Canis familiaris
atgaggaatgcctcagtggtgaccaagtttatcctgctgggcatcccacacaccgagggtctggagaccacgctctttgtcctgtttttgagcttctatatcttcactcttatggggaacctgctcatcctactggcgattatctcctccactcggcttcacactcctatgtacttcttcctgtgtcaactgtctgtgtgtgacatatttttcccttctgtgagttcccccaagatgctcttctacctctcagggaacagccgggtcatctcctatgcaggctgcgtgtcccagctcttcttctaccatttcctgggctgtaccgagtgcttcctgtacacagtgatggcctatgaccgctttgtcgccatatgttaccctctacgctacacggtgatcatgagccacagagtgtgtgccatcctggccatggggacctccttttttggctgcattcaggccacctttctaaccactctcaccttccagttgccctactgtggcgccaatgaggtggactatttcttctgtgatatcccggtgatgctgaagctggcttgtgctgatacctcagccctggagatggtgggcttcatcagcgtgggcctcatgcccctcagttgcttccttctcatcctcacctcctacagctgcattgtgtgttccatcctacagatccggtctcctgaaggcagacgccgtgccttttccacctgcagtgcccacctcactgccatcctcctctcctttatgccagtggtcctcatctacctgcagcccacccccaatccctggctcaatgcaactgttcaggtcctgaataacctggtcactcctatgctgaatccgttgatctacagcctaagaaataaagaagtaaaatattctctgaggaaggtgctacagcaagtagccttctttcctgagaagtga

SEQ ID NO: 1914 - protein, 310 aa, Canis familiaris
MRNASVVTKFILLGIPHTEGLETTLFVLFLSFYIFTLMGNLLILLAIISSTRLHTPMYFFLCQLSVCDIFFPSVSSPKMLFYLSGNSRVISYAGCVSQLFFYHFLGCTECFLYTVMAYDRFVAICYPLRYTVIMSHRVCAILAMGTSFFGCIQATFLTTLTFQLPYCGANEVDYFFCDIPVMLKLACADTSALEMVGFISVGLMPLSCFLLILTSYSCIVCSILQIRSPEGRRRAFSTCSAHLTAILLSFMPVVLIYLQPTPNPWLNATVQVLNNLVTPMLNPLIYSLRNKEVKYSLRKVLQQVAFFPEK

SEQ ID NO: 1915 - DNA, 936 bp, Canis familiaris
atggtagcgggaaatcactccacagtgactgaattcatcctcgctgggctaacacaacaaccggaactccagctgccccttttcttcctcttcctaggaatctatgtggtcacggtggtggggaacctgggcatgatcatgctgatagggctcagtgctcacctgcacacgcccatgtattacttcctcagtagcttgtccttcattgacctctgccattccactgtcattacccccaaaatgctggagaactttgtgacagagatgaatgtcatctcctaccctgaatgcatgactcagctctatttcttccttgtttttgctattgcagagtgttacatgttagcagtaatggcctatgaccgctatgttgccatctgtagccccttgctttacaatgtcatcatggcccatcaggcttgtttctccctgatttcaggagtgtatattatagccctggtttgtgcatttgttcatacaggttgcatgtttagggttcatttctgcaaatttgatgtgatcaatcattatttctgtgatcttctttccttgttaaaactctcctgttctaatacccatgtcaatgagttagtgattctaatctttagtacagttaatatccttgcccccagcctgacgatccttgcctcctatgtcttcatcctctccagcatcctccacatccgctccactgagggcaggtccaaagccttcagcacctgcagttctcacatctcagctgttgctgtcttctttggatctgctgcattcatgtacctgcagccgtcatctgtgagctccatggaccaagggaaagtatcctctgtgttttataccatcattgtgcccatgctgaaccccctgatctacagcctgaggaataaggatgtcaatgctgccctgaagaaaatcttagagagaagaatattcttgtga

SEQ ID NO: 1916 - protein, 311 aa, Canis familiaris
MVAGNHSTVTEFILAGLTQQPELQLPLFFLFLGIYVVTVVGNLGMIMLIGLSAHLHTPMYYFLSSLSFIDLCHSTVITPKMLENFVTEMNVISYPECMTQLYFFLVFAIAECYMLAVMAYDRYVAICSPLLYNVIMAHQACFSLISGVYIIALVCAFVHTGCMFRVHFCKFDVINHYFCDLLSLLKLSCSNTHVNELVILIFSTVNILAPSLTILASYVFILSSILHIRSTEGRSKAFSTCSSHISAVAVFFGSAAFMYLQPSSVSSMDQGKVSSVFYTIIVPMLNPLIYSLRNKDVNAALKKILERRIFL

SEQ ID NO: 1917 - DNA, 936 bp, Canis familiaris
atggaccctggaaatcattccatagtgactgagttcatcctcgctgggctaacagagaaaccagaactccaactgccccttttcttcctcttcctaggaatctatgtggtcacagtggtggggaacctgggcatgatcatgctgatagggctcagtgctcacttgcacacccccatgtactacttcctcagcaatttgtccttcattgatctctgccattccactgtcgttacccccaaaatgctggtgaactttgtgacacagaagaacatcactccctactctgaatgcatgactcagctctatttcttcctgatttttgccattgcagagtgtcacatgttggctgcaatggcttatgaccgctatgctgccatctgtaaccctttgctttacaatgtcatcatgtcttctcagatctgcttctggatgacagtgggagtttatattttgggcatcgttggatctacaatccacacgggctttatgatgagactccttttctgcaagagcaatgtggttaatcattatttctgtgatctcttcccagtcttggaattatcctgttccagcacctacattaatgaattactggttctagtcttgagtgcatttaacattttgactcctgccttaactatccttgcctcctacatcttcatcctctccagcatcctccacatccgctccactgagggcaggtccaaagccttcagcacctgcagttctcacatctcagctgttactgtcttttttggatctgctgcattcatgtacctgcagccgtcatctgtgagctccatggaccaagggaaagtgtcctctgtgttttataccatcattgtgcccatgttgaaccctttgatctatagcctgaggaataaggatgtcaaatttgccctgaagaaaattctggttggtagaaaatgttcataa

SEQ ID NO: 1918 - protein, 311 aa, Canis familiaris
MDPGNHSIVTEFILAGLTEKPELQLPLFFLFLGIYVVTVVGNLGMIMLIGLSAHLHTPMYYFLSNLSFIDLCHSTVVTPKMLVNFVTQKNITPYSECMTQLYFFLIFAIAECHMLAAMAYDRYAAICNPLLYNVIMSSQICFWMTVGVYILGIVGSTIHTGFMMRLLFCKSNVVNHYFCDLFPVLELSCSSTYINELLVLVLSAFNILTPALTILASYIFILSSILHIRSTEGRSKAFSTCSSHISAVTVFFGSAAFMYLQPSSVSSMDQGKVSSVFYTIIVPMLNPLIYSLRNKDVKFALKKILVGRKCS

SEQ ID NO: 1919 - DNA, 960 bp, Canis familiaris
atgggagcagaaaatcactccacagtgactgatttcatccttgctgggctaacagagaaaccagaactccaactgccccttttcttcctcttcctaggaatctatgcagtcacagtggtggggaacctgggcatgatcatgctgatagggatcagtgctcacctgcacacacccatgtattacttcctcagtagcttgtccttcattgatctctgccattccactgttgttactcccaaaatgctgatgaactttgtgacagagaggaattttatctcctatgaaggctgcatgactcagctttacttcttccttgtttttgttatatcagaatgtcacatgttggctgcaatggcctatgatcgctacgttgccatctgtaacccattgctttacaatgtcaccatgtcttatcaggtctgttcctggctggtaggtggggtgtatatcatgggcttgactggtgccacagctcacacaggctgcatgctaagagtgcttttctgcaaggctgatagaatcaaccattacttctgtgatctcttcccactattggagctctcctgctccagtacttatatcaacgaggtggtagttttgtgcttcagtgcagttaatatccttgtccccagcctgacgatccttgcctcctacatcttcatcctctctagcatcctccgcatccgctccactgagggcaggtccaaagccttcagcacctgcagctctcacatctcagctgttgttgtcttctttggatctgctgcattcatgtacctgcagccatcatctgtgagctccatggaccaagggaaagtgtcctctgtgttttataccatcattgtgcccatgctgaaccccctgatctacagcctgaggaataaagatgtcagagtcgccctaaagaagatccttgaaaaaagaaggaaaacggtattttgcctgagcaaaaatttttaa

SEQ ID NO: 1920 - protein, 319 aa, Canis familiaris
MGAENHSTVTDFILAGLTEKPELQLPLFFLFLGIYAVTVVGNLGMIMLIGISAHLHTPMYYFLSSLSFIDLCHSTVVTPKMLMNFVTERNFISYEGCMTQLYFFLVFVISECHMLAAMAYDRYVAICNPLLYNVTMSYQVCSWLVGGVYIMGLTGATAHTGCMLRVLFCKADRINHYFCDLFPLLELSCSSTYINEVVVLCFSAVNILVPSLTILASYIFILSSILRIRSTEGRSKAFSTCSSHISAVVVFFGSAAFMYLQPSSVSSMDQGKVSSVFYTIIVPMLNPLIYSLRNKDVRVALKKILEKRRKTVFCLSKNF

SEQ ID NO: 1921 - DNA, 942 bp, Canis familiaris
atggagaagaagaactgctcggtggtgactgaattcatcctgctggggattccacacacaaaggggctggagactatgctttttgtcttgttcttacccttctatgcctgcaccctgctaggaaatgtgtccatcctcatggctattctttcttccactcgccttcacacacccatgtatttttttctggggaacttgtctgtgtttgacatgagtttctcttctgtgacctgtcctaaaatgctgttgtacctcatgggactgagcccactcatttcctataagagttgtgtctcccagctcttcttcttccatttccttggcagcattgaatgcttcttgtataccgtgatggcctatgaccgcttcactgctatctgttaccctctgcggtacacagtcatcatgagtcctagaatctgtggggccctggctgcaggcacatggctgttagggtgtatccattccagtatcttgactttcctcaccttcactttgccatactgtggtcccaatgaagtggatcacttcttttgtgacattccggcacttttgccactggcctgtgctgatacatccttagcccagagggtgagtttcaccaacgttggcctggtgtctctcctctgctttctcctaatcattttatcctacactcgaatcaccatctccatcttgcatattcattcaaccgaaggccgccgccgggccttctccacttgtagtgcccacctcattgccatcctttgtgcctatggacccatcatcaccgtctacttgcagcccacgcctaaccccatgctgggaactgtggtgcaaattctgatgaacctcgtaggaccaatgctgaatcctttgatctataccttgaggaataaggaagtgaaaacagccctaaaaataattttgcacaggacaagccacattcctgagagccagtaa

SEQ ID NO: 1922 - protein, 313 aa, Canis familiaris
MEKKNCSVVTEFILLGIPHTKGLETMLFVLFLPFYACTLLGNVSILMAILSSTRLHTPMYFFLGNLSVFDMSFSSVTCPKMLLYLMGLSPLISYKSCVSQLFFFHFLGSIECFLYTVMAYDRFTAICYPLRYTVIMSPRICGALAAGTWLLGCIHSSILTFLTFTLPYCGPNEVDHFFCDIPALLPLACADTSLAQRVSFTNVGLVSLLCFLLIILSYTRITISILHIHSTEGRRRAFSTCSAHLIAILCAYGPIITVYLQPTPNPMLGTVVQILMNLVGPMLNPLIYTLRNKEVKTALKIILHRTSHIPESQ

SEQ ID NO: 1923 - DNA, 936 bp, Canis familiaris
atggaagtgaggaatcacactttggttacagagttcatcctgctgggcatcccacacacagaagggcaagaaaccatgctctttgttgtgttctctgtcttctacctctgcaccctactaggaaatctgctcatccttgtggctgtgatgtctgactcccacctccacactcctatgtatttctttctttgtaacctctctgtgctagatattggcttctcttctgtgagcacgccgaagatgttggccaacctgctggtgaggaaccgagtcatctccctggggggctgcatgtctcaggtctttttttaccacttcctcggcagcactgagtgtctgctctacacggtgatggcgtatgaccggtttgctgccatctgccacccactgcgttataccaccatcatgaaccgccgggtgtgtgccttgctggctgctggaacctggtttactagctcttttcatgccacaatcctcaccactctgaccttccaactgccctactgtgggtctaatgaggtagactatttcttttgtgacatctttcctgtagtcaaattggcgtgtggtaataccctcatcattgagacagtgagcttcaccaacatcggccttgtgcccatgatgtgttttctgctcatccttgcctcttacatccgcattgtcattgcaatcctaaagatgcactctgctgaggggaggcgcaaggcagcgtctacctgtgtctcccacctctcggtggtcacactgttctttgggccctgtgccctcatctatacccagccatctttgagcgaggtactcgtaaccccagtgcaaatctttggcaatgtagtcacccccatgctgaaccccacaatctacactctgagaaacaaagatgtcaaaggagccttgaaaaaactggctacgggccagatagtttcaggtcactag

SEQ ID NO: 1924 - protein, 311 aa, Canis familiaris
MEVRNHTLVTEFILLGIPHTEGQETMLFVVFSVFYLCTLLGNLLILVAVMSDSHLHTPMYFFLCNLSVLDIGFSSVSTPKMLANLLVRNRVISLGGCMSQVFFYHFLGSTECLLYTVMAYDRFAAICHPLRYTTIMNRRVCALLAAGTWFTSSFHATILTTLTFQLPYCGSNEVDYFFCDIFPVVKLACGNTLIIETVSFTNIGLVPMMCFLLILASYIRIVIAILKMHSAEGRRKAASTCVSHLSVVTLFFGPCALIYTQPSLSEVLVTPVQIFGNVVTPMLNPTIYTLRNKDVKGALKKLATGQIVSGH

SEQ ID NO: 1925 - DNA, 936 bp, Canis familiaris
atgaggaatctatcagtagtgactgaatttatcctgctgggcatcccacacaccgagggtctggagaccacgctctttgtcctgtttttgagcttctatatcttcactcttatggggaacctgctcatcctactggcgattatctcctccactcggcttcacactcctatgtacttcttcctgtgtcaactgtctgtgtgcgacatatttttcccttctgtgagttcccccaagatgctcttctacctctcagggaacagccgggtcatctcctatgcaggctgcgtgtcccagctcttcttctaccatttcctgggctgtaccgagtgcttcctgtacacagtgatggcctatgaccgctttgtcgccatatgttaccctctacgctacacggtgatcatgagccacagagtgtgtgccatcctggccatggggacctccttttttggctgcattcaggccacctttctaaccactctcaccttccagttgccctactgtggcgccaatgaggtggactatttcttctgtgatatcccggtgatgctgaagctggcttgtgctgatacctcagccctggagatggtgggcttcatcagcgtgggcctcatgcccctcagttgcttccttctcatcctcacctcctacagtcgcattgtttactccatcctgcagatccgctctgcagagggccgacgccgtgccttctccacctgcagtgcccacctcactgccatcttacttttctacatgccagtggtcctcatctacctgaggccaaccccaagcccctggctggatgcaactgttcaggtcctgaataacctggtcacccctatgctgaaccccttgatctacagcctcaggaataaggaagtaaagtcatctctgaggaaggtgctatatcacttgggcttccttcctgagcagttgtag

SEQ ID NO: 1926 - protein, 311 aa, Canis familiaris
MRNLSVVTEFILLGIPHTEGLETTLFVLFLSFYIFTLMGNLLILLAIISSTRLHTPMYFFLCQLSVCDIFFPSVSSPKMLFYLSGNSRVISYAGCVSQLFFYHFLGCTECFLYTVMAYDRFVAICYPLRYTVIMSHRVCAILAMGTSFFGCIQATFLTTLTFQLPYCGANEVDYFFCDIPVMLKLACADTSALEMVGFISVGLMPLSCFLLILTSYSRIVYSILQIRSAEGRRRAFSTCSAHLTAILLFYMPVVLIYLRPTPSPWLDATVQVLNNLVTPMLNPLIYSLRNKEVKSSLRKVLYHLGFLPEQL

SEQ ID NO: 1927 - DNA, 864 bp, Canis familiaris
atgcccctcttcttcctgttcctaggtttttatgtggtcaccgtggtggggaacctgggcctcataaccctgattgggctgaattctcaccttcatattcccatgtacttcttcctcctcaacttgtccttcatagattttagtttctctactgccatcatccccaaaatgctaatgagttttgtctccaagaaaaacatcatttcctatgtggggtgtatgactcagctctttttcttttgtttttttgtcttttctgaatcctatatcttgtcagcaatggcatatgaccgctatgtcgccatctgtaaaccactgctgtacatggtcaccatgtctcctcaggtgtgtttactccttttgttgggtgtttatgggatgggggtgtttggggctgtggcccatacaggaaatatattatttctgaccttttgtgctgacaaccttgtcaatcactatatgtgtgatatcattcccctccttgagctctcctgcaacagctcttacataaatttgctggtggtcttcattgttgtgaccattggcattggggtgcctattgctgccattttcatctcttatggtttcattatttccaacattttccatattagctccactgaaggaaggtccaaagcctttagtacctgcagctctcacataattgctgtttctctcttctttggatcaggagcttttatgtacctcaaaccaccttctattttaccccttgaccaggggaaaatgtcttccttgttctacaccattcttgtgccaatgttcaacccattaatctatagtctaaggaataaggatgtcaaatttgccctgaggaaaaccttgggcagaataaccttctcttga

SEQ ID NO: 1928 - protein, 287 aa, Canis familiaris
MPLFFLFLGFYVVTVVGNLGLITLIGLNSHLHIPMYFFLLNLSFIDFSFSTAIIPKMLMSFVSKKNIISYVGCMTQLFFFCFFVFSESYILSAMAYDRYVAICKPLLYMVTMSPQVCLLLLLGVYGMGVFGAVAHTGNILFLTFCADNLVNHYMCDIIPLLELSCNSSYINLLVVFIVVTIGIGVPIAAIFISYGFIISNIFHISSTEGRSKAFSTCSSHIIAVSLFFGSGAFMYLKPPSILPLDQGKMSSLFYTILVPMFNPLIYSLRNKDVKFALRKTLGRITFS

SEQ ID NO: 1929 - DNA, 933 bp, Canis familiaris
atgaggaatcacacagagctccgtgagtttattctactgggaatacctcagacagcgggaatggagactgtgctatttgtcatcttctcacttatttacctcttcaccttgctgggcaatttactcatccttacagcagttgtttcttcctctacccttcacacccctatgtacttcttcctgggactcctatctatttttgacatgttgtttccatctgtaacctgtcccaagatgctgttctatctctctggccaaagtcacgccatttcttacgagggctgtgttgcacagctctttttctaccatttcctggggtctactgaagggtgcctctattctgcaatggcatatgaccgctttgtggctatctgccaccccctgaggtatatgctcatcatgagacctggggtctgtgttggcttggtcatggcagcctgcttggtgggttgtcttcacgccaccatcctgacctccttcacctttcagttaacatactctggctccaacctggtggactactttttctgtgacattcctgctgtcttacccctggcctgtgctgacagctccctggcccagagagtgggctccactaatgttgggtttctggctttaatgctctggttcagtgtttgtgtctcctacacgcgcattgggattgccattctgagaatccgctcggcagagggcaggcagaaagctttctccacctgcagtgcccacctcactgcaatcctctgtgcctatggtcctgtgatcatcatctatctgcagcccacacccaaccccttgcttggggctatggtacagatattaaataatattgtgtcacccatgctgaactcattaatctattccttaagaaacaaagaagtgaaaagttccctaaaaagagtgttccgccatctagtatttatttctctggaataa

SEQ ID NO: 1930 - protein, 310 aa, Canis familiaris
MRNHTELREFILLGIPQTAGMETVLFVIFSLIYLFTLLGNLLILTAVVSSSTLHTPMYFFLGLLSIFDMLFPSVTCPKMLFYLSGQSHAISYEGCVAQLFFYHFLGSTEGCLYSAMAYDRFVAICHPLRYMLIMRPGVCVGLVMAACLVGCLHATILTSFTFQLTYSGSNLVDYFFCDIPAVLPLACADSSLAQRVGSTNVGFLALMLWFSVCVSYTRIGIAILRIRSAEGRQKAFSTCSAHLTAILCAYGPVIIIYLQPTPNPLLGAMVQILNNIVSPMLNSLIYSLRNKEVKSSLKRVFRHLVFISLE

SEQ ID NO: 1931 - DNA, 936 bp, Canis familiaris
atgagaaatcacacattggtgacagaattcatcctgttgggaatccctgagacagagggcctagagactgtcctctttttcctgttctcctcgttatacttatgcactctgttgggaaatgtgctcatccttacagctatcgtctcttcctctcggctgcacactcctatgtattttttcttgggaaatctttccatgttcgacctgggtttctcttcaacaactgttcccaagatgctgttatacctttcagggcagagtcaaggtatctcttttcagggctgcatgtcccagctcttcttctatcatttcctgggctgcactgagtgtttcttgtacacagtgatggcctatgaccgctttgttgccatatgttatcctttgagatacatggtcatcatgaaccacagggtctgctccatcttggccacagggacctggatgggtggttgtgttcacgccattattctaacctccctcactttccagttgacctactgtgcctctaatgaggtggactactacttctgtgacatacctgcagtcctacctctagcctgtggtgatacatctctagcccagagggtaggtttcacaaatgttggtcttctgtctctcatttgcttttttctcatccttgtttcctacactcacattgggatctccatatcaaaaatccgttcggcagaaggcaggcagagagccttctccacttgcagtgcccacatcactgcaattctttgtgcttatggaccagtaatcatcatctatctccagcccaatcccagtgccttgctcggtgcaataattcagatattgaataatcttgtaacccctatgctgaacccactcatctacagcctgaggaataaggatgtaaaatcagccctgaggaatgtatttcataagagaggctttgctgtggagaataagtga

SEQ ID NO: 1932 - protein, 311 aa, Canis familiaris
MRNHTLVTEFILLGIPETEGLETVLFFLFSSLYLCTLLGNVLILTAIVSSSRLHTPMYFFLGNLSMFDLGFSSTTVPKMLLYLSGQSQGISFQGCMSQLFFYHFLGCTECFLYTVMAYDRFVAICYPLRYMVIMNHRVCSILATGTWMGGCVHAIILTSLTFQLTYCASNEVDYYFCDIPAVLPLACGDTSLAQRVGFTNVGLLSLICFFLILVSYTHIGISISKIRSAEGRQRAFSTCSAHITAILCAYGPVIIIYLQPNPSALLGAIIQILNNLVTPMLNPLIYSLRNKDVKSALRNVFHKRGFAVENK

SEQ ID NO: 1933 - DNA, 933 bp, Canis familiaris
atgaagaatcacactcctgtaaccgagttcctcctgatgggaatcccttacacaaaagggctggaaaacatgctcttcgtcttatttctggccttctactttctcactcttctggggaacctgctcattcttctggccatcctcacttcctccaacctgcacacccccatgtatttcttcctgggaaacctgtctgtgttcgatatatttttcccttcagtgagctcccccaaaatgatgctctccctagtggggcaaagccggaccatctcttacccgggctgtgcctgtcagctcttcttttaccacttcctgggctgcactgagtgtttcctgtacaccgtgatggcctatgaccgctttgcggccatctgtcaccctctgcagtacacagtcatcatgaatcgcagagtgtgcaccatcatgacgctaggcacctgggtggggagctgtctgcatgcagctgtactcacattcctcatctttcacttacccttctgcggccccaatgaggtggacaatttcttctgtgatatcccagtggtgttacccctggcctgtgcagacacctctctagctcagacagtgagttttaccaatgtaggtattgttgcactcatctgttttcttcttatcctcacttcttatattcgcattgttgtctctgtattgaaaattagctcctcagaaggccggcgaagagctttttcaacctgcagtgcccacctgacttccatcctgctcttctatggaccggtggtcctcatttatctccggcctgcctccagcccctggttggattctgtggttcaggtgttgaataatattgtcaccccttccctgaatcctttgatatacaccttgagaaacaaggatgtgaagttggctctgaggaaagcactgatccaaggagtacatacttgtggggtgtaa

SEQ ID NO: 1934 - protein, 310 aa, Canis familiaris
MKNHTPVTEFLLMGIPYTKGLENMLFVLFLAFYFLTLLGNLLILLAILTSSNLHTPMYFFLGNLSVFDIFFPSVSSPKMMLSLVGQSRTISYPGCACQLFFYHFLGCTECFLYTVMAYDRFAAICHPLQYTVIMNRRVCTIMTLGTWVGSCLHAAVLTFLIFHLPFCGPNEVDNFFCDIPVVLPLACADTSLAQTVSFTNVGIVALICFLLILTSYIRIVVSVLKISSSEGRRRAFSTCSAHLTSILLFYGPVVLIYLRPASSPWLDSVVQVLNNIVTPSLNPLIYTLRNKDVKLALRKALIQGVHTCGV

SEQ ID NO: 1935 - DNA, 933 bp, Canis familiaris
atgcagaactacacttctgtgatggagttcatcctattgggaattcccaataccgaagggctggagaacatgctgtttgtcttatttttggccttctatctcttcaccttgttgggaaacctgctcattttcctcaccattctggtctcctccaacctgcacacccccatgtatttcttcttgggaaacctgtctgtctttgatatatttttcccttctgtgagctcccccaaaatgatgctctacctaatggggcaaagccggaccatctcataccagggctgtgcctgccaactcttcttttaccacttcctgggtggcactgagtgtttcctgtacaccgtgatggcctacgaccgatttgtggctatttgtcaccctttgcgatacacagtcatcatgaaccgcagggtgtgcactggcttgacattgggcacttggctgggcggctgtctccatggaagtatcctcacctttctggtctttaagttaccctactgtggctccaatgaggtggacaatttcttctgtgatatcccagtggtgttacccctggcctgtgcagacacctctctagctcagacagtgagttttactaacgtggatgttgtgacgcttacatgctttttccttatccttacttcctatggtcacatcgtcctttctatattgaaaatcagcactgcggaaggcaggcgccgagctttttcaacctgcagtgcccacctgatgtcaatcttcttgttctatgggccggtgatgctcatctatctcaggcctgcttccagcccctggctagattctgttattcaagtgttgaataatattgtcactccttctctcaaccctttgatttacaccttaagaaacaaggatgtgaaattggctttgaggaaagtattcactcaaatggtccacatttctggggtataa

SEQ ID NO: 1936 - protein, 310 aa, Canis familiaris
MQNYTSVMEFILLGIPNTEGLENMLFVLFLAFYLFTLLGNLLIFLTILVSSNLHTPMYFFLGNLSVFDIFFPSVSSPKMMLYLMGQSRTISYQGCACQLFFYHFLGGTECFLYTVMAYDRFVAICHPLRYTVIMNRRVCTGLTLGTWLGGCLHGSILTFLVFKLPYCGSNEVDNFFCDIPVVLPLACADTSLAQTVSFTNVDVVTLTCFFLILTSYGHIVLSILKISTAEGRRRAFSTCSAHLMSIFLFYGPVMLIYLRPASSPWLDSVIQVLNNIVTPSLNPLIYTLRNKDVKLALRKVFTQMVHISGV

SEQ ID NO: 1937 - DNA, 933 bp, Canis familiaris
atgacaaacatgagtgtagtgacaatgttcatcctcatgggccttccccatgcaccagccctggacatccccttcttcacaatcttcttagtgatttatgtactcaccgtgatggggaacctcctcatcctgctggtgatcagggtggattctcacctccacacccccatgtactacttcctgaccaacctgtccttcattgacatgtggttctccacagtcactgtgcccaaaatgctgatgaccttggggtctccaggaggcaggatgatctcctttcacagctgcatggcccagctctactgcttccacttcctgggcagcaccgagtgtttcctctacacagtcatgtcctatgaccgctacctggccatcagtcacccactcaggtacgccagcatgatgagggggagaacgtgtgccctcctggccaccggcacgtggctcagtggctctctgcactctgctgtccagaccacgctgacattccgtttgccctactgtggtcccggccagatccagcattacttctgtgatgcccctcccatcctcaggctggcctgtgcagacacctctgtgaacgagatggtgatctttgtcaacattggggtggtggcctcgggctgcttcctcctcatagtgttgtcctatgtgtccatcgtctgttccatcctgaaagaaatccgcacctcagaggagaggcatagagcctctcagacctgtgcctcccactgcattgtggtcctttgtttctttggccctggtcttttcatttacctgaggccaggctccagggatgctgtggatggggttgtggtcttctacacggtgctgacaccccttctaatccctgtggtgtacaccctgaggaacaaggaagtgaagaaagctgtgctcaaggtgggcagaaagtcagtgttgggtcaatgtgaa

SEQ ID NO: 1938 - protein, 311 aa, Canis familiaris
MTNMSVVTMFILMGLPHAPALDIPFFTIFLVIYVLTVMGNLLILLVIRVDSHLHTPMYYFLTNLSFIDMWFSTVTVPKMLMTLGSPGGRMISFHSCMAQLYCFHFLGSTECFLYTVMSYDRYLAISHPLRYASMMRGRTCALLATGTWLSGSLHSAVQTTLTFRLPYCGPGQIQHYFCDAPPILRLACADTSVNEMVIFVNIGVVASGCFLLIVLSYVSIVCSILKEIRTSEERHRASQTCASHCIVVLCFFGPGLFIYLRPGSRDAVDGVVVFYTVLTPLLIPVVYTLRNKEVKKAVLKVGRKSVLGQCE

SEQ ID NO: 1939 - DNA, 936 bp, Canis familiaris
atgacaaacaggagcctcgtaacaacattcatcctcataggccttccccatgcaccagccctggacatccccctcttcacaatcttcttagtgatttatgtactcaccgtgatggggaacctcctcatcctgctggtgatcatggtagattctcacctccacacccccatgtactacttcctgaccaacctgtccttcattgacatgtggttctccacagtcactgtgcccaaaatgctgatgaccttggggtctccaggaggcagaatgatctcctttcacagctgcatggcccagctctactgcttccacttcctgggcagcaccgagtgtttcctctacacagtcatgtcttatgaccgctacctggccatcagtcacccactcaggtacgccagcatgatgagggggagaacgtgtgccctcctggccaccagcacgtggctcagtggctctctgcactctgctgtccagaccacgctgacgttccgtttgccctactgtgggcccagccagatccagcattacttctgtgatgcccctcccatcctcaggctggcctgtgcagacacctccgtgaatgagatagtgatctttgtcaacattggggtggtggcctcgggctgcttcctcctcatagtgttgtcctatgtgtccattgtctgttccatcctgaagatccgcacctcagaggggaggcacagagcctttcagacctgtgcctcccactgcattgtggtcctttgtttctttgttccctgtgttttcatctacctgaggccaggctccagggatgctgtggatggggtcgtggcagtcttctacacggtgctgacaccccttctaaaccctgtggtgtataccctgaggaacaaggaagtgaagaaagctctgttgaagcttaaagacaaaataacacagtctcagagcaaataa

SEQ ID NO: 1940 - protein, 311 aa, Canis familiaris
MTNRSLVTTFILIGLPHAPALDIPLFTIFLVIYVLTVMGNLLILLVIMVDSHLHTPMYYFLTNLSFIDMWFSTVTVPKMLMTLGSPGGRMISFHSCMAQLYCFHFLGSTECFLYTVMSYDRYLAISHPLRYASMMRGRTCALLATSTWLSGSLHSAVQTTLTFRLPYCGPSQIQHYFCDAPPILRLACADTSVNEIVIFVNIGVVASGCFLLIVLSYVSIVCSILKIRTSEGRHRAFQTCASHCIVVLCFFVPCVFIYLRPGSRDAVDGVVAVFYTVLTPLLNPVVYTLRNKEVKKALLKLKDKITQSQSK

SEQ ID NO: 1941 - DNA, 936 bp, Canis familiaris
atgacaaacaggagctttgtaactacattcatcctcatgggccttccccatgcaccagccctggacatccccctcttcacaatcttcttagtgatttatgtactcaccgtgatggggaacctcctcatcctgctggtgatcagggtggattctcacctccacacccccatgtactacttcctgaccaacctgtccttcattgacatgtggttctccacagtcactgtgcccaaaatgctgatgaccttggggtctccaggaggcaggatgatctcctttcacagctgcatggctcagctctactgcttccacttcctgggcagcaccgagtgtttcctctacacagtcatgtcctatgaccgctacctggccatcagtcacccactcaggtacaccagcatgatgagggggagaacgtgtgccctcctggccaccggcacgtggctcagtggctctctgcactctgctgtccagaccacgctgacattccgtttgccctactgtgggcccagccagatccagcattacttctgtgatggacctcccatcctcaggctggcctgtgcagacacctccgtgaacgagatggtgatctttgtcaacattggggtggtggcctcgggctgcttcctcctcatagtgttgtcctatgtgtccatcgtctgttccatcctgaagatccgcacctcagaggggaggcatagagcctttcagacctgcacctcccactgcattgtggtcctttgcttctttgttccctgtgttttcatctacctgaggccaggctccagggatgctgtggatggggtcgtggcagtcttctacacggtgctgacaccccttctaaaccctgtggtgtacaccctgaggaacaaggaagtgaagaaagctctgttgaagcttaaagacaaaataacacagtcccagagcaaataa

SEQ ID NO: 1942 - protein, 311 aa, Canis familiaris
MTNRSFVTTFILMGLPHAPALDIPLFTIFLVIYVLTVMGNLLILLVIRVDSHLHTPMYYFLTNLSFIDMWFSTVTVPKMLMTLGSPGGRMISFHSCMAQLYCFHFLGSTECFLYTVMSYDRYLAISHPLRYTSMMRGRTCALLATGTWLSGSLHSAVQTTLTFRLPYCGPSQIQHYFCDGPPILRLACADTSVNEMVIFVNIGVVASGCFLLIVLSYVSIVCSILKIRTSEGRHRAFQTCTSHCIVVLCFFVPCVFIYLRPGSRDAVDGVVAVFYTVLTPLLNPVVYTLRNKEVKKALLKLKDKITQSQSK

SEQ ID NO: 1943 - DNA, 936 bp, Canis familiaris
atgacaaacatgagctttgtaagtacattcatcctcatgggcattccccatgcaccagccctggacatccccctcttcacaatcttcttagtgatttatgtactcaccatgatggggaacctcctcatcctgctggtgatcagggtggattctcacctccacacccccatgtactacttcctgaccaacctgtccttcattgacatgtggttctccacagtcactgtgcccaaaatgctgatgaccttcgggtctccaggaggcaggatgatctcctttcacagctgcatggcccagctctactgcttccacttcctgggcagcaccgagtgtttcctctacacagtcatgtcctatgaccgctacctggccatcagtcacccactcaggtatgccagcatgatgagggggagaacgtgtgccctcctggccaccagcacgtggctcagtggctctctgcactctgctgtccagaccacgctgacgttccgtttgccctactgtgggcccagccagatccagcattacttctgtgatgcccctcccatcctcaggctggcctgtgcagacacctccgtgaacgagatggtgatctttgtcaacatcggggtggtggcctcgggctgcttcctcctcatagtgttgtcctacgtgtccatcgtctgttccatcctgaagatccgcacctcagaggggaggcacagagcctttcagacctgtgcctcccactgcattgtggtcctttgtttctttggccctggtcttttcatctacctgaggccaggctccagggatgctgtggatggtgtcgtggcagtcttctacacggtgctgacaccccttctaaaccctgtggtgtacaccctgaggaacaaggaagtgaagaaagctctgctcaacgtgggcagtaagtcaatattcacccaatgtaaataa

SEQ ID NO: 1944 - protein, 311 aa, Canis familiaris
MTNMSFVSTFILMGIPHAPALDIPLFTIFLVIYVLTMMGNLLILLVIRVDSHLHTPMYYFLTNLSFIDMWFSTVTVPKMLMTFGSPGGRMISFHSCMAQLYCFHFLGSTECFLYTVMSYDRYLAISHPLRYASMMRGRTCALLATSTWLSGSLHSAVQTTLTFRLPYCGPSQIQHYFCDAPPILRLACADTSVNEMVIFVNIGVVASGCFLLIVLSYVSIVCSILKIRTSEGRHRAFQTCASHCIVVLCFFGPGLFIYLRPGSRDAVDGVVAVFYTVLTPLLNPVVYTLRNKEVKKALLNVGSKSIFTQCK

SEQ ID NO: 1945 - DNA, 936 bp, Canis familiaris
atgcacagtggaaaccagacttctgtgtcccatttcattttggtgggcctgcaccacccgccacagctgggggtgccactcttcctggctttccttgtcatctatgccctcactgtctctggcaatgggctcatcatcctcaccgtcttggtggacacccggctccaccgccccatgtactggttcctgtgtcacctctctttcttggacatgaccatttcttctgccattgtccccaagatgctagctggctttctccaggatagcagggttatctcctttggaggctgtgtaatccaacttttttctttccatttcctgggctgtactgaatgcttcctttacacacttatggcttatgatcgtttcctggccatttgtaagcctttacattatgccactattatgacccgtaacatctgtaacttcctggctttgggtacctggctgggaggcaccctccactcacttttccaaaccagcttcatattccgcctgcctttctgtggcccaaaccgagtagactacttcttctgtgacattcctgccatgctgcgtctagcctgtgctgacaccaccatcaatgagctggtcacctttgtagatattggatttctggccctcacctgctttatgcttatccttacttcctatggttatatagtggctgccattctgcgaatccagtcagttgatgggcgtcgcaatgccttctccacctgtgctgcccacctgaccgttgtcattgtttactatgtgccctgcaccttcatttacctccgtcctggctctcaggaacctctggatggagtggttgctgtcttctacactgtcatcactcccttgcttaaccccatcatctacacactccgcaacaaagagatgaaagcagcactgtggaggctgggaggccgcaaggatgtgcagcctcactga

SEQ ID NO: 1946 - protein, 311 aa, Canis familiaris
MHSGNQTSVSHFILVGLHHPPQLGVPLFLAFLVIYALTVSGNGLIILTVLVDTRLHRPMYWFLCHLSFLDMTISSAIVPKMLAGFLQDSRVISFGGCVIQLFSFHFLGCTECFLYTLMAYDRFLAICKPLHYATIMTRNICNFLALGTWLGGTLHSLFQTSFIFRLPFCGPNRVDYFFCDIPAMLRLACADTTINELVTFVDIGFLALTCFMLILTSYGYIVAAILRIQSVDGRRNAFSTCAAHLTVVIVYYVPCTFIYLRPGSQEPLDGVVAVFYTVITPLLNPIIYTLRNKEMKAALWRLGGRKDVQPH

SEQ ID NO: 1947 - DNA, 963 bp, Canis familiaris
atggagacggaggaccccaaccagactgtggtgagccacttcttcctggaggggctgatgtacacagctgaacaacctagcctcttcttcctcctcttcctcctcacctacagcatcaccttgactgggaatctcctcatcctcctgactgtgggctctgatcctcacctctgctcccctatgtaccacttcctggggcacctctccttcctggatgcctgtttgtctacagtgacggtgcccaaggtcatggcaggcctcctgaccgtggatgggaaggtgatctccttggagggctgtgctctacagctttactgcttccatctcctggccagcactgagtgcttcctatacacggtcatggcctacgaccgctacctagctatctgccaacccctgcgctacccagtggccatgaacagccggatgtgtgtggggctggctggcaccacctgggccgtaggtgctgtgcattcggcgatccacacctccctcaccttccacctgccctactgcggtcctcaccacattgcctacttcttctgcgacatccccccggtgctgaagctggcctgcgccgacacctccgttaatgagcttgtcatgcttgccaacattggcgtcgtggccgcaggttgcttgatcctcatcgtcgtatcctatgtcttcatcgtggcggcggtgctgcggatccgcaccgcccggggccggcggagggccttctccacctgcacctctcacctcaccgtggtgctgctgtactacgtgccacctgtctgcatctacctgcagcctcgctccgggggggcaggagcgggggtccctgcggtcttctacacaatcgtcactcccatgctcaaccctttcatctacactctgcgcaacaaggaggtcaagcgggctctgcaaagacttttgagccgaggcccgcgggagtccccgtcaggcagcccgcccccctga

SEQ ID NO: 1948 - protein, 320 aa, Canis familiaris
METEDPNQTVVSHFFLEGLMYTAEQPSLFFLLFLLTYSITLTGNLLILLTVGSDPHLCSPMYHFLGHLSFLDACLSTVTVPKVMAGLLTVDGKVISLEGCALQLYCFHLLASTECFLYTVMAYDRYLAICQPLRYPVAMNSRMCVGLAGTTWAVGAVHSAIHTSLTFHLPYCGPHHIAYFFCDIPPVLKLACADTSVNELVMLANIGVVAAGCLILIVVSYVFIVAAVLRIRTARGRRRAFSTCTSHLTVVLLYYVPPVCIYLQPRSGGAGAGVPAVFYTIVTPMLNPFIYTLRNKEVKRALQRLLSRGPRESPSGSPPP

SEQ ID NO: 1949 - DNA, 936 bp, Canis familiaris
atggctgcagataacgcctcctctgtgacagagtttatcctggcaggcttaacagatgagccggaactccagatgcccctcttcttcctgttcctaggtttttatgtggtcaccgtggtggggaacctgggcctcataaccctgattgggctgaattctcaccttcatattcccatgtacttcttcctcctcaacttgtctttcattgattttagttattccactactctcactcctaaaatgttaatgggttttgtctcaaagagaaacatcatttcctatgcggggtgtgtgactcagttttttttcttctgtttctttgtcttttctgaatcctatatcttgtcagcgatggcatatgaccgctatgtcgccatctgtaaaccactgctgtacacggtcaccatgtctcctcaggtgtgtttactcctcatgttgggtgtttatgggatgggggtgtttggggctgtgacccatatgggaaacatcatgtttataaccttttgtgctgacaaccttgtcaatcactatatgtgtgatatcattcccctccttgagctctcctgcaacagctcttacataaatttgctggtggtcttcattgttgtgaccattggcattggggtgcctattgtgaccattttcatctcttatggtttcattctttctagtattctccacattagttcaactgagggcagatccaaagccttcagtacctgcagttcccatataattgtggtatctcttttctttggatcaggagcttttatgtatctcaaaccaccttctattttaccccttgaccaggggaaagtgtcttccatattctatactgctgtggtacccatgttcaacccgctgatttatagtctgaggaataaggatgtcaaaattgccctgaagaaaacattaggcagaaaactcttctcttga

SEQ ID NO: 1950 - protein, 311 aa, Canis familiaris
MAADNASSVTEFILAGLTDEPELQMPLFFLFLGFYVVTVVGNLGLITLIGLNSHLHIPMYFFLLNLSFIDFSYSTTLTPKMLMGFVSKRNIISYAGCVTQFFFFCFFVFSESYILSAMAYDRYVAICKPLLYTVTMSPQVCLLLMLGVYGMGVFGAVTHMGNIMFITFCADNLVNHYMCDIIPLLELSCNSSYINLLVVFIVVTIGIGVPIVTIFISYGFILSSILHISSTEGRSKAFSTCSSHIIVVSLFFGSGAFMYLKPPSILPLDQGKVSSIFYTAVVPMFNPLIYSLRNKDVKIALKKTLGRKLFS

SEQ ID NO: 1951 - DNA, 933 bp, Canis familiaris
atggccataggaaatgactcttcagtgaccgagtttatcctgctgggtttaacacaacagccagaactccagctgcctctcttcttcattttcttaggattctatgtggtcaccatggtggggaacatgggcttgatttttctgattggtctgaaccctcacctgcacactcccatgtactactttctcttcaacctttccttcattgatttctgctactcgtctgtcataatccctagaatgctgatgagttttgtaaaggagaacatcatctcttatgcagagtgcatgacacagctctgtttcttctctttctttgttatcgatgagtgctatgttttgacatcaatggcttatgaccggtatgtggccatctgtaagcccctgctctacaaggtcaccatgtcccatcaggtctgcctcatgctgatggtgggaacatatgtgatggggtttgtgggtgccattgcccacaccggttgtatgctgagactcagcttctgtgatggcaacatcgtcaatcattacatgtgtgacatacctcctcttctccagctctcttgcacaagcacgtatatcaatgaggttatggttttcattgtggtgggcatcaatgtaatagtgcccagtctcactatctccatttcttacaccttgatcctctccaacatattccatatccgttctacagagggcaggtccaaagccttcagtacctgtagctctcacatagttactgtttctctcttctttggagcatcggcattcatgtaccttaagccctctcctgctgggtctctggatcgagataaagtatccacagttttttataccatcgtggggccaatgatgaatccttttatttacagtctaaggaacaaagatgttaaaattgcactgagtaagactttgaagaaaagggtgttctcataa

SEQ ID NO: 1952 - protein, 310 aa, Canis familiaris
MAIGNDSSVTEFILLGLTQQPELQLPLFFIFLGFYVVTMVGNMGLIFLIGLNPHLHTPMYYFLFNLSFIDFCYSSVIIPRMLMSFVKENIISYAECMTQLCFFSFFVIDECYVLTSMAYDRYVAICKPLLYKVTMSHQVCLMLMVGTYVMGFVGAIAHTGCMLRLSFCDGNIVNHYMCDIPPLLQLSCTSTYINEVMVFIVVGINVIVPSLTISISYTLILSNIFHIRSTEGRSKAFSTCSSHIVTVSLFFGASAFMYLKPSPAGSLDRDKVSTVFYTIVGPMMNPFIYSLRNKDVKIALSKTLKKRVFS

SEQ ID NO: 1953 - DNA, 900 bp, Canis familiaris
ctggaaaactggactcaggtgacagagtttgtccttttgggtttccccagaagccacatcctacagtctctgctgttcctggggttgatggtgacctacattgtaacggcctcaggcaacctactcattattgggctcagctgggtgagcagacgcctacacacacagatgtacttcttcctgaggaacctgtcctttctggagctgttgcttgtgtctgttgtggttccataaatgcttgtcatcattctcacaggggatcactccatctcatttgccagttgcatcctccaatcctacctctacttcctccttggcaccaccgacttcttcctcttagctgtcatgtctctggatcgttacttggcaatctgccgccccctccactatgagactctgatgagcggtcgtgtctgttcccaattagttctggcctcctggctagctggattcctctgggtgctctgtcccaccatcctcatggccagcctacctttctgtggcccccgtggtattgaccactttttctgtgacagctggcctttgctgaggctctcttgtggagacacccgcctactggagctggtggcatttgtgctctccacgacagtgttactggggtcactggcggtgaccttggtttcctatgcctgcattcttgccacagttttcagggcccccacagctgccgagcggaagaaggcattctccacttgtgtctcacatcttactgtggtggtcatcgtctatggcagctccatttttctctacatccgtgtgtcggaggctcagtcctcactgctcaacaaaggtgcctcagtcctgagctgtatcatcacacccctcctgaacccattcatcttcagtctccgcaatgataaggtgaagcaggccctgaga

SEQ ID NO: 1954 - protein, 222 aa, Canis familiaris
MLVIILTGDHSISFASCILQSYLYFLLGTTDFFLLAVMSLDRYLAICRPLHYETLMSGRVCSQLVLASWLAGFLWVLCPTILMASLPFCGPRGIDHFFCDSWPLLRLSCGDTRLLELVAFVLSTTVLLGSLAVTLVSYACILATVFRAPTAAERKKAFSTCVSHLTVVVIVYGSSIFLYIRVSEAQSSLLNKGASVLSCIITPLLNPFIFSLRNDKVKQALR

SEQ ID NO: 1955 - DNA, 945 bp, Canis familiaris
atgaatccaacaaatcatacccaggtgacaggctttgtcctcctggggctctctcaggtatgggagctccggttcttcttcttcattgtcttctcagctgtgtatcttatgactgtaatgggaaatctccttattgtggccatagtgacctctgacccacgcctccacacaaccatgtattttctcttaggcaatctttctttcctagacttttgctactctaccatcacggcacccaggatgctggttgacttgctctcaggcaaccccatcatttcctttggtagctgcctgactcagctctttttcttccatttcattggaggcatcaagatcttcctgctgactgtgatggcgtttgaccgctatattgccatctcccagcccttgcgctacaggattattatgaatagaacagtctgtgggctcctcgtggtagcctcctgggtggggggcttcatccactccattgtacaggttggactgactatccagctgccattctgtgggcctgacaggctggacaacttttactgtgatgtgcctcagctgatcaaattggcctgcacagatacctttgtcttagagcttctgatggtgtctaacaatggcctggtgaccctgatgtgttttctggtgctcctgggatcctacacggcactgctggtcatgctccgaggccactccagggagggccgcagcaaagccctatccacttgtgcttctcatattgccgtagtgaccttaatctttgtgccttgtgtctacatctatgcaaggccatttcgcaccttccctatggacaaggtggtctctgtgctgtacacaatggtcactcccatgctgaatcctgccatctataccctgagaaacaaggaagcgatcatggccatgaagaagctgtggagaaggcaaaaagaccttctgggtcccctggagcactga

SEQ ID NO: 1956 - protein, 314 aa, Canis familiaris
MNPTNHTQVTGFVLLGLSQVWELRFFFFIVFSAVYLMTVMGNLLIVAIVTSDPRLHTTMYFLLGNLSFLDFCYSTITAPRMLVDLLSGNPIISFGSCLTQLFFFHFIGGIKIFLLTVMAFDRYIAISQPLRYRIIMNRTVCGLLVVASWVGGFIHSIVQVGLTIQLPFCGPDRLDNFYCDVPQLIKLACTDTFVLELLMVSNNGLVTLMCFLVLLGSYTALLVMLRGHSREGRSKALSTCASHIAVVTLIFVPCVYIYARPFRTFPMDKVVSVLYTMVTPMLNPAIYTLRNKEAIMAMKKLWRRQKDLLGPLEH

SEQ ID NO: 1957 - DNA, 936 bp, Canis familiaris
atgggcctaagaaatcaatctgcagtgactgggtttcttctttcaggactaaccgaccaacctgagcttcagctgcctcttttctgcctcttctcagggatttatgcagttacagtggcgggaaatctcggaatgatctcaataattgggttgagttctcaacttcacacccccatgtaccatttcctcagtagtttgtcttttttagatgtatgctattcttctgttattacccccagaatgttggcagactttttatgcaacgataaagccatctcctattctggttgcatgactcagcttttttttttttgcatttttgtcatttctgagtgctacatgttagctgccatggcctatgatcgctatgtcgccatctgcagccccctgctgtaccatgtcatcatgtctcctcgggcttgttctctgctggtagctgctggcttctcagtaggcttgattgatgctatgatccatggaggttgtatattaaggctgactttctgtggcccaaacatcattaaacattatttctgtgacatcattccacttattcaactctcttgttcaagcacttatattgatgagcttttgatttttgtcattggcggatttaacatggtagccaccagcctgacgatcatcatttcttatggtttcatcctctccaaaatcctccacatccactctatgcagggcaggtccaaagccttcagcacctgcagctcccacttgacagctgttctaatattttatgggactctcatgtccatgtatctcaaacctgcttccagcaggtcactcatccaggagaaagtgtcctcggtattttataccactgtgattcccatgttgaatcccttgatatacagtctgaggaataaggaagtaaaaaatgcactcatgaaactcttaaaaagaaaagtatctttataa

SEQ ID NO: 1958 - protein, 311 aa, Canis familiaris
MGLRNQSAVTGFLLSGLTDQPELQLPLFCLFSGIYAVTVAGNLGMISIIGLSSQLHTPMYHFLSSLSFLDVCYSSVITPRMLADFLCNDKAISYSGCMTQLFFFCIFVISECYMLAAMAYDRYVAICSPLLYHVIMSPRACSLLVAAGFSVGLIDAMIHGGCILRLTFCGPNIIKHYFCDIIPLIQLSCSSTYIDELLIFVIGGFNMVATSLTIIISYGFILSKILHIHSMQGRSKAFSTCSSHLTAVLIFYGTLMSMYLKPASSRSLIQEKVSSVFYTTVIPMLNPLIYSLRNKEVKNALMKLLKRKVSL

SEQ ID NO: 1959 - DNA, 948 bp, Canis familiaris
atggctatgagaaaccagagtactttgactgaatttacgttggtctcctttcctgtcattcaagagcttcaaatcttgctgtttgtcattctcctgatggtttatatacttaccataacaggaaacattgtcatcatttccttaatatggactgataatcgtctccaaacaccaatgtatttcttccttagtaatctgtcatttttggacattttgttcacaaccactattgccccaaagttgctagcttgtctcttagaaaagaagaaaacgatatcctttgctgggtgcatcactcaaatttatttctacttctttctggggacagtggagtttatcctcctggcagtgatgtcctttgaccgctacgtggccatctgtaaccctctgcgctacaccatcattatgaacagcagggtttgtctcctgctggttctgggctgctgggtgggagccttcctctcagtgctgtgcccaactattgtggtctccagactgccttactgcactaaagaaattagtcatttcttctgtgacattgcccctttactgcaggtggcctgcatagacactcatttcattgagatgataaacttcctcttgtcttcctttgtcctcctgacctcactggtatttaccatcgtgtcctacacctacatcatctctaccatcctgcgcatcccctcagcccaaggacgtcagaaggccttttccacctgtgcttctcacatcacggttgtgtccattgcctatgggagcaacattttcatgtacatgaggcccagccagagtcattcactggagtttgacaaggtgacagctgtccttaccacaatggtaacccctcttctgaaccccttcatttacagcttaaggaatgaaaaagtaaaggaaatcttgagagagacaattagcaggatagttctaccatattccaagggcacttga

SEQ ID NO: 1960 - protein, 315 aa, Canis familiaris
MAMRNQSTLTEFTLVSFPVIQELQILLFVILLMVYILTITGNIVIISLIWTDNRLQTPMYFFLSNLSFLDILFTTTIAPKLLACLLEKKKTISFAGCITQIYFYFFLGTVEFILLAVMSFDRYVAICNPLRYTIIMNSRVCLLLVLGCWVGAFLSVLCPTIVVSRLPYCTKEISHFFCDIAPLLQVACIDTHFIEMINFLLSSFVLLTSLVFTIVSYTYIISTILRIPSAQGRQKAFSTCASHITVVSIAYGSNIFMYMRPSQSHSLEFDKVTAVLTTMVTPLLNPFIYSLRNEKVKEILRETISRIVLPYSKGT

SEQ ID NO: 1961 - DNA, 948 bp, Canis familiaris
atggatgtgcaaaatcagaccagagtgactgaatttacactgactgccttccctgttatccggaagcttcagatctccctctttgtggtcctcctgtttacttacatgctaactctaacaggaaatactgtcatcatttccttaatatgggctgataatcgcctccaaaccccaatgtacttctttctcagtaatttgtcatttttggacattctatacactacctcagttaccccaaagctgttagcttgtctcctagaggacaagaagaccatatcttttgctggctgcatgacccaagtatacttcttttttttcctggggacagtggagtttatcctcctggcagtgatgtcctttgaccgctacgtggccatctgtaaccctctgcgctacaccgttatcatgaacagcagggtctgtctcctgctggttctgggctgctggataggggctttcttttctgtgctgtgcccaattatcgtggtctccagactgccttactgttatagggaaattggtcatttcttctgtgacattgcccctttactgcaggtagcctgcatagacactcatttcattgagatgataaacttcctcttgtcctcctttgtcctcctgacctcactggtattcaccattgtgtcctacacctacatcatctctaccatcctgcgcatcccctcagcccaaggacgtcagaaggccttttccacctgtgcttctcacatcacggttgtgtccattgcctatgggagcaacatcttcatgtatgtgaggcccagccagagccattcactggagtttgacaaagtgacagctgtcatgaccataatggtaacccctcttctgaatcccttcatttatagtctaaggaatgaaaaggtaaaggaagttttgagagaagcaatcttcaaaattatgtccttatggcacaagagaacttga

SEQ ID NO: 1962 - protein, 315 aa, Canis familiaris
MDVQNQTRVTEFTLTAFPVIRKLQISLFVVLLFTYMLTLTGNTVIISLIWADNRLQTPMYFFLSNLSFLDILYTTSVTPKLLACLLEDKKTISFAGCMTQVYFFFFLGTVEFILLAVMSFDRYVAICNPLRYTVIMNSRVCLLLVLGCWIGAFFSVLCPIIVVSRLPYCYREIGHFFCDIAPLLQVACIDTHFIEMINFLLSSFVLLTSLVFTIVSYTYIISTILRIPSAQGRQKAFSTCASHITVVSIAYGSNIFMYVRPSQSHSLEFDKVTAVMTIMVTPLLNPFIYSLRNEKVKEVLREAIFKIMSLWHKRT

SEQ ID NO: 1963 - DNA, 948 bp, Canis familiaris
atggatgtgcaaaatcagtccagagtgactgaatttacgctgactgccttccctgttatccggaagcttcagatctccctctttgtggtcctcctgtttacctacatgctaactctaacaggaaatactgtcatcatttccttaatatgggctgataatcgcctccaaaccccaatgtacttctttctcagtaatttgtcatttttggacattctatacactacctcagttaccccaaagctgttagcttgtctcctagaggacaagaaaaccatatcttttgctggctgcatcacccaaacatacttcttttttttcctggggacagtggagtttatcctcctggcagtgatgtcctttgaccgctacgtggccatctgtaaccctctgcgctacaccgttatcatgaacagcagggtctgtctcctgctggttctgggctgctgggtgggagccttcctctcagtgctgtgcccaactatcgtggtctccagactgccttactgttatagggaaattggtcatttcttctgtgacattgcccctttactgcaggtggcctgcatagacactcatttcattgagatgataaacttcctcttgtcctcctttgtcctcctgacctcactggtattcaccatcgtgtcctacacctacatcatctctaccatcctgcgcatcccctcagcccaaggacgtcagaaggccttttccacttgtgcttctcacatcacggttgtgtccattgcctatgggagcaacatcttcatgtatgtgaggcccagccagagccattcactggagtttgacaaggtgacagctgtcctcacgacaatggtgacccctcttctgaaccctttcatttatagtctaaggaataaaaaggtaaaggaagttttgagagaagcaatccttaaaattatgtccttatggcacaagagaacttga

SEQ ID NO: 1964 - protein, 315 aa, Canis familiaris
MDVQNQSRVTEFTLTAFPVIRKLQISLFVVLLFTYMLTLTGNTVIISLIWADNRLQTPMYFFLSNLSFLDILYTTSVTPKLLACLLEDKKTISFAGCITQTYFFFFLGTVEFILLAVMSFDRYVAICNPLRYTVIMNSRVCLLLVLGCWVGAFLSVLCPTIVVSRLPYCYREIGHFFCDIAPLLQVACIDTHFIEMINFLLSSFVLLTSLVFTIVSYTYIISTILRIPSAQGRQKAFSTCASHITVVSIAYGSNIFMYVRPSQSHSLEFDKVTAVLTTMVTPLLNPFIYSLRNKKVKEVLREAILKIMSLWHKRT

SEQ ID NO: 1965 - DNA, 942 bp, Canis familiaris
atggggaattggagcatagtgaccgaatttaccctaattgccttccctgttctcttagagcttcgaatcttcctctttgtggttcttttgctgacttacacactaacagcaacaggaaacattatcatcatcttcctaatatggactgataatcgcctgcaaactccaatgtacattttcctcagtaatttgtcctgtctagatattttatataccacggtcattaccccaaagttgctagactgcctccttggagagaagaaaaccatatcctttgctggctgcatcactcaaacgtatttctacttctttctggggacagtggagtttatcctcttggcggtgatgtcctttgaccgctacgtggccatctgtaaccccctgcgctacaccaccatcatgaacagcagggcctgcctactgctggttctgggctgctgggtgggagccttcctctccgtgttggtaccaaccattgtagtgacaaggctgccttattgtaggaaagaaattaatcattttttctgtgacattgcccctcttctgcaagtggcctgtgtagacacttacctcattgagcagataaacttccttctatctgccctcgtcatcctgagctccctagcattcacagctgggtcctacacctacatcatctctaccatcctgcgcattccctcagcccaaggccgccagaaagctttttctacctgtgcttctcacattacggttgtgtccattgcttatgggagcaacatctttgtgtatgtgagacccagtcagaactattccctggattttgacaaggtagctgctgtcctcattacagtggtgacccctcttctgaacccttttatttatagcttaagaaatgaaaaggtgaaagaagtgttgagagagacaatgaacagaatcatgtccttgatactaaggaaaacttga

SEQ ID NO: 1966 - protein, 313 aa, Canis familiaris
MGNWSIVTEFTLIAFPVLLELRIFLFVVLLLTYTLTATGNIIIIFLIWTDNRLQTPMYIFLSNLSCLDILYTTVITPKLLDCLLGEKKTISFAGCITQTYFYFFLGTVEFILLAVMSFDRYVAICNPLRYTTIMNSRACLLLVLGCWVGAFLSVLVPTIVVTRLPYCRKEINHFFCDIAPLLQVACVDTYLIEQINFLLSALVILSSLAFTAGSYTYIISTILRIPSAQGRQKAFSTCASHITVVSIAYGSNIFVYVRPSQNYSLDFDKVAAVLITVVTPLLNPFIYSLRNEKVKEVLRETMNRIMSLILRKT

SEQ ID NO: 1967 - DNA, 939 bp, Canis familiaris
atgagaaatggcacaacaatcacagagttcatcctggtaggctttcctgatatccaaggactacaaatccctctctttatagtgatctttttcatctacatattaacccttgtgggcaatgggctcataattgtcattgtgtgggcagagcccaggctacaaataccaatgtacttcttcctttgcaacttgtccttcctagagacgtggtacaccaccacagtcatccccaaactgttggagacttttgtggtggcaagagcaaccatttccatcccctgctgtctactgcagtccttcttccactttttcctgggtaccactgagttctttatcctcaccatcatgtcttttgaccgttacctggccatctgcaagccccttcgctaccccaccattatgaccagcaacctctgcctgcaacttgcactcagctcctggatggtcggctttaccattgtcttttgtcagatgcttctgctcatccagttgccattctgtggcaacaatgtcatcaatcatttctactgtgatgttggtcccattttgaaagcagcctgcgtagacacaagcattctggagctcctgggtcttttggcgaccatcctggtgatcccagggtcactcctcttcacagtaatttcttatatctatatcctgtccaccatcctacagatcccttcagccactggcagacaaaagactttctctacctgtgcctctcacctgacggtagtctccctgctgtatggtgctgtcttgttcatgtacctgagacccacaacacactcttcctttaagattaataaggtggtgtcagtgctaaatactatcctcacaccccttctgaatcccttcatttacacaattagaaacaaggaggttaaagcagccctaaggaagacaatgacttgtccaaagactcatcatccagagtaa

SEQ ID NO: 1968 - protein, 312 aa, Canis familiaris
MRNGTTITEFILVGFPDIQGLQIPLFIVIFFIYILTLVGNGLIIVIVWAEPRLQIPMYFFLCNLSFLETWYTTTVIPKLLETFVVARATISIPCCLLQSFFHFFLGTTEFFILTIMSFDRYLAICKPLRYPTIMTSNLCLQLALSSWMVGFTIVFCQMLLLIQLPFCGNNVINHFYCDVGPILKAACVDTSILELLGLLATILVIPGSLLFTVISYIYILSTILQIPSATGRQKTFSTCASHLTVVSLLYGAVLFMYLRPTTHSSFKINKVVSVLNTILTPLLNPFIYTIRNKEVKAALRKTMTCPKTHHPE

SEQ ID NO: 1969 - DNA, 948 bp, Canis familiaris; identical to SEQ ID NO: 20

SEQ ID NO: 1970 - protein, 315 aa, Canis familiaris; identical to SEQ ID NO: 50

SEQ ID NO: 1971 - DNA, 930 bp, Canis familiaris
atgactctgagaaacagctcctcagcaactgagtttatcctagtgggattatcagaacacccagagctccagctacccctcttcctcttgttcttagggatatatgtgtttactgtggtgggcaacatgggcttgatcaccttaattgggctgaattctagccttcatactccaatgtactttttcctcttcaacttgtcttttatagatctctgttatgccagtgtgtttacccctaaaatgctgaatggttttgtgtcagaaaatatcatctcttatgtgggatgcatgactcagctattcttcttctgtttctttatcaattctgaatgctatgtgttggtatcaatggcctatgatcgctatgtggctatctgcaaccctctgctgtacacggtcaacatgtccccacaggtttgttctctgctgatgtttggttcatacgtgatagggtttgctggagctatggcccacactggaagcatattgagactgacgttctgtaattccaacatcatccaccattatctgtgtgaagttcttcctctcttgcagctctcttgcaccagcacccatgtcaatgagttggtgttttttattattgtgggagtggtcatcacaatatccagcatcagcatcttcatctcttatgcattgattctctctaatatcctccgtattccttctgctgagggcaggtccaaagcctttagcacatgtggctcccacattattgctgttgctttgttttttgggtcaggggcattcacctatttaacaacctcttttcctggatctatggaccagggtaaatttgcctcagtcttttataccaatgtggttcccatgcttaacccttttatctacagtttgaggaataaggatgtgaaacttgccctgggtaaaaccctgagaagagtgcttctctga

SEQ ID NO: 1972 - protein, 309 aa, Canis familiaris
MTLRNSSSATEFILVGLSEHPELQLPLFLLFLGIYVFTVVGNMGLITLIGLNSSLHTPMYFFLFNLSFIDLCYASVFTPKMLNGFVSENIISYVGCMTQLFFFCFFINSECYVLVSMAYDRYVAICNPLLYTVNMSPQVCSLLMFGSYVIGFAGAMAHTGSILRLTFCNSNIIHHYLCEVLPLLQLSCTSTHVNELVFFIIVGVVITISSISIFISYALILSNILRIPSAEGRSKAFSTCGSHIIAVALFFGSGAFTYLTTSFPGSMDQGKFASVFYTNVVPMLNPFIYSLRNKDVKLALGKTLRRVLL

SEQ ID NO: 1973 - DNA, 933 bp, Canis familiaris
atggctatggaaaatgagtcttcagtgactgaattcatcctggtaggatttacagatcaatctcagctccagttaccccttttcttcctctttttactgaactatgtggtcactgtggtaggaaatttgagcttcattaatctaatttgcctgaattctcacttgcacactcccatatactttttcaccttcaacttatccttcatagatctctgccagtctttggtcattacacctaaaatgctgatgaactttgtgtcagagaagaatatcatctcctttacagaatgcatgactcagctggtttttttctgtttctttgcccattctgagtgctatgtgttgacagccatggcctatgatcgctatgtggccatctgtcagctcctggtgtacacggtcaccatgtcccctcaggtctgttctctgctgatgtttggttcttatgtgatggggtttgctggtgccatggtccacacaggggacatggtcagattgtccttctgtgattccaacatcatcaaccattacatgtgtgacatcttccccctctaccagctctcctgcagcagcacctatgccagtgagctggtggattccattattgtgatcacagttgtcataatatccagctccattattttcatttcttatgttttgatcctgtccagtgtcctccacatctcatcagctctgggttggtccaaaaccttcagcacctgtggctcccacatagtaactgttggtctattctatggatctgggctgttcacacatctcaagacctctccttctggttctatgggccaggggaaattcttctcagtattttacacaaatatagtacccatgttgaacccttttatctatagtctaaggaacaaggatgtcaaatgtgctctgaaaaaaactctgaaaagaattgcaaattaa

SEQ ID NO: 1974 - protein, 310 aa, Canis familiaris
MAMENESSVTEFILVGFTDQSQLQLPLFFLFLLNYVVTVVGNLSFINLICLNSHLHTPIYFFTFNLSFIDLCQSLVITPKMLMNFVSEKNIISFTECMTQLVFFCFFAHSECYVLTAMAYDRYVAICQLLVYTVTMSPQVCSLLMFGSYVMGFAGAMVHTGDMVRLSFCDSNIINHYMCDIFPLYQLSCSSTYASELVDSIIVITVVIISSSIIFISYVLILSSVLHISSALGWSKTFSTCGSHIVTVGLFYGSGLFTHLKTSPSGSMGQGKFFSVFYTNIVPMLNPFIYSLRNKDVKCALKKTLKRIAN

SEQ ID NO: 1975 - DNA, 1026 bp, Canis familiaris
atgacagcgtgtaaggagggagctgggttttctattaatgggattttcttctgttctcacagatttccaaagaggagaatattggttagaaatgactccttagtgactgaattccttcttgctggattaacagaccgccctgagctccagcaacctctcttcttcctgtttctgatgatctacatcgtcaccatggtgggcaaccttggcttgatcatcctcatcggtctcaattctcacctccacacccccatgtactatttcctcttcaatctatccttcattgatctctgttactcttctgtttttacccccaagatgctgatgaactttgtatcaaaggacaatatcatctcctatgttgggtgcatgactcaactgttcttctttctcttttttgtcatctcagaatgctacatgttgacctcaatggcctatgaccgctatgtggccatctgtaatccattgttgtataaggtcaccatgtcccatcaggtctgttccttgctaactgttgctgcatatatgatgggatttgccagagcctctgcccacacggggtgcatgcttagactaacgttctgcaatgtcaatatcatcaaccattacctgtgtgacatccttcctctcctccaactctcttgcaccagcacctatgtcaatgaggtagtagttctgatagtcgtgggaattaatatcacagtacccagttttaccatcctgatttcttacgtcttcatcctcactagcattcttcatatcaaatctgctcaaggaagatcaaaagccttcagtacttgtagctctcacgtcattgctctgtgtcttttttttggatcagcagcattcatgtatcttaaatattcttctcctggatctatggagcagggaaaaatttcttcagtgttctatactaatgtgggacccatgctcaatcccctgatctacagtttgaggaataaggatgtcaaaattgcactgcggaaagctctgattagaatatggaagagaaacattagattctag

SEQ ID NO: 1976 - protein, 341 aa, Canis familiaris
MTACKEGAGFSINGIFFCSHRFPKRRILVRNDSLVTEFLLAGLTDRPELQQPLFFLFLMIYIVTMVGNLGLIILIGLNSHLHTPMYYFLFNLSFIDLCYSSVFTPKMLMNFVSKDNIISYVGCMTQLFFFLFFVISECYMLTSMAYDRYVAICNPLLYKVTMSHQVCSLLTVAAYMMGFARASAHTGCMLRLTFCNVNIINHYLCDILPLLQLSCTSTYVNEVVVLIVVGINITVPSFTILISYVFILTSILHIKSAQGRSKAFSTCSSHVIALCLFFGSAAFMYLKYSSPGSMEQGKISSVFYTNVGPMLNPLIYSLRNKDVKIALRKALIRIWKRNIRF

SEQ ID NO: 1977 - DNA, 933 bp, Canis familiaris
atggccataggaaatgactcttcagtgaccgagtttatcctgctgggtttaacacaacagccagaactccagctgcctctcttcttcattttcttaggattctatgtggtcaccatggtggggaacatgggcttgattcttctgattgggctgaactctcacctgcacactcccatgtactactttctcttcaacctttcattcattgatttctgctactcgtctgtcataatccctagaatgctgatgagttttgtaaaacaaaacattatctcttatccagagtgcatgacacagctctgtttcttcgctttctttgttatcagtgagtgctgtattttgacatcaatggcctatgaccggtatgtggccatctgtaagcccctgctctacaaagccatcatgtcccatcaggtctgcctcatgttcatggcaggaacatatgggatggggtttgtgggtgcaatggcccacaccggatgtatgctgagactcagcttctgtgatggcaacatcatcaatcattacatgtgtgacatacctcctcttctccagctctcttgcacgagcacctacatcaatgaggtggtggttttcattgtggtgggcatcaatgtaatagtgcccagtctcactatctccatttcttacaccttgatcctctccaacatattccatatccgttctacagagggcaggtccaaagccttcagtacctgcagctctcacgtagttactgtttctctcttctttggagcatcggcattcatgtaccttaagccctctcctgctgggtccctggatcgagataaagtatccacagttttttataccatcgtggggccaatgatgaatccttttatctacagtttaaggaacaaagatgttaaaattgcactgagtaagactttgaagaaaagggtgttctcataa

SEQ ID NO: 1978 - protein, 310 aa, Canis familiaris
MAIGNDSSVTEFILLGLTQQPELQLPLFFIFLGFYVVTMVGNMGLILLIGLNSHLHTPMYYFLFNLSFIDFCYSSVIIPRMLMSFVKQNIISYPECMTQLCFFAFFVISECCILTSMAYDRYVAICKPLLYKAIMSHQVCLMFMAGTYGMGFVGAMAHTGCMLRLSFCDGNIINHYMCDIPPLLQLSCTSTYINEVVVFIVVGINVIVPSLTISISYTLILSNIFHIRSTEGRSKAFSTCSSHVVTVSLFFGASAFMYLKPSPAGSLDRDKVSTVFYTIVGPMMNPFIYSLRNKDVKIALSKTLKKRVFS

SEQ ID NO: 1979 - DNA, 960 bp, Canis familiaris
atgtggcagaggaatcagacctttctggcagacttcatccttgaaggcctctttgatgactctctcatccaccttttccttttctccttaaccatattggtcttccttattgcagtgagtggcaacacgctcactattctcctcatctgtgctgatgcccagcttcacacacccatgtacttcctgctcagtcagctctccctcatggatctaatgcatgtctccacaaccatcccaaagatggctaccaattatctatctggcaagaagaccatctcctttgtgggctgcgctacccagcacttcctctatttgtctctgggtggtggtgagtgtcttctcttagttctcatgtcctatgaccgctatgttgccatttgtcatccacttcgttataccattctcatgaacagaaaggtgggattgatgatggctatcatgtcatggttgggggcatccataaactctctaattcacacagtgatcttgatgcatttccctttctgtgggtctcggaaaatccaccacttctactgtgagtttccagctgttgtgaagttggtgtgtggagacatcactgtttatgagaccatagtgtatatcagcagtgtcatacttctcctcttccccattttcctagtttctacatcttatggcttcatcctccacagtgtcattcagatgcattcagctgggagtaagagaaatgcctttgctacttgtagctctcacctcattgtggtttctttctggtttggggcctgcatcttttcatatatgaggcccaggtcccagcgtactccattgcaagacaaagttggttctgtgttttatagcatcattactcccaccctcaatcctttgatttatactctccggaataaggatatagctaaggctatgagaagagtactagggagagatattctcactcagagacagcaattgccattgccctga

SEQ ID NO: 1980 - protein, 319 aa, Canis familiaris
MWQRNQTFLADFILEGLFDDSLIHLFLFSLTILVFLIAVSGNTLTILLICADAQLHTPMYFLLSQLSLMDLMHVSTTIPKMATNYLSGKKTISFVGCATQHFLYLSLGGGECLLLVLMSYDRYVAICHPLRYTILMNRKVGLMMAIMSWLGASINSLIHTVILMHFPFCGSRKIHHFYCEFPAVVKLVCGDITVYETIVYISSVILLLFPIFLVSTSYGFILHSVIQMHSAGSKRNAFATCSSHLIVVSFWFGACIFSYMRPRSQRTPLQDKVGSVFYSIITPTLNPLIYTLRNKDIAKAMRRVLGRDILTQRQQLPLP

SEQ ID NO: 1981 - DNA, 945 bp, Canis familiaris
atggagggagaaaaccacacgagtgtctctgagttcatcctcctagggctctccagccagcctgaaaggcaagagttgatctttgggctcttccttgtcatgtacctggttggggcagcagggaacttgctcatcatcctggccattggctctgactccctcctccacacacctatgtacttcttcctcagcaacctttccctggtggatttctgcttcatctctgccactgtccccaagatgcttgtgaatatccagatgcagacccagtccatttcttatggcggctgcttagcccagatctacttctgcattttgcttgccaacatggacaactttctcctgacagcaatggcttatgaccgctacgtggccatctgccaccccctgcactactccactatgatgagtctgcaaatctgtgccctgatgctgggaagctcctggctcattgccaatctccactctctgctacacactgccctcatggctcggctggagttctgtgccagcaacatcatcccttacttcttttgtgacctcattcccctgctccagctctcctgttctaacacccagctcaaccagctcatgattctgctggtggggggcttgattgtcctcattccttttctcagcattcttgtgtcctacatccgcattgtgtctgctgtgctcaaagtcccatctgcccagagcaaacaaaaggccttttccacttgtggctctcatctcacggtagtcctcctcttctatgggaccatcacaggggtctacctgaatccctcatcctcccacttagctgacaaggattcactggcttcagtgatgtatatggtggtcacacccatgctgaaccccttcatctactgcctgaggaacaaggacatgaagggagctctaagaaaactatttggagtgaagactttatcctgtgggctgtga

SEQ ID NO: 1982 - protein, 314 aa, Canis familiaris
MEGENHTSVSEFILLGLSSQPERQELIFGLFLVMYLVGAAGNLLIILAIGSDSLLHTPMYFFLSNLSLVDFCFISATVPKMLVNIQMQTQSISYGGCLAQIYFCILLANMDNFLLTAMAYDRYVAICHPLHYSTMMSLQICALMLGSSWLIANLHSLLHTALMARLEFCASNIIPYFFCDLIPLLQLSCSNTQLNQLMILLVGGLIVLIPFLSILVSYIRIVSAVLKVPSAQSKQKAFSTCGSHLTVVLLFYGTITGVYLNPSSSHLADKDSLASVMYMVVTPMLNPFIYCLRNKDMKGALRKLFGVKTLSCGL

SEQ ID NO: 1983 - DNA, 978 bp, Canis familiaris
atgagctcctggcccgcgtccaactggacggccccagccgagttcgtgatcctgggtttctccgggtggccccaggggctgcggctgctgctcttcgccttcctgctgccgctctacctggccacgctggcgggaaacctgctcatcctgggcctggctgtggcggagcctgccctgcactgccccatgtacttcttcctgggagcgctgtccgccgtggaggtggcctacacgctggcgctgactccgcgcatgctcgccggcttcctgctgccgcccgcaggcctggccgtggcccgctccacgtgcgccgcgcagatgggcctctttgtggcgctggggggcgccgagtgcctgctgctggccgccatggccctggaccgctacctggccatctgccgccccctctactacccccagctcatgagcacggcgctctgctggggcctcctggcctcctgctgtgccgggggctcaatcctggccttggggctcaccacggccattttccagctgcccttctgccaggggggcttagtgaaccacgtcttctgtgacctcccggcggtgctgctgctggcctgtggggaccggcagctgcaggagcgggtgctgctggcagcttgcctgctgctgctggtgctgcctctggccctgatcctgctttcctataccagggtgctggtggtcatcctgggcgttgggggatctgcgggccgccgcaaggcgttcaacacggtggcgtcgcacctcacggtggccgtgctgcactacggctgcgccacggccatgtacgccaggcccctgagcagccgctccctggaggaggacaagctggtctcgctcatctacatcaacctcacaccactgctctacccggccatctacacgctgcggaatcgcgatgtgcagggtgccctgcagcgggtgctcagcggcaggacgccagggaccgtccaccaggctgagggcaactaa

SEQ ID NO: 1984 - protein, 325 aa, Canis familiaris
MSSWPASNWTAPAEFVILGFSGWPQGLRLLLFAFLLPLYLATLAGNLLILGLAVAEPALHCPMYFFLGALSAVEVAYTLALTPRMLAGFLLPPAGLAVARSTCAAQMGLFVALGGAECLLLAAMALDRYLAICRPLYYPQLMSTALCWGLLASCCAGGSILALGLTTAIFQLPFCQGGLVNHVFCDLPAVLLLACGDRQLQERVLLAACLLLLVLPLALILLSYTRVLVVILGVGGSAGRRKAFNTVASHLTVAVLHYGCATAMYARPLSSRSLEEDKLVSLIYINLTPLLYPAIYTLRNRDVQGALQRVLSGRTPGTVHQAEGN

SEQ ID NO: 1985 - DNA, 939 bp, Canis familiaris; identical to SEQ ID NO: 18

SEQ ID NO: 1986 - protein, 312 aa, Canis familiaris; identical to SEQ ID NO: 48

SEQ ID NO: 1987 - DNA, 930 bp, Canis familiaris
atgagaggggcaaaccagtcaagtgtctccaagttcctcctcctcgggctctccaggcagccccagcagcagcagcttctctttgtcctcttcctgagcatgtacctggccaccatcctgggaaacctgctcatcctcctggccatcagcgtggactcctgcctgcacatccccatgtacttcttcctcagcaacctgtcctttgtggacatctgcttctcctccaccactgtccccaagatgctgaccaaccacttacttggcactcagaccatctccttctctggctgcctcacacagatgtacatgtttgtggacatggacaatttcctcctcgctgtgatggcctatgactgctttgtagccatatgccaccccttacactactcaacaaagatgacccaccagctctgtgccctgctggttgctgggtcgtgggtcattgccaacctggatgtcctactgcataccctggtgatggctcaactctcattctgtagagacaatgccatcccccacttcttctgtgatgcaaagcccctcctgaaactctcctgctgacacacacctcctgctgaggtgatgattctttttgaagcagggttgatcatgatcactccctttatttgcatcctggcttcatatatccgcaatacctgtgctatcctgagagtcccattcacaaagggaagatggaaagccttctccacctgtgaatcccacctggctgtggtttctctcttctatggcaccatcattactgtgtatttcaatcctttatcctcctacttagctgagacagatatagcagccactgtaatgttcagtgtggtgactcccatgctgaaccccttcatctacagcctgagaaacaaggacataaaaggggctcttggaaaagtgcttgctatgaatttttttctacttggt

SEQ ID NO: 1988 - protein, 186 aa, Canis familiaris
MRGANQSSVSKFLLLGLSRQPQQQQLLFVLFLSMYLATILGNLLILLAISVDSCLHIPMYFFLSNLSFVDICFSSTTVPKMLTNHLLGTQTISFSGCLTQMYMFVDMDNFLLAVMAYDCFVAICHPLHYSTKMTHQLCALLVAGSWVIANLDVLLHTLVMAQLSFCRDNAIPHFFCDAKPLLKLSC

SEQ ID NO: 1989 - DNA, 924 bp, Canis familiaris
ttaatgatgggaaaccagatatcagtgatagaattcattcttcttggactgacgaatgacactgagcttcaagctgtgcttttcctttttctgctgctaacttatgtcttaagcatcctgggaaacttgaccatcatcattctgacccttttggattatcgccttcagactccgatgtatttctttctccggaatttttctgttttggaaatatcttttacttctgtctttgttcccaaaatgctagtcaatattgcaactggagacaagactatctccttcgctggttgtttcactcagtatttttttgccatccttctgggggcaactgaattttatcttttagctgccatgtcctatgattgctatgctgccatttgtaaacccctgcattatacaactgtaatgagcaggaaactgtgcattcagcttgttctgtgttcctggttctctggttttttggttgtcattgtgccacatacaatgactctccaactgcctttctgtgcctccaatgtcatcaatcattgttgctgtgactataccatactgctgcatctgtcctgttaagacacacagttcatagaagtgatggagtttatctttgcagcagttaccctcatcttcaccttggtgctagtgattctttcctacacgtacataatcaggacaattctgagaatcccttctgttcaacaaagaaaaaaagccttttctacatgctcctgtcacatgattgtggtctcactttcttatggaagttgtatctttatgtacataaatccttctgttaaggatgcagaaacttttaataagagagtggctgttttaaatacctcagttgcccctctgttgaaccctttcatctatatcctaaggaaaaagcaagtgaaaatagccttcaaagacatggtcagcaagata

SEQ ID NO: 1990 - protein, 189 aa, Canis familiaris
LMMGNQISVIEFILLGLTNDTELQAVLFLFLLLTYVLSILGNLTIIILTLLDYRLQTPMYFFLRNFSVLEISFTSVFVPKMLVNIATGDKTISFAGCFTQYFFAILLGATEFYLLAAMSYDCYAAICKPLHYTTVMSRKLCIQLVLCSWFSGFLVVIVPHTMTLQLPFCASNVINHCCCDYTILLHLSC

SEQ ID NO: 1991 - DNA, 843 bp, Canis familiaris
atggaaaaccatacaactgtgacagtattgacggaggacccaaaactgaagattgtgctatttgtcttcctgctcctcacctacttgctaagcatctcaggcaacttagttattattaccctcactttgctggactcacatctcaagacccctatgtatttctttcttcgaaatgtttctttcttagaaatttcttatacgacagtctgcatccccaaattgcttgtaagcatggcaactggtgacaaaaccatttcctataactgttgtgcaactcagttgtttgccttccttcttggagcatctgaatgttacctcctggctgtcatgtcctacaatcattatgtcgccatctgcaagcccctgcattacacaaccattatgagcagcaaaatctgtatccagctagtccttagctcttggatcactggtttcctcaccatctttccaggactcattttaggcttaagcctggacttctgtgattccaatgtcattgatcatttctactgtgacactgttcccctcctgcagatctcctgcacagacagacacatgttggaaatgatgagtttcatcttagctttggtgactctgctggtcactttggcattagtaattttaaaaaattccttctgccaaccacagaaaaaagctttctccacctgttcttctcacatgattgtcatctccctctcatatggcagctgcatctatgtaccttaaaccctcaaacagaggatatccttgatgaagggagtggcagttctcaatacttctgttgctccacttttgaatccctttatttatactctaaggaaacaacaggtgaagcaagcattt

SEQ ID NO: 1992 - protein, 241 aa, Canis familiaris
MENHTTVTVLTEDPKLKIVLFVFLLLTYLLSISGNLVIITLTLLDSHLKTPMYFFLRNVSFLEISYTTVCIPKLLVSMATGDKTISYNCCATQLFAFLLGASECYLLAVMSYNHYVAICKPLHYTTIMSSKICIQLVLSSWITGFLTIFPGLILGLSLDFCDSNVIDHFYCDTVPLLQISCTDRHMLEMMSFILALVTLLVTLALVILKNSFCQPQKKAFSTCSSHMIVISLSYGSCIYVP

SEQ ID NO: 1993 - DNA, 642 bp, Canis familiaris
caattgttttttaccttccttcttggtgcatctgaattttgcttgctggcagctatgtcctatgaccgctatgttgccatttgtaagcccctgcattacacaaccatcatgagcaataagatctgcatgcaacttgtcttctgttgttggtttgctgggtcttttgtcatctttccacctctcctcttaggcttaaatgacttctatgccttcaacattgttgatcatttctactgtgctacaacccccctgctgcagatctcctgctcagacacacagctcttagagacaatgggatacatctctgctttggtgacactcatagtcacattggtaatggtgataatatcatatacctacattgtattaagaattctaaaaatcctttcagtcaatcagaggaaaaaggctttttcaacatgttcttctcacatgattgtgatatccctttcttatggcagctgcatcttcatgtatgttaagccatcagtcaaacaaagaacatcttattccaagggaattgcagtgctcaacacctctgttgctctacttttgaatcctttcatctacactttgtggaacaagcaagtaaaaacagccttcatgaacatggtacacaaaattgtttctttctcaaacaaa

SEQ ID NO: 1994 - protein, 214 aa, Canis familiaris
QLFFTFLLGASEFCLLAAMSYDRYVAICKPLHYTTIMSNKICMQLVFCCWFAGSFVIFPPLLLGLNDFYAFNIVDHFYCATTPLLQISCSDTQLLETMGYISALVTLIVTLVMVIISYTYIVLRILKILSVNQRKKAFSTCSSHMIVISLSYGSCIFMYVKPSVKQRTSYSKGIAVLNTSVALLLNPFIYTLWNKQVKTAFMNMVHKIVSFSNK

SEQ ID NO: 1995 - DNA, 909 bp, Canis familiaris
atgaaaaaccattcaacggaaatagagtttattctcataagactgacggatgacccacaattgcaagttgtgatttttgtgtttttatttcttaattacacattgagcctgatggggaacttaaccattatcctcctcactctgctggatcctcacctcaagatgccaatgtatttctttctccgtaatttctcatttttagaaatcatattcacaacggtatgtattcccagatacttgaaaaccatagtgactaaagaaaaattttttattattttactgggagttgcagagttttaccttctggctgctatgtcctatgaccactatgttgccatctctaaacccttgcattactcaatcattatgaacagcagagtgtgctattggcttgtactttcttcctggctgactggattcctaatcatctttcccctattgctcatgggactcaagctggatttctgtgcttccaaaacgattgatcactttatgtgtgaaacttcccccatcctgcagatatcctgcacagacacacatgtcctagaattgatgtctttcatattcgctgtggtgacacttgtggtcacattggtgttagtggttctctcctacactttcatcatgaagaccattatgaaattcccttctgcacagcaaaggaccaaagctttttccacctgtacttcccatatgattgttgtctccatgacatatgggagctgcatctttatgtatattaagccatctgccaaagaaagggtgactgtatccaaagatgtagctttgctgtatacctcaattgcccctttactaaatcccttcatttataccctaaggaaccagcaggtgaaagaaatattttgggatatgttacaaaaaaggttgtgtctttcaaaaaaacaattg

SEQ ID NO: 1996 - protein, 303 aa, Canis familiaris
MKNHSTEIEFILIRLTDDPQLQVVIFVFLFLNYTLSLMGNLTIILLTLLDPHLKMPMYFFLRNFSFLEIIFTTVCIPRYLKTIVTKEKFFIILLGVAEFYLLAAMSYDHYVAISKPLHYSIIMNSRVCYWLVLSSWLTGFLIIFPLLLMGLKLDFCASKTIDHFMCETSPILQISCTDTHVLELMSFIFAVVTLVVTLVLVVLSYTFIMKTIMKFPSAQQRTKAFSTCTSHMIVVSMTYGSCIFMYIKPSAKERVTVSKDVALLYTSIAPLLNPFIYTLRNQQVKEIFWDMLQKRLCLSKKQL

SEQ ID NO: 1997 - DNA, 954 bp, Canis familiaris
atggtgatcctgccctgggaaaaccaaacaaccatagtggaatttatgcttcaaggattctcctctatccgacagctaaatatctttctctttataatgtttttagttttctatgtcttagtcatttctggcaacatcctcattgttctgctagttttgttcatccatcacctccacacccccatgtacttcttcctggtgaacttgtcctttctagagatctgctatacctccaatattgtccccaagatgttactgatcaccatagctgaacagaggactatctctgttgctgggtgcatggcacagttctacttctttggatctctggctgcaacagagtgtcttctgctggctgtgatgtcctatgaccgatacctggccatctgccaacctctccactatcccatcctcatgactggccccctttgcattaggctagctgccagctcttggctctgctgcttccttcttacagcaatcactatggtcttactatctagattgaccttctgtggacctaatgaaattgatcacttcttctgtgacttcacccctctcgtccacctctcctgcacagacacctcactgacggagaccatcgcctttgccacctcttcggcagtaactctggttccgtttctcctcatcgcagcctcctactcctgcattcttattgctatcctaagaattccacctggcacaggtcggagaaaggccttctccacctgctcctcccacctcaccgtggtcacagtgttttatgggacactgattgccacgtatcttgtgccttcagccaattcttcacaactcttgcgcaaaggattctctcttctctataccatcctgacacccatgttcaaccccatcatctacagcctaagaaacagagacatccatgaagccctgaagatgtgcttgagtaagaagccaggattcctccttagatga

SEQ ID NO: 1998 - protein, 317 aa, Canis familiaris
MVILPWENQTTIVEFMLQGFSSIRQLNIFLFIMFLVFYVLVISGNILIVLLVLFIHHLHTPMYFFLVNLSFLEICYTSNIVPKMLLITIAEQRTISVAGCMAQFYFFGSLAATECLLLAVMSYDRYLAICQPLHYPILMTGPLCIRLAASSWLCCFLLTAITMVLLSRLTFCGPNEIDHFFCDFTPLVHLSCTDTSLTETIAFATSSAVTLVPFLLIAASYSCILIAILRIPPGTGRRKAFSTCSSHLTVVTVFYGTLIATYLVPSANSSQLLRKGFSLLYTILTPMFNPIIYSLRNRDIHEALKMCLSKKPGFLLR

SEQ ID NO: 1999 - DNA, 960 bp, Canis familiaris
atggatataacaaaccaaacaagagtgacagagttcatttttcttgggtttcctggtgttctacatctgcggatcaccttgtttgtgatatttcttattgtatatctgctctccctcatgggaaataccctcattattttcattgttctcatggatatcacactccaaacacctatgtacattttcttaggaaatttgtcattcctggagatctggtacaccacagccacggtacctaaattgctggacatctgcctctcacaggttgttaccatctctgtttctggttgtatcacccagtactacttctttttctctatgggagctacagagtgcatactgctggcagtgatggcctatgatcggtacctggccatctgcagtcctctccattattcactcctcatgagtattcgtatgtgcctgcggttttcagctggatcttggattgggggcttcattgcccctctcccacctaccatactcatttctcatctaaatttctgtggccctcagaagattaaccatttcttttgtgactcagaccccattttcaaactctcttgctcagatacacttttggtggagactttgggttacacatgtacctctgtcgtgattctaagttctttccttctcactatgtcctcttatggctacatagtggtcacaataatcaagctgtcttcccaaaaggcacaaaaaaaaactttctccacctgtgcctcccatctcactgtggtctctatctattatggcaccattatctttgcctatgttcaccctccagcgaagcacaacttcaccattggtaaagtgatctcagtgttttactgtgtggttacccctttggtaaaccctctcatatatacactgagaaacaaagatgtgaagacagctttcagaaaagttctagcaagaaagatattgcttttgaccacaaacatgcaaaggatttga

SEQ ID NO: 2000 - protein, 319 aa, Canis familiaris
MDITNQTRVTEFIFLGFPGVLHLRITLFVIFLIVYLLSLMGNTLIIFIVLMDITLQTPMYIFLGNLSFLEIWYTTATVPKLLDICLSQVVTISVSGCITQYYFFFSMGATECILLAVMAYDRYLAICSPLHYSLLMSIRMCLRFSAGSWIGGFIAPLPPTILISHLNFCGPQKINHFFCDSDPIFKLSCSDTLLVETLGYTCTSVVILSSFLLTMSSYGYIVVTIIKLSSQKAQKKTFSTCASHLTVVSIYYGTIIFAYVHPPAKHNFTIGKVISVFYCVVTPLVNPLIYTLRNKDVKTAFRKVLARKILLLTTNMQRI

SEQ ID NO: 2001 - DNA, 927 bp, Canis familiaris
atgaaaaacaggacgtttactgagtttattctgttgggcttcacaaatcaacctgatatccaggttgtcatattcatctttcttttcatcacctacatactaagtgtcctaggaaatttgactatcatcattctcactctagtagatcctcacctccagacccccatgtatttcttcctccggaatttctccttcttagaagtttctttcacatccatttttattcccagatttctgaccagcgtgacaacaggaaataaagtcatcagttttgctggatgcttggttcaatatttttttgctatatttcttggggcaacagagttttatctcttggcttctatgtcctatgaccgctatgttgccatatgcaaacccctgcattatctgatcattatgagcaatcgggtctgcatacaactcgtgttctgttcctggctgggaggattcctagctatcttacccccaatcatcctgatgagccaggtggatttctgtgcctccaatattctgaatcactattactgtgattatgggccccttctggagcttgcctgctcagacacaagcatcctagaagtgatggtcatcttcttggcagttgtgactctggtggttactctactgctggtgacattttcttatacgtacattatcaggaccattttgaggatcccttctgcccagcaaaggaaaaaggctttttctacttgttcttcccacatgattgtcatatccctctcttatggcagctgcatgtttatgtacattaatccctctgcaaaagaagaaggttctttcaacaaaggaatagctgtactcattacctcaattactccgttgttaaaccccttcatttatactctaagaaatcagcaagtgaagcaagcattcaaggatgctgtcaaaaagattgtgaagctttaa

SEQ ID NO: 2002 - protein, 308 aa, Canis familiaris
MKNRTFTEFILLGFTNQPDIQVVIFIFLFITYILSVLGNLTIIILTLVDPHLQTPMYFFLRNFSFLEVSFTSIFIPRFLTSVTTGNKVISFAGCLVQYFFAIFLGATEFYLLASMSYDRYVAICKPLHYLIIMSNRVCIQLVFCSWLGGFLAILPPIILMSQVDFCASNILNHYYCDYGPLLELACSDTSILEVMVIFLAVVTLVVTLLLVTFSYTYIIRTILRIPSAQQRKKAFSTCSSHMIVISLSYGSCMFMYINPSAKEEGSFNKGIAVLITSITPLLNPFIYTLRNQQVKQAFKDAVKKIVKL

SEQ ID NO: 2003 - DNA, 942 bp, Canis familiaris
atggatataacaaaccaaacaagagtgacagagttcatttttcttgggtttcctggtgttctacatctgcggatcaccttgtttgtgatatttcttactgtatatctactctccctcacaggaaacactctcattattttcattgttctcatggatatcacactccaaacgcccatgtacattttcttaggaaatttgtcattcctggagatctggtacaccacagccacggtgcctaaattgctggacacctgcctctcacaggttgttaccatctctgtttctggttgtatcacccagtactacttctttttctccatgggagctacagagtgcatcctgctggcagtgatggcctatgatcggtacctggccatctgcagccctttaagatactcacttctcatgagtattcgtgtgtgcctgcggttttcagctggatcttggattgggggcttcattgcccctctcttacctaccatactcatttctcatctaaatttctgtggcccccagaagatcagccatttcttttgtgactcagaccccattttcaaactctcctgctcagatacatttttggtggaggctttgggctacacatgtagctctgttgtgattctaagttctttccttctcaccatgtcttcctatggacacatcgtggtcacaataatcaagctgtcttccagggaggctcggaagaaaactttctccacctgtgcctcccacctcactgtggtctctatctattatggcaccattatctttgcctatgttcgccctccagccaagtacaatttcaccattggtaaagtgatatcagtgttctactgtgtggttacccctttggtaaatcctctaatatataccctgagaaacaaagatgtgaagaaagctttcagaaaagctctagcaagaaagagaatgctcttgacctga

SEQ ID NO: 2004 - protein, 313 aa, Canis familiaris
MDITNQTRVTEFIFLGFPGVLHLRITLFVIFLTVYLLSLTGNTLIIFIVLMDITLQTPMYIFLGNLSFLEIWYTTATVPKLLDTCLSQVVTISVSGCITQYYFFFSMGATECILLAVMAYDRYLAICSPLRYSLLMSIRVCLRFSAGSWIGGFIAPLLPTILISHLNFCGPQKISHFFCDSDPIFKLSCSDTFLVEALGYTCSSVVILSSFLLTMSSYGHIVVTIIKLSSREARKKTFSTCASHLTVVSIYYGTIIFAYVRPPAKYNFTIGKVISVFYCVVTPLVNPLIYTLRNKDVKKAFRKALARKRMLLT

SEQ ID NO: 2005 - DNA, 939 bp, Canis familiaris
atggatcttaaaaatggatctgtagtgactgaatttattttactaggattttctgggcaacgggaatttcatattttcttctttgtaacattcttgttaatctacagtgctactgtgtgggggaatattctcattatggtcacggtgaaatttagttccacccttcattctcccatgtacttcctccttggaaacctctcttttttagatatgtgtctttccactgtcaccacacccaaaatgatcacagacttgctcagtgaacacaaaaccatctccgtatggggctgcatgactcagatgttctttatgcacttgtttgggggtgctgagatgactcttttgatagccatggcctttgacagatatgtagccatatgtaaacccctgcactacaggacaatcatgagccacaggctgctgagtgggtttatgatactatcatggacaattggttttgtacacaccatgagccagatggttttaacagtcaacttgcctttctgtggccccaatgtcatagacaatatattctgtgaccttcctcttgtgattcagcttgcttgtatggacacatatacaatggaattctttgtcattgctgacagtgggctgctctcactcatctgttttatcctgctgcttgtctcctacactgtcatcctgatcactgtacaacaaagatcatctggaggactcaacaaggctctgtccacactgtctgcacacatcattgtggtcactctgttctttggaccttgtatctttatctatgcatggccattcaatagttttgcaggcaataaagtccttgctgtattttacaccattatcacacccttactgaatcctgttatttacacactgagaaatcagaaaatgcaaggagcaatgagaaaattatggttccaacgtgtaatttctacacagaagttttag

SEQ ID NO: 2006 - protein, 312 aa, Canis familiaris
MDLKNGSVVTEFILLGFSGQREFHIFFFVTFLLIYSATVWGNILIMVTVKFSSTLHSPMYFLLGNLSFLDMCLSTVTTPKMITDLLSEHKTISVWGCMTQMFFMHLFGGAEMTLLIAMAFDRYVAICKPLHYRTIMSHRLLSGFMILSWTIGFVHTMSQMVLTVNLPFCGPNVIDNIFCDLPLVIQLACMDTYTMEFFVIADSGLLSLICFILLLVSYTVILITVQQRSSGGLNKALSTLSAHIIVVTLFFGPCIFIYAWPFNSFAGNKVLAVFYTIITPLLNPVIYTLRNQKMQGAMRKLWFQRVISTQKF

SEQ ID NO: 2007 - DNA, 891 bp, Canis familiaris
atggaaagggcaaaccattcagtggtatctgagttcattttgctgggactttccaaatctcagaatcttcagattctgttctttgtaagattctctgtggtctatgctgggattgtgttaggaaacctaattttggtcacagtgacctttgactcatgccttcacacacaaatgtactttctgcttatcaatatgtcctgtattgatatgatcctagcttcttttgctacccctaagattattgtgggtttcctccaaaaacagaagaccatctcttgttggggatgttattctcagatgctcttcatgtacctcctaggtgggaatgagatgatgttgcttgtagccatggcagtagacaggtatattgccatatgcaaacccctccattacatgaccatcatgagcccgcaagtgcttgttgggctgctgttatcttcctacgcagttggctttgtgcactggtctagtcaaatggctttcatgttgaatttgcccttctgtgtcccagtgtggtggacagttttttctgtgaccttcctcttgtgatcaaacttgcctaccttctacaattgctggccattgctgacagtggcctcctgtccctgatctgcttcctcctcttgcttgtctcctacacgatcatcatatactcagtcaggcactatgctgcctgtggttcagccaaggccttctccactctgtcagcacacatcacagttgtcactgtcttctttgccccatgtgtctttatctatgtatggcccttcagcagatattctgtagataaaattctttccgtgttttatacaattatcaattatcacacctctcttaaatcctattatttatccattaaggaatcaagaagtaaaagagccataaagaaga

SEQ ID NO: 2008 - protein, 182 aa, Canis familiaris
MERANHSVVSEFILLGLSKSQNLQILFFVRFSVVYAGIVLGNLILVTVTFDSCLHTQMYFLLINMSCIDMILASFATPKIIVGFLQKQKTISCWGCYSQMLFMYLLGGNEMMLLVAMAVDRYIAICKPLHYMTIMSPQVLVGLLLSSYAVGFVHWSSQMAFMLNLPFCVPVWWTVFSVTFLL

SEQ ID NO: 2009 - DNA, 621 bp, Canis familiaris
atgggggcagttgagatgttcctacttataatgatggcctatgattggtatgttgcaatttgttgccctctgcactataacagtattataagtcaaggattacgctgtatgttggtagctgcctcctggatgggagggtttgtgcacactactgtccagattatcctcactatccgtttacctttttgtggaccaaacaaggtggacagcttcttttgtgatgttgttccccctgttatcaaacttgcctgcgcagacacatttgttattgaattgctaatggtatctaacagtagatagatctctaccgattcctctgtgatactgcttttttcctattccactatcctggccaagattccctccaaggagggaaggtgaaaggcactttcctcccgtggcacccacgtcatagtggtaacactcttctttggaccctgtattttcatctatgctcagcccttttccacattttctgtggacaagatggtgtctgtactctacaatgctattacacccataatgaatccccttatctacacactttggaacaaaaaagtcaagtcagccatgcaaaaactatgggacaggagtggacttagttggaaaaagcaggagaca

SEQ ID NO: 2010 - protein, 99 aa, Canis familiaris
MGAVEMFLLIMMAYDWYVAICCPLHYNSIISQGLRCMLVAASWMGGFVHTTVQIILTIRLPFCGPNKVDSFFCDVVPPVIKLACADTFVIELLMVSNSR

SEQ ID NO: 2011 - DNA, 267 bp, Canis familiaris
acagacaccatctattgaggcatggttatttgtactatttcttttcttctatgtgcccacttgggtaagcaatgttctcacttggtcacagtggcctctgataactatctgaattcatcacctatgtatttccttcttggtaacccctctttcctggacttatgttattcaacagtaactacccctgagcttttggctgactttcttgataatgagaatctcattggctatgaccaatgtattgtgtagctcttctttctgcatttt

SEQ ID NO: 2012 - protein, 36 aa, Canis familiaris
QTPSIEAWLFVLFLFFYVPTWVSNVLTWSQWPLITI

SEQ ID NO: 2013 - DNA, 819 bp, Canis familiaris
atggagggaggaaatgagatggtaacaacagatttcattctctcaggactcttccccaatgtgaagtatgtcagcatccttatctacactatcatcctgatctacctggttgccgtcactgggaacttcatcctgctttttcttatctggatatacttgaggcttcacaccccaatgtacttcctccttagtcagctttctctcgtagatctggccttcatcagtagcactgttccaaagatgataaactttctctctggaagaaaaaacatcacacatcttgcctgtggaacccagatatttttcttctttactcttggaggtgctgaatgcatcctcctgacccttatggcctatgactgatatgtatctgtctgtcaccctttgagatatgtagtgattatgaaccaaaaggtctgtctgcaaatggccttccttctgtgattgccagcaatcatgaagatctcatgcaaagacacttccacctatgagctggtggtcttcgttatgggcattgcttttatcattgtcccttttggacttatcatggcttcctacactttcatcttcctcactgttcttcatatgagatccccccaaggcaggaccaaagccttggccacatgctcatcccatcttacggtggtaagtttttatctaggaccatgtgtttatatgtacatgacacctggtttcttccacaccgttgagcaagaacaggctgtgtctgtattttgcacagtcctcacacccatgctaaatccactcatctacagcttgagaaacaaagatgtggtgggggcttttcagaaaatcctg

SEQ ID NO: 2014 - protein, 121 aa, Canis familiaris
MKISCKDTSTYELVVFVMGIAFIIVPFGLIMASYTFIFLTVLHMRSPQGRTKALATCSSHLTVVSFYLGPCVYMYMTPGFFHTVEQEQAVSVFCTVLTPMLNPLIYSLRNKDVVGAFQKIL

SEQ ID NO: 2015 - DNA, 873 bp, Canis familiaris
atgaccctgtttgtggttgtgtctgtgttttacacagtcaccctcgtgggcaacagcaccaccatactcctgtgtcacctggatccccacctccacacccccatgtacttcttcctcacccacccctccatcctggacctctgctttaccaccagctgcatccctcagatgctggtcaatttctggggttcagacaagaccataagctatctgggatgcgcagcccagctctacatcttcctgggactgggagctgcagagtgcatgctgctgctggtcatggcctttgatcgctacttggtggtgtgccgccctctgcactatgcagttattgtgaacccacctctgtgtcacaagttggtatctctggtctgggtcagtgaggtttttggcacattggtgcagtctcccactaccatgaaactccccttttgccttcatcaccaggttgacgactttgtctgtgaggttcctgcactgatacgcctggcctgtggagacacccacgtcaatgagctccagatctcggtgattggtgtcatcttcctgatggggacactgctgctcatccttgtttcatacagccacattgcccaagcagtgctggccatccagtcccaggaaggcaggagcaaggccttccacacctgctcttcccacctggcagtcgtctttctcttctactgcagggtcactgctgtctacatccaacctcggagtcacttttcaaagaagggagggaagttcctaaatcttttctacaccatggtgacccccactctcaaccccctcatctatactttgaggaacaaggacatgaagggagctttcaagaggctctttgggaaagacagaagggccagtgaagaatga

SEQ ID NO: 2016 - protein, 290 aa, Canis familiaris
MTLFVVVSVFYTVTLVGNSTTILLCHLDPHLHTPMYFFLTHPSILDLCFTTSCIPQMLVNFWGSDKTISYLGCAAQLYIFLGLGAAECMLLLVMAFDRYLVVCRPLHYAVIVNPPLCHKLVSLVWVSEVFGTLVQSPTTMKLPFCLHHQVDDFVCEVPALIRLACGDTHVNELQISVIGVIFLMGTLLLILVSYSHIAQAVLAIQSQEGRSKAFHTCSSHLAVVFLFYCRVTAVYIQPRSHFSKKGGKFLNLFYTMVTPTLNPLIYTLRNKDMKGAFKRLFGKDRRASEE

SEQ ID NO: 2017 - DNA, 960 bp, Canis familiaris
atgagaggtgaaaaccagagcttcttggggggtccccccaaggacttcatccttctaggtgtttctgacaggccatggctggaactctctctgtatgtggtcctgctggtgtcctaccttctggccatgttggggaacattgccatcatcctggtgtccagactggacccccaactccacagccctatgtacatttttctcagccacctctccttcctggacctctgttacaccaccaccactgtcccacagatgctggtcaacatgggcagcaccaggaagaccatcagcttcggtggctgcacagtacagtatgcaattttccactggctgggatgcactgagtgcattatcttggctgccatggccctggaccgctacgtagccatctgtgagccgctgcagtatgccattatcatgtaccaccctctgtgccagaagctcgtggctgtggcctggctcagtggctttggcaactcccttgttcaggtggtcctgacagtacagctgcctttctgcgggaggcaggtgctgaacaacttcttctgtgaggtgccagccatgatcaagctgtcgtgtgctgacaccaccatgaacgatgccatgctggctgtacttgtggccttcttcgtgctggtgcccctagctctcattcttctctcctatggcttcattgcacgcgcggtgctcaggatccagtcctcccggggaaggcgcaaatccttcgggacttgttcctctcacctggtggtggtctccctcttctacctgcctgccatctacatgtacttacagtccccttccagctactcccaagagcagggtaagtttatctccctcttctattccataatcacccccaccctcaatccctttatctacaccctgaggaataaggatgtgaaaagagctctaaggagactcctgtcaaggacctggaggttttgcaggaggctctga

SEQ ID NO: 2018 - protein, 319 aa, Canis familiaris
MRGENQSFLGGPPKDFILLGVSDRPWLELSLYVVLLVSYLLAMLGNIAIILVSRLDPQLHSPMYIFLSHLSFLDLCYTTTTVPQMLVNMGSTRKTISFGGCTVQYAIFHWLGCTECIILAAMALDRYVAICEPLQYAIIMYHPLCQKLVAVAWLSGFGNSLVQVVLTVQLPFCGRQVLNNFFCEVPAMIKLSCADTTMNDAMLAVLVAFFVLVPLALILLSYGFIARAVLRIQSSRGRRKSFGTCSSHLVVVSLFYLPAIYMYLQSPSSYSQEQGKFISLFYSIITPTLNPFIYTLRNKDVKRALRRLLSRTWRFCRRL

SEQ ID NO: 2019 - DNA, 228 bp, Canis familiaris
acctgtaccatagtaccccagctgctggccaatctcggggggccagagaagacaattgcttcctggggctgcatcacccaggcctatctcttccactggacaggatgcactgaatataccctgttggcagtaatggcttttgatcactatgtggctatttacaggcctctccagtacactctcatcatgcagccccaggtgtgtgtgcaactggcaggtgctgcctgg

SEQ ID NO: 2020 - protein, 76 aa, Canis familiaris
TCTIVPQLLANLGGPEKTIASWGCITQAYLFHWTGCTEYTLLAVMAFDHYVAIYRPLQYTLIMQPQVCVQLAGAAW

SEQ ID NO: 2021 - DNA, 945 bp, Canis familiaris
atggcaagagacaatgacagctaccagcaagtattcatcttggtgggcttttctgaccgtcctcaactagagataattctctttgcttttgtcttggtcttctacatcctgaccctcttgggcaacagtgccatcatcttcttgtcaatcttggatgccaggctccacacacccatgtacttctttcttgggaacctttcttttttggacctctgctttacgacgagcattgtcccccagttgctgtggaacctttggggtccagagaagaccatcacctaccatggttgtgtggcccagctctacatctacatggtgttgggctcaaccgagtgtgttctcctagctgtcatgtcctatgaccgctacgtggctgtctgccggcccctgcactacactgtgatcatgcatccacgtctctgcctgcagttggtgactgtgtcctggttctgtggctttctaaattcctttgtcatgtgtccccagaccatgcaactctcccgatgtgggcaccatatggtggaccactttctgtgtgagatgcctgctcttattgccatgtcctgtgaagacaccatgctggtggaagcatttgcctttgccctgggtgttgcccttctcctggtgcccctttccctgatcctcatctcttacagcatgattgcagccactgtgctgaggatcaagtcagcagcagggtgcaagaaagctttcaacacctgctcttcccacctgatggtggtctcccttttctacgggaccatcatctacatgtacctgcagcccgccaatagctactcccaagaccaaggcaagttcctcaccctcttctacaccatcatcactcccagtatcaaccccctgatctacacgctgaggaacaaggatgtaaagggggtgatgaggaggctcctgaagggtgagaagggggccagggaagcctaa

SEQ ID NO: 2022 - protein, 314 aa, Canis familiaris
MARDNDSYQQVFILVGFSDRPQLEIILFAFVLVFYILTLLGNSAIIFLSILDARLHTPMYFFLGNLSFLDLCFTTSIVPQLLWNLWGPEKTITYHGCVAQLYIYMVLGSTECVLLAVMSYDRYVAVCRPLHYTVIMHPRLCLQLVTVSWFCGFLNSFVMCPQTMQLSRCGHHMVDHFLCEMPALIAMSCEDTMLVEAFAFALGVALLLVPLSLILISYSMIAATVLRIKSAAGCKKAFNTCSSHLMVVSLFYGTIIYMYLQPANSYSQDQGKFLTLFYTIITPSINPLIYTLRNKDVKGVMRRLLKGEKGAREA

SEQ ID NO: 2023 - DNA, 858 bp, Canis familiaris
aaactggagatggttctgtttttcattaacatggttttttaccttctggccatcaagggcaactcgagcatcatcttcctctcagtgatggactctcgactgcacgtgcccatgtacttcttcttctgcaatctttccctcctggacatgtgctacaccactagcagcattccccagatactgatcaacctgtggggctcaagcaagaccatcacctacgtgggttgtgtcatccagctctctgccttcctgtctgtaggaggcacggagtgcattctcctgtctataatggcctatgaccgttttgtggccgtctgcaagccactgcactacatggccatcatgcacccccagctatgcctgcagctggcggcctttggatggctcagtgggatggtcaactccatcctcatgtccccactgatgatgtccctgggcctctgtggtcagcgccgcatcacccactttgtgtgtgagatgtcagccatcatccgcatctcgtgcatggacaccagacatgtggaaggcctggctttcttcctggccatccccatcgtgctagtgcctctctccacaatcctcgtgtcctacagctacattgccgtcaaggttgcgggcatccggtctgcagctggcagacgcaaggccttcaacacctgctcatcccacatggcgctggtgtccctcttctacagcagcagcatctccatgtaaatgcagcctgggaatgtagaaagccaggaccagggctagtttcttactctgttctaccgtctggcaacccccaccctgaatcctttcatctacatgctgagaaacaaagacgtgcagggggcaatgtggaaggtgctggggaga

SEQ ID NO: 2024 - protein, 237 aa, Canis familiaris
KLEMVLFFINMVFYLLAIKGNSSIIFLSVMDSRLHVPMYFFFCNLSLLDMCYTTSSIPQILINLWGSSKTITYVGCVIQLSAFLSVGGTECILLSIMAYDRFVAVCKPLHYMAIMHPQLCLQLAAFGWLSGMVNSILMSPLMMSLGLCGQRRITHFVCEMSAIIRISCMDTRHVEGLAFFLAIPIVLVPLSTILVSYSYIAVKVAGIRSAAGRRKAFNTCSSHMALVSLFYSSSISM

SEQ ID NO: 2025 - DNA, 966 bp, Canis familiaris
atgatgatgggaatagccaatgtaagttctccagaagtctttgtactcctgggcttctctgcacgaccctccctagaatccatcctcttcatcattgtcttagggttttacgtggtgtctatcttgggcaatggcatcatcattctggtttcctgcatggatgtgcacctccacacgcctatgtacttctttcttgctaacctctccttccttgacattagctttaccacaagcattgtcccacaacttctggtcaacctctggggaccacagaaaaccataagctacggagggtgtgtggtccaattctatatctcccactggctgggagcgactgaatgtgtcttcttggcagtcatgtcctacgaccgctatgctgccatctgtaggccacttaattacaccatcatcatgcatccacagctttgcctcagcttggccctcgcctcatggcttgggggtctgaccaccagcatggtgggctccacactcactatgctcctgccgctctgtgggaacaatcgcattgatcacttcttctgtgagatgcccctcattatgcaattgacttgcgtggacaccagcctcaatgaggtggagatgtatgtggccagctttatctttgttgtcttgcccctgggtctcatcctggtctcatatggccacattgcctgggctgtgatgaagatcaggtcagcagaaggacggagaaaggccttcaacacttgctcctcccatgtggcagttgtggctctattctatgggagcatcatctttatgtatctccagccagccaagagtaactcccatgaacagggcaagttcatagccctcttctacactgtgatcaccccgatgctgaatcccttgatttacacgctcaggaacaaggatgtgaagacggctctcaggcacattgtgttagagaagtgctgtggctttgcagggccatgggggcatatttag

SEQ ID NO: 2026 - protein, 321 aa, Canis familiaris
MMMGIANVSSPEVFVLLGFSARPSLESILFIIVLGFYVVSILGNGIIILVSCMDVHLHTPMYFFLANLSFLDISFTTSIVPQLLVNLWGPQKTISYGGCVVQFYISHWLGATECVFLAVMSYDRYAAICRPLNYTIIMHPQLCLSLALASWLGGLTTSMVGSTLTMLLPLCGNNRIDHFFCEMPLIMQLTCVDTSLNEVEMYVASFIFVVLPLGLILVSYGHIAWAVMKIRSAEGRRKAFNTCSSHVAVVALFYGSIIFMYLQPAKSNSHEQGKFIALFYTVITPMLNPLIYTLRNKDVKTALRHIVLEKCCGFAGPWGHI

SEQ ID NO: 2027 - DNA, 885 bp, Canis familiaris
atggaaaaggccaatgtgagctccttgatgggtttcatccttctaggcttctcagaccaccctcacctggaagctgcactctttgtatttgtcctttttttctacctcctgactcttgtggggaacctcactatcatcattatctcatacctacatcccctcctccacacccctatgtacttcttcctcagcaacctctccctgctggacctctgcttcactactagccttgcacctcagatgctagttaacctgagaggtccagagaagactatcacttatggtggttgtgtagtacaactctatatttcgctagcactgggctccactgagtgtatcctcctggctgtaatggctttggatcactatgttgccatctgcaagccccttcactatgtggctatcatgaacccaaggctatgtcaacagctggcatccatctcctggtttagtggtttggccaattcgctgatccatgctactattaccttgcaattgcctctatgtggcaaccacagactcgatcattttatttgtgaagtgccagctctcctcaagttggcttgtgtggacaccactgtcaacacaccactgtcaactattggtgcttttttggttagtgtcctgtttctcctaatacccccaacactcattcttatctcctatggctttattagtcaagctgtgctgaagataaagtcagtggaggcaaggcacaaagcctgcagcacctgctcctcccaccttacagtggtgatcattttctatggcaccataatctacatgtacctgcaaccaaggaacagctgtactcagaaccaaggcaaatttatctcccacttctataccatggtgactccaaccttaaatcctattatctacact

SEQ ID NO: 2028 - protein, 295 aa, Canis familiaris
MEKANVSSLMGFILLGFSDHPHLEAALFVFVLFFYLLTLVGNLTIIIISYLHPLLHTPMYFFLSNLSLLDLCFTTSLAPQMLVNLRGPEKTITYGGCVVQLYISLALGSTECILLAVMALDHYVAICKPLHYVAIMNPRLCQQLASISWFSGLANSLIHATITLQLPLCGNHRLDHFICEVPALLKLACVDTTVNTPLSTIGAFLVSVLFLLIPPTLILISYGFISQAVLKIKSVEARHKACSTCSSHLTVVIIFYGTIIYMYLQPRNSCTQNQGKFISHFYTMVTPTLNPIIYT

SEQ ID NO: 2029 - DNA, 960 bp, Canis familiaris
atggatataacaaaccaaacaagagtgacagagttcatttttcttgggttccctggtgttctacatctgcggatcaccttgtttgtgatatttcttattgtatatctgctctccctcgtgggaaacattcttatcattttcattgttgtgttagattccacactccaaatgcccatgtacattttcttaggaaatttgtcattcctggagatctggtacaccacagccacgatgcctaaattactggacacctgcctctcacagactgttaccatctctgtttctggttgtatcacccagtactacttctttttctccatgggagctacagagtgcatcctgctggcagtgatggcctatgatcggtacctggccatatgcagtcctctccattattcactcctcatgagtatccatatctgtctgtggttttcagctggatcttggattgggggattcacttcccctctcctgtctactatactcatctcacatctcaacttttgtgggcctcagaagattaaccatttcttttgtgactcagaccccattttcaaactctcttgctcagatacatttttggcagaggccttgagctacacatgtagctctgttgtgattctaagttctttccttctcactatgtcttcctatggacacatcatagtcacagtaatgagactgccttcccgtgaggcttggaagaaagcattatccacttgcacctcccacctcactgtggtctctatctattatggcaccattatctttgcttatgttcgccctccagccaagtacaacttcactattggtaaattaatctcagtgttctactgtgtggtcactccattgataaatcctctcatttacaccctgagaaacaaagaggtgaagaaagctttcaggaaggttctagctcaaaaaagatttctcttgttcagatacatgcaagaaatttga

SEQ ID NO: 2030 - protein, 319 aa, Canis familiaris
MDITNQTRVTEFIFLGFPGVLHLRITLFVIFLIVYLLSLVGNILIIFIVVLDSTLQMPMYIFLGNLSFLEIWYTTATMPKLLDTCLSQTVTISVSGCITQYYFFFSMGATECILLAVMAYDRYLAICSPLHYSLLMSIHICLWFSAGSWIGGFTSPLLSTILISHLNFCGPQKINHFFCDSDPIFKLSCSDTFLAEALSYTCSSVVILSSFLLTMSSYGHIIVTVMRLPSREAWKKALSTCTSHLTVVSIYYGTIIFAYVRPPAKYNFTIGKLISVFYCVVTPLINPLIYTLRNKEVKKAFRKVLAQKRFLLFRYMQEI

SEQ ID NO: 2031 - DNA, 930 bp, Canis familiaris
atgagaaaccacaccactgtcactgagtttgtcctgctagggctctcagaggcctgtgagctgcagatgctcatcttcctggcactgctcctgacctatcttgtcactctgctaggaaatctcctcattgtgagcatcaccctcatagacaggtgcctccacacccccatgtactacttcctctgcaactttgctgtcctggagatctggttcacctcggtcatcttccccaagatgctgaccaacatcctaactggaaacaagaccatttccctagcaggctgttttctacaaagtttcctctatttcttcctgggcactacagagttcttcctactagcagcgatgtcctttgacaggtatgtggccatatgtaaccccttgcgttatgccaccatcatgagcaaaagggtctgtgtccagctagttctttgttcctggatggcaggattccttctcatcatctttccaagtttcatcacttttcagcagccattttgtggccccaatgtcattaatcatttcttctgtgacaactttccactcctggagctcatatgtgcagacacaagtctgatagagcttctgggctttattgtggccaacttcagtttactgggcactctgtccgtgacaaccacctgctatggctacatcctccacagcatcctgcgcatcccttcagccaaggaaaggcagaaagccttctcaacctgctcctctcacattattgttgtgtctctcttctatggcagctgcatcttcatgtacatccgggcagggaagggtaatgagggagaggacaaaaacaaggtggtagccttgctcaataccgtggtgaccccaatgctcaatcccttcatctataccctaaggaacaaacaggtgaagcaggtgtttaggaagcaaatgagcaagctcctttcataa

SEQ ID NO: 2032 - protein, 309 aa, Canis familiaris
MRNHTTVTEFVLLGLSEACELQMLIFLALLLTYLVTLLGNLLIVSITLIDRCLHTPMYYFLCNFAVLEIWFTSVIFPKMLTNILTGNKTISLAGCFLQSFLYFFLGTTEFFLLAAMSFDRYVAICNPLRYATIMSKRVCVQLVLCSWMAGFLLIIFPSFITFQQPFCGPNVINHFFCDNFPLLELICADTSLIELLGFIVANFSLLGTLSVTTTCYGYILHSILRIPSAKERQKAFSTCSSHIIVVSLFYGSCIFMYIRAGKGNEGEDKNKVVALLNTVVTPMLNPFIYTLRNKQVKQVFRKQMSKLLS

SEQ ID NO: 2033 - DNA, 603 bp, Canis familiaris
attatttttggatgtttggacaatctgcttctgactgtgatggcttctaaccagtttgtggtcatatgttaccccctgcactatccagtcatcatgaattaccacctttgtggctttttaggtttggtatctttcttcagtcagcgtttcaggatcccagctgcacagttggatgatatcacaacttacattctgcaaaaatatagaaattcattatttctcttgtgactcttctcaccttctcaaccttggcttttctagcatccacaccaataacatattattatatttattggtgctgtattttgtagtactctattttcaatggtccttaactcttacaccttaaatagcctcttccagtattgcgagtaccatcagcagttcagaaatatggagccttctccatctgaagttctcatcagcttgcttattttatggaacaggccttgggagctgcttagtttatctcagtgttcccccagaaagggtacagtggcctccgtggtgtgtactgtgatcactcccatgctgaatcacttcatctacagcctgaggaaatgggatttcaagagtgcactgtggaggcccttcagcagaaca

SEQ ID NO: 2034 - protein, 93 aa, Canis familiaris
MVLNSYTLNSLFQYCEYHQQFRNMEPSPSEVLISLLILWNRPWELLSLSQCSPRKGTVASVVCTVITPMLNHFIYSLRKWDFKSALWRPFSRT

SEQ ID NO: 2035 - DNA, 942 bp, Canis familiaris
atggaagcacagaacatcacacaagtgttccagtttgtccttttaggattttcacagacccaggagctccagaaattcctgttcctggtgttcttatttgtctatgtcaccaccattgtgggaaacatccttatcatagttacagtgacttctgactctcggctccacacgcccatgtattttctgctccgaaatctggctgtcatagatctctgctattccacagtcacttctccaaagatgctggtggacttctttcatgaggtccggaccatctcctaccagggctgcatggcccagatcttcttctttcacctcttgggtggtgggactgtcttcttcctttcagtaatggcctatgaccgctacatagccatctcccggcccctccactatgtcaccatcatgaaccctcgattgtgtgtggggctggtggtggctgcttgggtagggggatttgttcactccattgtccagcttgctctgatgctcccgttacctttttgtggccccaacatcctggataacttctactgtgatgtcccacaactgctgagactcgcctgtactgatacctcccttctggagttcctcatgatctccaacagtgggatgttagttctcatctggttccttctccttctgatatcttacacggtcatcctggtgatgctgaggtcccactcagggcaagccaagaagaaggcagcttccacatgtaccactcacatcattgtggtgtctatgatcttcattccctgtatctatatctactcccggcccttcactcctttccccatggacaaggctgtgtccatcagctacacagttatgacccccatgctcaaccccatgatctataccctgaggaatcaggagatgcaggcagccatgaagagattaggcaagcgcctcatggtatgtaacagagagtggacttaa

SEQ ID NO: 2036 - protein, 313 aa, Canis familiaris
MEAQNITQVFQFVLLGFSQTQELQKFLFLVFLFVYVTTIVGNILIIVTVTSDSRLHTPMYFLLRNLAVIDLCYSTVTSPKMLVDFFHEVRTISYQGCMAQIFFFHLLGGGTVFFLSVMAYDRYIAISRPLHYVTIMNPRLCVGLVVAAWVGGFVHSIVQLALMLPLPFCGPNILDNFYCDVPQLLRLACTDTSLLEFLMISNSGMLVLIWFLLLLISYTVILVMLRSHSGQAKKKAASTCTTHIIVVSMIFIPCIYIYSRPFTPFPMDKAVSISYTVMTPMLNPMIYTLRNQEMQAAMKRLGKRLMVCNREWT

SEQ ID NO: 2037 - DNA, 945 bp, Canis familiaris
atggagccagagaacctcacgtgggtatcagaatttgtcttcttggggttctcccagactcgagagctccagcttttcctgtttctggtgttcttgtttgtctacaccaccactgtcgtgggaaacctcctcatcatggtcacggtgacctcagacacccggctccacacacccatgtactttctgctccgaaatctggctgtgctggacctctgtttctcctctgtcactgccccaaagatgctggtggactttctctctgagaagaagaccatctcctaccagggctgcatggcccagatcttcttctttcactttctgggaggtgccatggtcttcttcctctctgtgatggcctatgaccgcctcgttgccatctcccggcccctccactatgtcaccatcatgaacactcagctctgtgtccagctggtagtgacagcctggatggtaggttttgtgcattccattgcccaactggctctgatgctcccgctgcctttctgtggccccaacatcctggataacttctactgcgatgtcccacaagtgctgagacttgcctgcactgacacgtcccttctggagttcctcatgatctccaacagtgggctgttggatatcatctggttctttctcctcctgacctcctactctgtcatcctggtgatgctgaggtcccactctgggcaggcgaggaggaaggcagcttccacctgtaccacccacattgtcgttgtgtctatggttttcattccaagcatttacctctatgctcggcccttcacccccttctccatggacaaggctgtgtccatcagccacacggtcatgacccccatgctcaaccccatgatctacacgctgaggaaccaggaggtgcaggcagccgtgaggagactagggaggcgccggctgctttgtaaaagggatcttggacaatga

SEQ ID NO: 2038 - protein, 314 aa, Canis familiaris
MEPENLTWVSEFVFLGFSQTRELQLFLFLVFLFVYTTTVVGNLLIMVTVTSDTRLHTPMYFLLRNLAVLDLCFSSVTAPKMLVDFLSEKKTISYQGCMAQIFFFHFLGGAMVFFLSVMAYDRLVAISRPLHYVTIMNTQLCVQLVVTAWMVGFVHSIAQLALMLPLPFCGPNILDNFYCDVPQVLRLACTDTSLLEFLMISNSGLLDIIWFFLLLTSYSVILVMLRSHSGQARRKAASTCTTHIVVVSMVFIPSIYLYARPFTPFSMDKAVSISHTVMTPMLNPMIYTLRNQEVQAAVRRLGRRRLLCKRDLGQ

SEQ ID NO: 2039 - DNA, 945 bp, Canis familiaris
atggagccagagaacctcacgtgggtatcagaatttgtcttcttgggactctcccagactcgagagctccagcttttcctgtttctggtgttcttgtttgtctacaccaccactgtcgtgggaaacctcctcatcatggtcacggtgacctcagacacccgactccacacacccatgtactttctgctccgaaatctggctgtgctggacctctgtttctcctctgtcactgccccaaagatgctggtggacttcctctctgagaagaagaccatctcctaccagggctgcatggcccagatcttcttctttcactttctgggaggtgccatggtcttcttcctctctgtgatggcctatgaccgcctcgttgccatctcccggcccctccactatgtcaccatcatgaacactcagctctgtgtccgactggtggttgctgcttgggtagggggatttgtgcattccatttcccaactggctctgatgctcccgctgcctttctgtggccccaacatcctggataacttctactgcgatgtcccacaagtgctgagacttgcctgcactgacacgtcccttctggagttcctcatgatctccaacagtgggctgttggatatcatctggttctttctcctcctgatctcctactctgtcatcctggtgatgctgaggtcccactctgggcaggcgaggaggaaggcagcttccacctgtaccacccacatcgtcgttgtgtctatggttttcattccaagcatttacctctatgctcggcccttcacccccttctccatggacaaggctgtgtccatcagccacacggtcatgacccccatgctcaaccccatgatctacacgctgaggaaccaggaggtgcaggcagccgtgaggagactagggaggcgccggctgctttgtaaaagggatcttggacaatga

SEQ ID NO: 2040 - protein, 314 aa, Canis familiaris
MEPENLTWVSEFVFLGLSQTRELQLFLFLVFLFVYTTTVVGNLLIMVTVTSDTRLHTPMYFLLRNLAVLDLCFSSVTAPKMLVDFLSEKKTISYQGCMAQIFFFHFLGGAMVFFLSVMAYDRLVAISRPLHYVTIMNTQLCVRLVVAAWVGGFVHSISQLALMLPLPFCGPNILDNFYCDVPQVLRLACTDTSLLEFLMISNSGLLDIIWFFLLLISYSVILVMLRSHSGQARRKAASTCTTHIVVVSMVFIPSIYLYARPFTPFSMDKAVSISHTVMTPMLNPMIYTLRNQEVQAAVRRLGRRRLLCKRDLGQ

SEQ ID NO: 2041 - DNA, 948 bp, Canis familiaris
atggacccagaatccagaaccaatggaacaactgttactgagttcatcctgctgggcttggtggagacaccagggctacaaccagttgtctttgtagtcttcctctttgcctacctggtcacagtcggaggcaacctcagcatcctggctgccatcttggtggaacccaaactccacacacccatgtacttcttcctggggaacctgtcagtgctagatgttgggtgcatcactgtcactgttccctcaatgttggctcgcctcttgtcccacaaacgtacagttccctacagagcctgcctcacacaaattttcttcttccatctcttggctggtgtggactgcttcctgttgacagccatggcctatgaccgattcctggccatctgccggcccctcacctacagcacccggatgagtcagacagtccagaaaatattggtagctgtgtcctgggctttagccttcaccaatgcactgacccacacagtagccatagccacactcaacttttgtggtcctaatgtgatcaaccacttctactgcgacctcccacagctcttccagctctcctgctccagcactcagctcaatgagctgctgctctttgctgtgggtttcataatggcaggtacccccttggctctcatcatcacttcctatgcacatgtggcagctgcagtcctacgaatccgctctgctgagggcaggaagaaagctttctccacatgtggctcccacctcacagtggttggcatattctatgggacaggtgtcttcagctacatgaggctgggctcagtggaggcctcagacaaggacaaagggattggtatcctcaacactgtcatcagccccatgctgaacccactcatctatagcctccggaacccggatgtgcagggggctctgtggcaggtgctcacagggaagcgagcccttgcatga

SEQ ID NO: 2042 - protein, 315 aa, Canis familiaris
MDPESRTNGTTVTEFILLGLVETPGLQPVVFVVFLFAYLVTVGGNLSILAAILVEPKLHTPMYFFLGNLSVLDVGCITVTVPSMLARLLSHKRTVPYRACLTQIFFFHLLAGVDCFLLTAMAYDRFLAICRPLTYSTRMSQTVQKILVAVSWALAFTNALTHTVAIATLNFCGPNVINHFYCDLPQLFQLSCSSTQLNELLLFAVGFIMAGTPLALIITSYAHVAAAVLRIRSAEGRKKAFSTCGSHLTVVGIFYGTGVFSYMRLGSVEASDKDKGIGILNTVISPMLNPLIYSLRNPDVQGALWQVLTGKRALA

SEQ ID NO: 2043 - DNA, 948 bp, Canis familiaris
atggagccaagtgcctgggggaacaggacaactgtcactgagttcatccttcttggcctgacagaaaacataagactgcaacccatcctttttgttgtcttccttgttgcctatttaatcactgttggaggcaacctcagcatcctggctgccatctttgtggagcccaaactccacacacccatgtactacttcctggggaatctgtctctgctggacattggatgcatcactgtcaccgtccctccaatgctagcatgtctcctggcccaccagtgtagagttccctatgctgcctgcatttcacagctcttctttttccacctcctggctggtgttgactgtcacctcctgacagccatggcctatgaccgctacctggccatctgtcagcccctcacctacagcacccgcatgagccgtgaagtccagggtgccttggtgggcatttgctgcaccatttcctttatcaatgctttgactcatacagtggctatatctgtgcttgacttctgtggccctaatgtgatcaaccacttctactgcgacctcccacccctattccagctctcctgctccagcatccacctcaatgggaagctgctttttgtgggagccactttcatgggagtgttccccatgatcctcatctcagtgtcttatgctcacgttacagctgcagtgctacgaatccgctcagcagaggggaggaagaaggccttctctacatgtgggtctcacctcaccgtggtttgtatcttttatggaactggcttcttcagttatatgcgtctgggctcagcgtcagtttcagataaggacaaggggattgggatcctcaatactatccttagccccatgctgaatccagtcatctatagcctccggaaccctgatgtgcagggggccctgaaaagagtgctgatggggaagcagccccctgagtga

SEQ ID NO: 2044 - protein, 315 aa, Canis familiaris
MEPSAWGNRTTVTEFILLGLTENIRLQPILFVVFLVAYLITVGGNLSILAAIFVEPKLHTPMYYFLGNLSLLDIGCITVTVPPMLACLLAHQCRVPYAACISQLFFFHLLAGVDCHLLTAMAYDRYLAICQPLTYSTRMSREVQGALVGICCTISFINALTHTVAISVLDFCGPNVINHFYCDLPPLFQLSCSSIHLNGKLLFVGATFMGVFPMILISVSYAHVTAAVLRIRSAEGRKKAFSTCGSHLTVVCIFYGTGFFSYMRLGSASVSDKDKGIGILNTILSPMLNPVIYSLRNPDVQGALKRVLMGKQPPE

SEQ ID NO: 2045 - DNA, 387 bp, Canis familiaris
atgacaggagggaaccagaccaacatctttgatttcctcctctggggactctcagagtggccagaacagcaacacatcctcttcctgctgttcctgcaaatatacatggtcactgtggctggaaacctgctcatttttctggccattgacactgatgcacatctccacatgcccatgtactacttcttcaccagctgtgcagacatccttttcacctccgctactgtgcccaaggccctggtgaatatccagactcagaacaggttcatttcctacacaggcttcctggttcagctctacttcttgactgcaagaaacatagacatttttctcctggccacagtggcctatgaattctacatggccatctaccaccctctccactac

SEQ ID NO: 2046 - protein, 129 aa, Canis familiaris
MTGGNQTNIFDFLLWGLSEWPEQQHILFLLFLQIYMVTVAGNLLIFLAIDTDAHLHMPMYYFFTSCADILFTSATVPKALVNIQTQNRFISYTGFLVQLYFLTARNIDIFLLATVAYEFYMAIYHPLHY

SEQ ID NO: 2047 - DNA, 945 bp, Canis familiaris
atggccccgggcaatgccacggcagccgccgagttcctcctcctgggcctgctggatggagccgacgtccacccgctgctcttcctgcttttcctcggtgtctacttgctcaacgcgctgggcaacctgaccatggtggtggtggtgaggtgggatgaggccctccgctgccccatgtactacttcttgggccacctaagcctcgtggacgtgtgcttcgctagcgtcacgctccccaggctgctggccggcctgctccacccgggccaggccgtgtccttccagggatgctttgcccagatgtacttcttcgtggccctgggcatcacggagagctacctgctggcagccatggcctacgaccgcgcggtggccgtctgccggccgctgcactaccgggcggtgctgacgccggggcgctgcgccgcgctggtggccgcgtcctgggcggtggcccacctgcactcgctgctgcacacgctgctcatctccgcgctctcctacccgcgccccgccgccgtgcgccacttcttctgcgacatgacggtgatgctgagcttggcgacctcggacacggcggccgcggagactgccgtcttctccgagggcctggccgtggtgctcaccccgctgctcctcgtgtcgctctcctacgcgcgcatcctcggcgcggtgctgggactgcggtcggccgggggccggcgccgcgccttctccacctgcggggcccacctggtggtggtgtcgctcttcttcggctctgtcctttccgtctacttccggccctcgtccgcctactcagcgcgctacgaccgcctggccagcgtggtctatgcggtgctcacacccaccttgaaccctttcatctacagccttcgcaacagggaggtcaagggcgccctgaaaaggggactcgggtggagggctgcgtcccaagacttgtga

SEQ ID NO: 2048 - protein, 314 aa, Canis familiaris
MAPGNATAAAEFLLLGLLDGADVHPLLFLLFLGVYLLNALGNLTMVVVVRWDEALRCPMYYFLGHLSLVDVCFASVTLPRLLAGLLHPGQAVSFQGCFAQMYFFVALGITESYLLAAMAYDRAVAVCRPLHYRAVLTPGRCAALVAASWAVAHLHSLLHTLLISALSYPRPAAVRHFFCDMTVMLSLATSDTAAAETAVFSEGLAVVLTPLLLVSLSYARILGAVLGLRSAGGRRRAFSTCGAHLVVVSLFFGSVLSVYFRPSSAYSARYDRLASVVYAVLTPTLNPFIYSLRNREVKGALKRGLGWRAASQDL

SEQ ID NO: 2049 - DNA, 948 bp, Canis familiaris
atgaaaatgggcaaccgaactgtcatctcagaattcatcctgctgggcctgcccattgatccagatcagcgagacctgttctacgccctgttcctggccatgtatgttaccaccatcctggggaacctactcatcattgtcctcattcacctggactcgcacctccacacacccatgtatttgtttctcagcaatttatccttctctgacctctgcttctcttctgtcacaatgcccaagttgctgcagaacatgcagagccaagtcccgtccatcccctatgctggctgcctgacccaaatgtacttcttcctgttttttgcagacctggagagcttcctcctggtggccatggcctatgaccgctatgtggccatctgcttccccctgcactacaccaccatcatgagccccaagctctgtttctccttgttgatgctgtcctgggtgctgaccacttttatctctcttttgcacaccctactcatggctcggctatctttctgtgctgataatgtgatccctcactttttctgtgacatgtcagctctgctaaagttggcctgctctgacattctgataaatgaaatggtgatatttgtcttgggagggctcatcatttttgttccgtttctgttgatctctttatcctatgcatggattgtgtcctccatcctcaaagtcccttctgctaggggcatctgcaaggccttctccacctgtggctcccacctctcagtggtgtctctcttctatgggacaatcattggtctctacttgtgcccctcagctaataattctaccgttaaggagactatcatggctgttatgtacactgtgattacccccatgctgaatccctttatttacagcctgaggaatcaggacataaaaggagccttgggaagagtcttttcaaagtggacaattcagctttctttgggatag

SEQ ID NO: 2050 - protein, 315 aa, Canis familiaris
MKMGNRTVISEFILLGLPIDPDQRDLFYALFLAMYVTTILGNLLIIVLIHLDSHLHTPMYLFLSNLSFSDLCFSSVTMPKLLQNMQSQVPSIPYAGCLTQMYFFLFFADLESFLLVAMAYDRYVAICFPLHYTTIMSPKLCFSLLMLSWVLTTFISLLHTLLMARLSFCADNVIPHFFCDMSALLKLACSDILINEMVIFVLGGLIIFVPFLLISLSYAWIVSSILKVPSARGICKAFSTCGSHLSVVSLFYGTIIGLYLCPSANNSTVKETIMAVMYTVITPMLNPFIYSLRNQDIKGALGRVFSKWTIQLSLG

SEQ ID NO: 2051 - DNA, 942 bp, Canis familiaris
atgacagaaaagaatcaaactgtcgtctcagaatttgtcctccttggcctgcccattgatccagatcagcgagacctgttctacgccctgttcctggccatgtatgttaccacaatcctggggaacctactcatcattgtcctcattcagctggactcgcacctccacacacccatgtatttgtttctcagcaatttatccttctctgacctctgcttctcttctgtcacaatgcccaagttgctgcagaacatgcagagccaagtcccgtccatcccctatgctggctgcctgacccaaatgtacttcttcctgttttttggagatctggagagcttcctcctggtggccatggcctatgaccgctatgtggccatctgcttccccctacactacaccaccatcatgagccccaagctctgtttctccctgttggtgctgtcatgggtgctgaccatgttccatgctgtattacacactctgttaatggccagattgtgtttttgtgccaacacaatcccccactttttttgtgatatgtctgctctgctgaagctggcctgctctgacactcaagttaatgagttggtgatatttatcatgggagggctcattctcgtgatcccattcctgctcatcatcacgtcttatgcacggattgtgtcctccatcctcaaggttccttctgccataggcatctgcaaggtcttctccacctgtggctcccacctctcagtggtgtctctcttctatgggacagttattggtctctatttatgcccatcagctaataattctactgttaaggagactatcatggctatgatgtacactgtggtcacccccatgctgaaccccttcatctacagcctgaggaataaagacatgaagggagccctgagaagagtcatttgtagaaagaaaattaccttctctgtgtga

SEQ ID NO: 2052 - protein, 313 aa, Canis familiaris
MTEKNQTVVSEFVLLGLPIDPDQRDLFYALFLAMYVTTILGNLLIIVLIQLDSHLHTPMYLFLSNLSFSDLCFSSVTMPKLLQNMQSQVPSIPYAGCLTQMYFFLFFGDLESFLLVAMAYDRYVAICFPLHYTTIMSPKLCFSLLVLSWVLTMFHAVLHTLLMARLCFCANTIPHFFCDMSALLKLACSDTQVNELVIFIMGGLILVIPFLLIITSYARIVSSILKVPSAIGICKVFSTCGSHLSVVSLFYGTVIGLYLCPSANNSTVKETIMAMMYTVVTPMLNPFIYSLRNKDMKGALRRVICRKKITFSV

SEQ ID NO: 2053 - DNA, 909 bp, Canis familiaris
atgcatggaagcaaccagagtgaggccacggagttcccactcctggggatctcagagagtcctaaagagcagcagatcttgttctggatgctcttgtccatgtacctggtcacagtggtgggaaatgtgctcatcattctggccattggctctaactctcacctacacactcccatgtatttattcttagccaacctctccttcacagacctcttctttgtcaccaatataaaacccaagacattagtgagcctccagtctcagaacaaagccatctcctatgcaggatgtctgacacagctctacttcctggtctccttggtgaccctggacaacttcatcttggccacaatggcatatgaccgctatgtagccatctgccgccccctccactacaccacagccatgagccctggactctgtattttgctcctcgccttgtgctgggcactttctgccctctgtggccttttcctcacgctcttcatgaccaaggtgacattctgtggatcccggaagatccactacatcttctgtgagatgtatatcctgctgaggcttgcatgttccaacacccagatcattcacacagtgcagattaccacaggctgcttcatcttcttcaccccactagggttcatgataatgtcctatgtctggattgtcagagccatcctccaaatactctcagcctctagcaagtacaaagctttctccacctgtgcctcccatttggctgtagtctccctcttctatgggacactttgtatggtatatctgcagcctctccaaacctactccatgaaggactcagtagctacagtgatgcatgctgtggtgaccctcatgatgaaccctttcatctacagcctgaggaacaaggacatgcatggggctctgggaagactg

SEQ ID NO: 2054 - protein, 303 aa, Canis familiaris
MHGSNQSEATEFPLLGISESPKEQQILFWMLLSMYLVTVVGNVLIILAIGSNSHLHTPMYLFLANLSFTDLFFVTNIKPKTLVSLQSQNKAISYAGCLTQLYFLVSLVTLDNFILATMAYDRYVAICRPLHYTTAMSPGLCILLLALCWALSALCGLFLTLFMTKVTFCGSRKIHYIFCEMYILLRLACSNTQIIHTVQITTGCFIFFTPLGFMIMSYVWIVRAILQILSASSKYKAFSTCASHLAVVSLFYGTLCMVYLQPLQTYSMKDSVATVMHAVVTLMMNPFIYSLRNKDMHGALGRL

SEQ ID NO: 2055 - DNA, 912 bp, Canis familiaris
atggatgaaagcaaccaaactatagtctctgagttcctgctcctggggctctctgagagtcctgagcagcagcgggtccagttctggatgttcctgtccatgtacctggtcacagtggtaggaaatgtgctcatcatcctggccatcagctttgatccccgcctgcacactcccatgtacttcttcctggccaacctctccttcactgacctcttcttcgtcaccaatacaacaatacccaagatgctggtgagcctccagtctcagaacaaagccatctcctatgcagggtgtctgacacagctttacttcctggtctccttggtggccctggacaacctcatcctggccacaatggcatatgaccgctatgtggccatctgccgccccctccactacaccacagccatgagccctggactctgtattttgctcctcgccttgtgttgggcactttctgccctctatggcctcacccacaccctcctaatgaccagagtgacattctgtggatcccggaagatccactacatcttctgtgagatgtatgtcctgctgaggcttgcatgctccaacacccaagtaaatcatacagtgctgattgctacaggatctttcatcttcctcgccccactagggttcacgataatgtcctatgtctggattgtcagagccatcctccgaataccctcagcctctagcaagtacaaagccttctccacctgtgcctcccatttggctgtagtctccctcttctatgggacactttgtatggtatatctgcagcctctccacacctactccatgaaggactcagtagccacagtgatgtatgctgtggtgacccccatgatgaaccctttcatctacagcctgagaaacaaggacatgcatggggctctgggaagactg

SEQ ID NO: 2056 - protein, 304 aa, Canis familiaris
MDESNQTIVSEFLLLGLSESPEQQRVQFWMFLSMYLVTVVGNVLIILAISFDPRLHTPMYFFLANLSFTDLFFVTNTTIPKMLVSLQSQNKAISYAGCLTQLYFLVSLVALDNLILATMAYDRYVAICRPLHYTTAMSPGLCILLLALCWALSALYGLTHTLLMTRVTFCGSRKIHYIFCEMYVLLRLACSNTQVNHTVLIATGSFIFLAPLGFTIMSYVWIVRAILRIPSASSKYKAFSTCASHLAVVSLFYGTLCMVYLQPLHTYSMKDSVATVMYAVVTPMMNPFIYSLRNKDMHGALGRL

SEQ ID NO: 2057 - DNA, 852 bp, Canis familiaris
gagcaacaacaggtccagttctggatgttcctgtccaggtccctggttacaggggtgggaaatgtgttcatcatcctggccattggctctgatccctgcctgcacactcctatgtactccctcctggccaacttctccttcacagacctcttctttgtcaccaatacaatacccaagatgctggcaaaccttcagtctcagaacaaagccatctcctatgcagggtgcctaacacagctctacttcttggtctccctggtgacactggacaacctcattctggccacaatggcatatgaccactatgtggccatctgccgccccctccactatgtcacagccatgagccctggactctctattttgttcctcaccttgtgttgggcactttctgtcatctgtggccttacccacaccctccttctgaccagagtgaccttctttggttcctggaagatccgctacatcttctgtgagatgtgtgtcatgctaaggttggcctattccaacacccagagcattcacatactgctgattaccacaggcatctttatcttcctgacccccttagggtttgtgatcatgtcctatgtccacactgtcaaagccatcctctgaatgccctcagcctctagcaagtactaagccttctccacttgtgcccccccccccaatttggctgtagtctccctcttctatgggacacttggtatggtatatctgcagcccctccacacctactccatgaaggactcagtagccacaatgatgtatgctgtggtgacccccatgatgaaccctttcatctacagcctgaagaacaaggacatgcatggggctctgggaagactg

SEQ ID NO: 2058 - protein, 205 aa, Canis familiaris
EQQQVQFWMFLSRSLVTGVGNVFIILAIGSDPCLHTPMYSLLANFSFTDLFFVTNTIPKMLANLQSQNKAISYAGCLTQLYFLVSLVTLDNLILATMAYDHYVAICRPLHYVTAMSPGLSILFLTLCWALSVICGLTHTLLLTRVTFFGSWKIRYIFCEMCVMLRLAYSNTQSIHILLITTGIFIFLTPLGFVIMSYVHTVKAIL

SEQ ID NO: 2059 - DNA, 930 bp, Canis familiaris
atgagggaagacaaccaatcctctaccctggaattcatcctcctgggagttactggtcagcaggaccaggaagactttttctttaccctcttcctgttcatttaccccatcacgttgattggaaacttgctcatcatcttggccattcgctctgatgttcgccttcacaatcccatgtactttttccttgccaacctctcctttgttgacatcctcttctcttctgtaaccatccctaaaatgctggcaaatcatctcttgcacagcaaagccatctcctttggtggatgcctaacacagttgtattttatgattgccttgggcaacacagatagctatatcttggctgcaatggcatatgatcgtgcggtggccatcagtcgcccacttcattacacaacaatcatgagcccatggacttgtgtcctcctagttgttgggtcttgggtggttggtaatgccaatgccctcccccacactctgctcacagccaggctgtccttctgtggcaacaaggaagtagccaacttctactgtgatattacccctttgcttaagctgtcctgttctgacatcctctttaatgtgaggatgatgtacctaggggttggtgtcttctctgtgccattactatgcatcattatctcctatgtccaggtcttttccacagtcttacgggtcccatctaccaaaggtgtgctcaaggccttctctacctgtggttcccacctcacagttgtttttctgtattatgggacagtcatgggcatgtatttccgccctctgtctagttacagcctaaaggatgcaatcataactgttatgtacatggcagtgaccccaatgttaaatcctttcatttatagtttgagaaaccgagacatgaaggctgccctggggatactattatgcaagagaatctccttataa

SEQ ID NO: 2060 - protein, 309 aa, Canis familiaris
MREDNQSSTLEFILLGVTGQQDQEDFFFTLFLFIYPITLIGNLLIILAIRSDVRLHNPMYFFLANLSFVDILFSSVTIPKMLANHLLHSKAISFGGCLTQLYFMIALGNTDSYILAAMAYDRAVAISRPLHYTTIMSPWTCVLLVVGSWVVGNANALPHTLLTARLSFCGNKEVANFYCDITPLLKLSCSDILFNVRMMYLGVGVFSVPLLCIIISYVQVFSTVLRVPSTKGVLKAFSTCGSHLTVVFLYYGTVMGMYFRPLSSYSLKDAIITVMYMAVTPMLNPFIYSLRNRDMKAALGILLCKRISL

SEQ ID NO: 2061 - DNA, 897 bp, Canis familiaris
atgggaggagacaatgagtcctttacccttggtttcatcctcctgggagttagtagacagtaaaaatagtaagacttcttcttcatcctcttcctcttcatttaccccatcacattgattggaaaactgctcatcatcttggccattcgttctgacattcgccttcacaaccctatgtattttttccttgccaatctctcctttgttgacatcctcttctcttctgtaaccatccctaaaatgttagccaaccatgtcttagggagcaaagccatctgctttgggggatgcctaacacaaatgtgtttcatgttagccttgggtttcacagatagttatatccaggcttcaatggcttatgatgatgcggtggccatcagtcatcctcttcattatataatgattatgagcctatggacttgtgtcctcctagttgttgggtcttaggtagttgaaaatgccaatgccctcccccacactctgctcacagctagtatgcccttctgtgacaaccagaaagtagccaacttctactgtgacattgtctcttgactcaagctatcctgttctgacacccacttaaatgtgaggatgatatacctaggggttggtgttttttctgtgccattactatgtatcatcatctcctaagtctgagtcttttccacagacttgcaggttccatccaggaagggagtgctcaaggccttctcctgtggttcccacctcacaattgtttccctgtattatgggacagttatgagcatgtatttctaccttctgactagttatggcctaaaagatgaagtgataactgtgatgtgcatcacagtgcccccagtgttaaatcctttcatttatagtctgagaaaccaagacatgaagtctgccctgggg

SEQ ID NO: 2062 - protein, 46 aa, Canis familiaris
MSMYFYLLTSYGLKDEVITVMCITVPPVLNPFIYSLRNQDMKSALG

SEQ ID NO: 2063 - DNA, 954 bp, Canis familiaris
atggaaagagggaaccagaccagcagctttgagttcctcctctggggactctcagagcggccagagcagcagaatatccttttcctgctgttcctgtggatatatgtgatcactgtggctggaaacctgctcattgtcctggccattggtactgatgcacgcctccacacacctatgtacttcttccttgccagcctttcctgtgcagacatccttttcacctccaccactgtgcccaaggccttggttaacatccagacccagagcaggtccatttcctacacgggatgcctggttcagctctacttcttcttgacttttggggacatggacatctttctcctggccacaatggcctatgaccgctatgtggccatctgccaccctctccactacaagatgatcatgagccgccggcgctgcaccctcctggttactgcttgctggatccttacaagtcttgttgccatgacccacactttcctcatctttcgacttaatttttgctctaagaaaatcattcctgacttcttctgtgatctgggacccctgatgaaggtgtcttgctctgacactcaagtcaatgagcttgtgctcctcttcttggggggagcagtcattttaatccccttcattctcatcctggtctcttatatgcacatcgtttcagccatcctcagagtcccctccgcccagggaaggtacaaggccttctctacctgtgggtcacaccttgctgttgttgctctgttctttgggacagtgatcagggcttatctgtgtccttcatcatcttcctccaactccatagaagaggatacagcagctgctgtcatgtacacagtggtaactcccctgctgaaccccttcatttatagcctgcggaacaaagacatgaagtgcgccttggggagatttctcagaggcaaagtcttcttttcatggggccagtga

SEQ ID NO: 2064 - protein, 317 aa, Canis familiaris
MERGNQTSSFEFLLWGLSERPEQQNILFLLFLWIYVITVAGNLLIVLAIGTDARLHTPMYFFLASLSCADILFTSTTVPKALVNIQTQSRSISYTGCLVQLYFFLTFGDMDIFLLATMAYDRYVAICHPLHYKMIMSRRRCTLLVTACWILTSLVAMTHTFLIFRLNFCSKKIIPDFFCDLGPLMKVSCSDTQVNELVLLFLGGAVILIPFILILVSYMHIVSAILRVPSAQGRYKAFSTCGSHLAVVALFFGTVIRAYLCPSSSSSNSIEEDTAAAVMYTVVTPLLNPFIYSLRNKDMKCALGRFLRGKVFFSWGQ

SEQ ID NO: 2065 - DNA, 897 bp, Canis familiaris
aacaatagtggagtctctgagttcctgctcctggggatttctgagagtcctgagcagcagcgggtccagttctggatgttcctgtccatgtacctggtcacagtggtgggaaatgtgctcatcatcctggccatcagctttgatccccgcctgcacgctcccatgtacttcttcctggccaacctttccttcactgacctcttctttgtcaccaatacaatacccaagatgctggtgagcctccagtctcagaacaaagccatctcctatgcagggtgtctgacacagctttacttcctggtctccttggtggccctggacaacctcatcctggccacaatggcatatgaccgctatgtggccatctgccgccccctccactacaccacagccatgagccctggactctgtattttgctcctcgccttgtgttgggcactttctgccctctatggcctcacccacaccctcctcatgaccagagtgacattttgtggatcccggaagatccactacatcttctgtgagatgtatgttctgctgaggctcgcatgttccaacactcaagtcaatcacacagtgctgattgccacaggctgctttatcttcctcacccccttagggttcatgataatgtcctatgtctgaattgtcagagccatcctccgaataccctcagccactgggaagtacaaagccttctccacctgtgcctcccatttggctgtagtctccctcttctatgggacacttggtatggtatatctgcagcccctccagacctactccatgaaggactcagtagccacagtgatgtatgctgtggtgacccccatgatgaaccctttcatctacagcctgaggaacaaggacatgcatggggctctgggaagactg

SEQ ID NO: 2066 - protein, 215 aa, Canis familiaris
NNSGVSEFLLLGISESPEQQRVQFWMFLSMYLVTVVGNVLIILAISFDPRLHAPMYFFLANLSFTDLFFVTNTIPKMLVSLQSQNKAISYAGCLTQLYFLVSLVALDNLILATMAYDRYVAICRPLHYTTAMSPGLCILLLALCWALSALYGLTHTLLMTRVTFCGSRKIHYIFCEMYVLLRLACSNTQVNHTVLIATGCFIFLTPLGFMIMSYV

SEQ ID NO: 2067 - DNA, 948 bp, Canis familiaris
atggatccagaagttggagccaacaggacatctgttactgagttcattctagtgggcctagtggaaacagaacagctacagtctgtggtctttgtagtcttcctctttgcctacctggtcacagtcggaggcaacctcagcatcctggctgccatcttggtggaacccaaactccacacacccatgtacttcttcctggggaacctgtcagtgctggatgttgggtgcatcactgtcactgttccctcaatgttggctcgcctcctgtcccacaaacgtacagttccctacagggcctgcctcacacagcttttcttctttcaccttctggctgggatggactgcttcctgttgactgtcatggcctatgaccgattcctggccatttgccgacccctcacctacaacacccacatgagccagaacgtccagagaatattggtagctgtgtcctgggctttaggtttcaccaatgcactaaatcacactattgccctaactaccctcaacttctgtggtcctaatatagtcaataacttctactgtgacctcccacagctcttccagctctcttgctctagcacccagctcaacgagttgctgctctttgtggcagcagccttcatggctgtagcccccttggtcctcatcactgtgtcctatgcacaggtggcagctgcagttctacaaattcgttcagtggaaggcaggaataaggccttttccacatgtggctcccacctcactgtggtttgccttttctatggtactggtatcttcaactacatgtgtcttggttctgaagagtcttcagacaaggataaaggggttggggtcttcaacactgttatcaatcccatgctgaacccacttatctacagccttagaaaccctgatgttcaggatgccctgtggcgggtatttgtggggaggaagtcattgacctaa

SEQ ID NO: 2068 - protein, 315 aa, Canis familiaris
MDPEVGANRTSVTEFILVGLVETEQLQSVVFVVFLFAYLVTVGGNLSILAAILVEPKLHTPMYFFLGNLSVLDVGCITVTVPSMLARLLSHKRTVPYRACLTQLFFFHLLAGMDCFLLTVMAYDRFLAICRPLTYNTHMSQNVQRILVAVSWALGFTNALNHTIALTTLNFCGPNIVNNFYCDLPQLFQLSCSSTQLNELLLFVAAAFMAVAPLVLITVSYAQVAAAVLQIRSVEGRNKAFSTCGSHLTVVCLFYGTGIFNYMCLGSEESSDKDKGVGVFNTVINPMLNPLIYSLRNPDVQDALWRVFVGRKSLT

SEQ ID NO: 2069 - DNA, 948 bp, Canis familiaris; identical to SEQ ID NO: 11

SEQ ID NO: 2070 - protein, 315 aa, Canis familiaris; identical to SEQ ID NO: 41

SEQ ID NO: 2071 - DNA, 951 bp, Canis familiaris
atggatgctgccaatgagtcctcagagggagccccgttcatcctattgggattgacaacaagtcctggacagcagcagcctctctttgtgctattcttggccctgtatgtggcaggtatcctgggtaatggactcattgtggctgccatccaggccagcccagcccttcatgcacccatgtacttcctgctggcccatctgtcctttgccgacctctgctttacctctgtcactgtgcccaaaatgttggccaacttgttggcccacgaccgctccatctccctggcgggctgcctgacccagatgtacttcttctttgccctgggtgtaactgacagctgtctcctggccgccatggcctatgaccgctatgtggccatccggcaccccctccactatgccacaagaatgtcccgggctatgtgcacagccctggtggggactgcatggctggtgtcccacctccactccctcctgcatatcctgtttatggcccgcctgtccttctgtgcctcccaccaagtgccgcacttcttctgtgatcaccagcctattcttaggctctcttgctctgacatccgccacatccagctgctcatcttcactgagggcgccgcagtggtggtcactcccttcctgctaattcttgcctcctatggggccatcgcagctgcagtgctccggctgccctcagcctctgggaggctccgcgctgtgtccacttgtggctcccacctggcagtggtgggcctcttctatgggacagtcattgcggtctacttccagcccacatcccggtatgaggcagagcggggccgtgtggccactgtcatgtacactgtagtcacccctatgctaaaccctgttatctacagcttccggaaccgcgacatgcagggggcgctccgatcacttttcactggaagaaggatctcctctagtgactcctaa

SEQ ID NO: 2072 - protein, 316 aa, Canis familiaris
MDAANESSEGAPFILLGLTTSPGQQQPLFVLFLALYVAGILGNGLIVAAIQASPALHAPMYFLLAHLSFADLCFTSVTVPKMLANLLAHDRSISLAGCLTQMYFFFALGVTDSCLLAAMAYDRYVAIRHPLHYATRMSRAMCTALVGTAWLVSHLHSLLHILFMARLSFCASHQVPHFFCDHQPILRLSCSDIRHIQLLIFTEGAAVVVTPFLLILASYGAIAAAVLRLPSASGRLRAVSTCGSHLAVVGLFYGTVIAVYFQPTSRYEAERGRVATVMYTVVTPMLNPVIYSFRNRDMQGALRSLFTGRRISSSDS

SEQ ID NO: 2073 - DNA, 960 bp, Canis familiaris
atgactacagagaacttcacctggaccagggttactcctactgaattcatcctcctgggcatcacggatcgctgggacctacgagtgaccctcttcctgattttcctgccagtctacctggtcagcctgctgggaaatgtgggcatggtgctgctgatccgtatggatgcccggctccaaacacctatgtactttttcctggccaacctctccctgctggatgcctgctattcctcagccatcggccccaagatgctagtggacttgctgctgccccacgccactattccttacatagcctgtgccctccagatgtttgtgtttgcagggctggctgatgctgagtgttgcctgttggcagccatggcctatgaccgctatgtggccatcagaaaccctctcctctacacaacagccatgtctcggtgtgtatgcctggccttgctgggagcatcaggtctgagtggggcagtgagtgcctttgtccacacaaccctcaccttccgcctgaacttctgccagtctcgggaggtcaacagcttcttctgtgatatccctccactgctggccatctcttgcaatgacaccagtctcaatgagctcctcctcttcactgtctgtggcttcatccagacagccactgtgttggtcattgccgtgtcatatggtttcattgctggggctgtgattcgcatgcattcggcagaaggccgtcagcgagcagcctctacctgtggctctcacctcacagctgtggccatgctgtacggaacacttactttcatgtacctgcgtcccagctccagctatgccctggataccgacaagatggcatctgtgttctacactcttgtcatcccagctctcaacccgctcatctacagcctccgcaacaaggaggtcaaggaggcagtcagaaagacttggagccgattctgctgccctggtccagagcactaa

SEQ ID NO: 2074 - protein, 319 aa, Canis familiaris
MTTENFTWTRVTPTEFILLGITDRWDLRVTLFLIFLPVYLVSLLGNVGMVLLIRMDARLQTPMYFFLANLSLLDACYSSAIGPKMLVDLLLPHATIPYIACALQMFVFAGLADAECCLLAAMAYDRYVAIRNPLLYTTAMSRCVCLALLGASGLSGAVSAFVHTTLTFRLNFCQSREVNSFFCDIPPLLAISCNDTSLNELLLFTVCGFIQTATVLVIAVSYGFIAGAVIRMHSAEGRQRAASTCGSHLTAVAMLYGTLTFMYLRPSSSYALDTDKMASVFYTLVIPALNPLIYSLRNKEVKEAVRKTWSRFCCPGPEH

SEQ ID NO: 2075 - DNA, 930 bp, Canis familiaris
atgctgagggaaaaccagagccatatgcctgaattcctccttctgggactgaccagtgaccccaaacagcaggggtggctctttgccagcttcctagccatgtatctggtcaatgtggctggtaactcagtcatcattgcagccatccggagggatgcctgcctccacacccccatgtacttcttgctttccagtctgtccctggtggacatctgctttacaagtgccattgtgccaaggatgctggcaaacatgatgagcaaaagcaagaaggtcccctttgcccaatgcctcacacagatgtgtttctttgtggcctttgggatcactgacagcttcctcctggctgtcatggctgttgaccgctacacggccatctgcaacccgctgctttacagcatgaccatgagccccaggcgctatctcctgctggtgatggtgtcctgggtgctgtcccatctccactcactcacccacatgattctcatggcccgcctctccttctgtgggcccaatgtcatccatcacttcttctgtgatgtccagccactgctgacactctcctgctcggacacctctatcaatgagcttttggctttcacagaaggctcctttgtgatcatgagtcccttcgccttgatcactgtctcttatatttttatcacccatgctgttctgagggtccgttctgagagaggcaggtacaaggtcttctccacctgtcggtcctacctcatagttgtggcactattctatgggaccataatatttgtgtacattcacccctcatccacctactcagtgacaaaggaccatgtggtcactgtcatctatacagtagttatccccatgctgaacccttttatctatagtcttaggaacaaggacatgaagcaggccttgaaaaagctcctcagaagggtagaatag

SEQ ID NO: 2076 - protein, 309 aa, Canis familiaris
MLRENQSHMPEFLLLGLTSDPKQQGWLFASFLAMYLVNVAGNSVIIAAIRRDACLHTPMYFLLSSLSLVDICFTSAIVPRMLANMMSKSKKVPFAQCLTQMCFFVAFGITDSFLLAVMAVDRYTAICNPLLYSMTMSPRRYLLLVMVSWVLSHLHSLTHMILMARLSFCGPNVIHHFFCDVQPLLTLSCSDTSINELLAFTEGSFVIMSPFALITVSYIFITHAVLRVRSERGRYKVFSTCRSYLIVVALFYGTIIFVYIHPSSTYSVTKDHVVTVIYTVVIPMLNPFIYSLRNKDMKQALKKLLRRVE

SEQ ID NO: 2077 - DNA, 237 bp, Canis familiaris
aagagtcatgtgactgaattcctctttctgggactgaccagtgaccccaaacagcaggggtggctctttgccagcttcctagccatgtatctggtcaatgtggctggcaactcagtcatcattgcagccatccagagggatgcctgcctccacacccccatgtacttcttgttttccagtctggccctggtggacatctgctttacaaatgtcattgtgccaaggatgctggcaaac

SEQ ID NO: 2078 - protein, 79 aa, Canis familiaris
KSHVTEFLFLGLTSDPKQQGWLFASFLAMYLVNVAGNSVIIAAIQRDACLHTPMYFLFSSLALVDICFTNVIVPRMLAN

SEQ ID NO: 2079 - DNA, 930 bp, Canis familiaris
atggaaacaaagaactatagcagcgaatcaggctttgtcctcctgggcatctcttccagtcctcagctacagaaaccactctttgccatcttcctcatcatgtacctggtcactgtcgtgggcaatgtactcatcatcttggctatccagtctgactcccgactccatactcctatgtactttttcctcagcaacttgtccttcacagatatctgcttcacaacagtgattgtgcccaacatgctggcaaacctactatcagagaccaaggttatctcctttgtgggttgcctgatccagatgtaattcttcatggcctttgcgaatactgacagttaccttctggcctctatggccatagataggctggtggccatctgcaaccccttccactatgaaagggtcgtgaacccacggcgttgtctcctcatgctgctgggctcttgcaccatctcccacctgcactccctgctccgagtgctactcatgtcccgcctgtccttctgtgcctctcatgtcattaagcactttttttgtgatacccaacctgtactaaagctatcctgctctgacacatcctccaaccagattgtggtcatgactgagaccctggccgtcatcacaacccccttcctgtgcatcctcttttcctacctgcgaatcatcatcactgtgctcagaattccctctgcagctgggaagtggaaggccttctctacctgtggctcccacctcactgtagtggctttgttctatgggagtgtcatctatgtctactttaggcccctgtccatgtactcagtggtgaaggaccgggtagccacagttatgtacacagtagtgacacccatgctgaaccctttcatctatagcctgaggaacaaagatatgaagaggggtttgattaaattaagggacagaattcactca

SEQ ID NO: 2080 - protein, 206 aa, Canis familiaris
MAFANTDSYLLASMAIDRLVAICNPFHYERVVNPRRCLLMLLGSCTISHLHSLLRVLLMSRLSFCASHVIKHFFCDTQPVLKLSCSDTSSNQIVVMTETLAVITTPFLCILFSYLRIIITVLRIPSAAGKWKAFSTCGSHLTVVALFYGSVIYVYFRPLSMYSVVKDRVATVMYTVVTPMLNPFIYSLRNKDMKRGLIKLRDRIHS

SEQ ID NO: 2081 - DNA, 933 bp, Canis familiaris
atggaaacaaagaactatagcagcgaatcaggctttgtcctcctgggcatctcttccagtcctcagctacagaaaccactctttgccatcttcctcatcatgtacctggtcactgtcgtgggcaatgtactcatcatcttggttatccagtctgactcccggctccatactcctatgtactttttcctcagcaacttgtccttcacagatatctgcttcacaacagtgattgtgcccaacatgctggcaaacctactatcagagaccaaggttatctcctttgtgggttgcctgatccagatgtatttcttcatggcctttgcaaacactgacagttaccttctggcctctatggccatagataggctggtggccatctgcaaccccttccactatgaaagggtcatgaacccacggcgttgtctcctcatgctgctgggctcttgcaccatctcccacctgcactccctgctccgagtgctactcatgtcccgcctgtccttctgtgcctctcatgtcattaagcactttttttgtgatacccaacctgtactaaagctatcctgctctgacacatcctccaaccagattgtggtcatgactgagaccctggccgtcatcacaacccccttcctgtgcatcctcttttcctacctgcgaatcatcatcactgtgctcagaattccctctgcagctgggaagtggaaggccttctctacctgtggctcccacctcactgtagtggctttgttctatgggagtgtcatctatgtctactttaggcccctgtccatgtactcagtggtgaaggaccgggtagccacagttatgtacacagtagtgacacccatgctgaaccccttcatctatagcctgaggaacaaagatatgaagaggggtttgattaaattaagggacagaattcactcatag

SEQ ID NO: 2082 - protein, 310 aa, Canis familiaris
METKNYSSESGFVLLGISSSPQLQKPLFAIFLIMYLVTVVGNVLIILVIQSDSRLHTPMYFFLSNLSFTDICFTTVIVPNMLANLLSETKVISFVGCLIQMYFFMAFANTDSYLLASMAIDRLVAICNPFHYERVMNPRRCLLMLLGSCTISHLHSLLRVLLMSRLSFCASHVIKHFFCDTQPVLKLSCSDTSSNQIVVMTETLAVITTPFLCILFSYLRIIITVLRIPSAAGKWKAFSTCGSHLTVVALFYGSVIYVYFRPLSMYSVVKDRVATVMYTVVTPMLNPFIYSLRNKDMKRGLIKLRDRIHS

SEQ ID NO: 2083 - DNA, 963 bp, Canis familiaris
atgaggagggagaaccagagcagcgtgttagagtttctcctcctggggctccccatccagccagagcagcagcgcatgttctttgccctgttcctgggcatgtacctgaccacggtgcttgggaatctgctcaccatcctactcatcagactggactctcacctccacacccccatgtacttcttccttagccacttggccttctctgatgtctctttctcatctgtcactgtcccaacgatgctgatgaacatgcagactcggcacttaaccgtctcctatgcggggtgcatttcccagatgtattttttcatactttttgtttgtcttgacaattttcttcttgcagcgacagcatatgacaggtatgtggccatctgtcagccactccactacaccactgtcatgagggaggagctgtgtatcttactggtggctggatcctggttcttctcgtgtgcccatgccctgttgcatactctccttctgtcacgcctgtccttctgtgctgacaataccatccctcatttcttttgtgatctcactgccctcttgaagttagcctgctcagatacttccctcaatgagctagttatcttcactgagaggggagtgtttgccttcctgtcattttgtgctattttggcctcctatatctatgttggggccaccatcctgagagtccctccatcaagaggatctgcaaagccctccatcaagaggatctgcaaagccttgtctacctgtggctcccacctccttgtggtgttgtactatgggactcttgcaatgatttacttcattccttcatcaaacagttccaaggtcaaagacattattgcttcagttttgtatacagtggtgatacccatgttaaacccttttatgtatggcctgaggaacagggacatgaaataagctctgaggacactttacaggaggaaaattttttcttaccaagtg

SEQ ID NO: 2084 - protein, 305 aa, Canis familiaris
MRRENQSSVLEFLLLGLPIQPEQQRMFFALFLGMYLTTVLGNLLTILLIRLDSHLHTPMYFFLSHLAFSDVSFSSVTVPTMLMNMQTRHLTVSYAGCISQMYFFILFVCLDNFLLAATAYDRYVAICQPLHYTTVMREELCILLVAGSWFFSCAHALLHTLLLSRLSFCADNTIPHFFCDLTALLKLACSDTSLNELVIFTERGVFAFLSFCAILASYIYVGATILRVPPSRGSAKPSIKRICKALSTCGSHLLVVLYYGTLAMIYFIPSSNSSKVKDIIASVLYTVVIPMLNPFMYGLRNRDMK

SEQ ID NO: 2085 - DNA, 945 bp, Canis familiaris
atggcaagggtcaaccaaaccagcagtgtctctgagttcattctcctgggactctcctcccagcctgaggaccagaagccactctttatcctcttcctcaccatgtacctgatcaccataatagggaacctactcatcatcctggccatccattctgatccccagctccagacccccatgtatttcttcttgagtttcctgtccttcactgatatttgctttacaacaactgttgtccccaggatgctagtgagcttcctttctaagaagaccatctcctatgctgggtgtctgacacagatgtatttcatttatgctctgggcaacaccgacagctgccttctggcagtcatggcctttgaccgctatgtggctatctgtgaccccttccactacgtcaccaccatgaaccgccgctgctgtgtcctgctggtggccttttcctgctcacttccccacttccactcactcgtacacacactgctactgaacagcctcactttctgtgactccaatgtcatccaccacttcctctgtgacctcagtcccttgatgaaattgtcctgttcctccacatttgtcaatgaagttgtgataatatcagaaggttctgttgttttggtgactccatttctgtgcatcactctctcttatgtacgaattctcatcgcagttcttaagatcccttcagctgctgggaaacgcaaagccttctccacctgtggctctcacctcaccgtggtcacactcttttatggaagcatcttctatgtctatttacagcccctgtccacctacagtgccagggaccacatagcaacaattgtctacacagttctttcctccatgctaaacccttttatctacagcctgagaaacaaagacctgaaacagagcctaaggaagctgatgggcaggtggaattctcaagcaacaccctcttga

SEQ ID NO: 2086 - protein, 314 aa, Canis familiaris
MARVNQTSSVSEFILLGLSSQPEDQKPLFILFLTMYLITIIGNLLIILAIHSDPQLQTPMYFFLSFLSFTDICFTTTVVPRMLVSFLSKKTISYAGCLTQMYFIYALGNTDSCLLAVMAFDRYVAICDPFHYVTTMNRRCCVLLVAFSCSLPHFHSLVHTLLLNSLTFCDSNVIHHFLCDLSPLMKLSCSSTFVNEVVIISEGSVVLVTPFLCITLSYVRILIAVLKIPSAAGKRKAFSTCGSHLTVVTLFYGSIFYVYLQPLSTYSARDHIATIVYTVLSSMLNPFIYSLRNKDLKQSLRKLMGRWNSQATPS

SEQ ID NO: 2087 - DNA, 981 bp, Canis familiaris
atggagaaggtcaaccaaaccagcagtgtctccaagttcctcctcggactctccttctctcctgaggaccagaagccattcttttccctgttcttcatcatgtacatggtcactctgggagggaacctgctcatcaccctagccatctgctctgacactcagctccagacacctatgtattttttttttttcctcagcatattatccttcattgacatttgctacaccacaaccatcattcccaagatgctggtgaacttcctatcagaaaaagaagcccatctcctacgctgagtgtatgacccagatgtatttcttcttggcttttgccaacacagaaagtttcctggcgaccatggccattgatcgctttgtggctatctgtgaccccttccattatgtcaccaccatgagccactgccactgtctcctgctgcttgccttctcctgctccatccctgacctccattccctcttacttgttcttctggtgaatgcctcactttctgtgactccaatgttatacccccacttcctctgcaacatcaactctctgctgaaattgtcctgctcaaaaaaaaaaaaaaaaaaaaaaagaaattgtcctgctcttccacatttgtcaatgaagttgtaattaacacagaatgattgataacactgatgaccccctttatatgtgttatcatctcttacttctgggtcctcattgctattcttaagatcccctcagctgctcggaagcataaagctttctctaactatggctcccacctcaccatggtgactctcttttatggaagtattatttatgtttatttctgacctctgtccagctatacaatcaaggacagggtggtgacagtcatctacacagttctgtcctccatgctgaaccctttaatctacagcctgaggaacaaagacatgaagtggggcatgagaaagctgatgggcagctttcagtcccagacagcacct

SEQ ID NO: 2088 - protein, 97 aa, Canis familiaris
MEKVNQTSSVSKFLLGLSFSPEDQKPFFSLFFIMYMVTLGGNLLITLAICSDTQLQTPMYFFFFLSILSFIDICYTTTIIPKMLVNFLSEKEAHLLR

SEQ ID NO: 2089 - DNA, 945 bp, Canis familiaris
atgggaaataataatgtgacagaatttgtcctccttggcctcactcaggatcctgaggggcagaaagcattatttgtcatgattttactcatctacattgtgacaatggtgggcaacctactcattgtagtgactgtttttggcagcccctctctgggctcccccatgtactttttccttgcctatctgtcacttatggatgctgtttattccactgtcatttcacccaaattgattatagacttactctgtgacaaaaagacaatttctttcccagcttgcatgggtcagctctttctagaacacttctttgggggttctgaggtcttccttctggtcatgatggcctatgatcgctatgtggccatctgtaggccactgcattacctgactgttatgaatcgacaggtttgcatcctgctgatagtggtggcctggattggaggtcttgtgcactctatggttcagcttctctttgtgtacagcctcccattttgtggctccaatgtcattgatcactttatctgtgaactgtacccattattagaacttgcctgcactgacacctacttaataggcctcactgtgattgccaacggtggagcaatctgtatggtcatctttatccttctactcatctcctatggagtcattctaaattctcttaaaagtcacagtccagaagggaggcgcaaagccctgtctacctgcagttcccacaccacagtggttgtccttttttttgttccctgcatttgcatgtatgttagacctgtttctaacttgcccattgataagtctgtaactctggtttatacagttatcactcccatgttatatcctttaatatataccttgagaaattcagagatgaaaaatgctatggaaaaattctggtgtaaaaatttaacaaaaggtagaataagaatgtgtcacctaaactga

SEQ ID NO: 2090 - protein, 314 aa, Canis familiaris
MGNNNVTEFVLLGLTQDPEGQKALFVMILLIYIVTMVGNLLIVVTVFGSPSLGSPMYFFLAYLSLMDAVYSTVISPKLIIDLLCDKKTISFPACMGQLFLEHFFGGSEVFLLVMMAYDRYVAICRPLHYLTVMNRQVCILLIVVAWIGGLVHSMVQLLFVYSLPFCGSNVIDHFICELYPLLELACTDTYLIGLTVIANGGAICMVIFILLLISYGVILNSLKSHSPEGRRKALSTCSSHTTVVVLFFVPCICMYVRPVSNLPIDKSVTLVYTVITPMLYPLIYTLRNSEMKNAMEKFWCKNLTKGRIRMCHLN

SEQ ID NO: 2091 - DNA, 933 bp, Canis familiaris
atggaaaaacacaatctgaccatgctcaatgaattcattctcatgggaatcacacatcgtcctgagctgcaggctccattatttgggctcttctttgtcatctatttgatctccgtggtgggcaacctgggcatgatcatcctcaccaaagtggatgccagactacaaacacccatgtacttcttcctcaaacacctggcttttactgaccttggttattcaacaactgtgggacccaaaatgttagtaaattttattgtggatcaaagtacaatctcctattacttttgtgctatgcaactagctttctttcttgtgtttattatcagtgaacttttcattctgtcagctatgtcctatgaccgctatgtagccatctgtaaccctctgctctaccccctcatcatgtcacagagggtgtgtcaggtgctggtggcaatcccttatctctacagcacatttgtgtctcttctagtcaccataaagatttttagttcattcttctgtggctacaatgttgtaaatcatttctactgtgactgtctccccttgttatctttgctctgctcaaatacacatgaaattgagttgatgattttgattttctcagtttttgatgtcagttcatcccttctgataattcttgtgtcttacctgctgatcctggtagccattgtcaggatgaattcagctaagggtaggctcaaggctttttccacctgtggatcccacctgacagtggccacagtgttctatgggactttgatatttatgtatgtgcaacctgagtccagccattcctttgacactgataaagtggcgtccatattttacaccctcgttatccccatgctgaatcccttgatctatagcttgaggaacaaagatgtaaaatatgcagtgcaaacaatgtggaaaaaaactatgcaataa

SEQ ID NO: 2092 - protein, 310 aa, Canis familiaris
MEKHNLTMLNEFILMGITHRPELQAPLFGLFFVIYLISVVGNLGMIILTKVDARLQTPMYFFLKHLAFTDLGYSTTVGPKMLVNFIVDQSTISYYFCAMQLAFFLVFIISELFILSAMSYDRYVAICNPLLYPLIMSQRVCQVLVAIPYLYSTFVSLLVTIKIFSSFFCGYNVVNHFYCDCLPLLSLLCSNTHEIELMILIFSVFDVSSSLLIILVSYLLILVAIVRMNSAKGRLKAFSTCGSHLTVATVFYGTLIFMYVQPESSHSFDTDKVASIFYTLVIPMLNPLIYSLRNKDVKYAVQTMWKKTMQ

SEQ ID NO: 2093 - DNA, 861 bp, Canis familiaris
agggatccaagaaaacagaaagcagtatttggtgtcttcttgatgttttaccttgccacactgttgggaaactttctcattgtagtgactattaaaagaagcaggacccttgggagtcccatgtacttcttcctattttacctgtcttttactgatgcttgcctctctacaaccattgcccccagattgattgtggatgccatttctcagaggaagaccatttcctacaatgagtgcatgactcaagtcttttcagcccacttctttggatgcatggaaatcttcgtgctgatcctgatggcttttgatcgctatgtagccatttgtaagcccttgtgatacacaaccatcatgaacaggcatgtctgcagtgtgctggtgattctgggttgggtgggatcctgtatccactcttcagcacaaattttcctggcttcgagattgcctttctgtggtcccaatgtgattgatcactatttctgtgacttgcagcccttgttgaaacttgcttgcatggacacttatgtaataaatttgctagttgtttctaacagtggagccatatgcacggtgagtttcataattctgcttatctcctatgttatcatcttgtactctctgagaaactacagtgcagaaggaaggcgaaaagccctttcgacctgcacctcccattttattgtggttgtcctattttttggcccatgtatattcatgtatacacgcccggcaaccacatttccagtagacaaggtggtggcagtgttttataccattgggacacctttgctgaaccctctgatctatacactgaggaatgcggaagtgaaaaatgccatgaaaaagttatggtgtagcaaa

SEQ ID NO: 2094 - protein, 170 aa, Canis familiaris
MNRHVCSVLVILGWVGSCIHSSAQIFLASRLPFCGPNVIDHYFCDLQPLLKLACMDTYVINLLVVSNSGAICTVSFIILLISYVIILYSLRNYSAEGRRKALSTCTSHFIVVVLFFGPCIFMYTRPATTFPVDKVVAVFYTIGTPLLNPLIYTLRNAEVKNAMKKLWCSK

SEQ ID NO: 2095 - DNA, 915 bp, Canis familiaris
atggtgatgaatagcactgtgaatgaattcattctgtttggcttgacacaggatccaagaaaacagaaagcagtatttggggtcttcttgatgttttaccttgccacactgttgggaaactttctcattgtagtgactattaaaagaagcaggacccttgggagtcccatgtacttcttcctattttacctgtcttttactgatgcttgcctctctacaaccattgcccccagattgattgtggatgccatttctcagaggaagaccatttcctacaatgagtgcatgactcaagtcttttcagcccacttctttggatgcaaggaaatcttcgtgctgatcctgatggcttttgatcgctatgtagccatttgtaagcccttgcgatacacaaccatcatgaacaggcatgtctgcagtgtgctggtgattctgggttgggtgggatcctgtatccactcttcagcacaaattttcctggcttcgagattgcctttctgtggtcccaatgtgattgatcactatttctgtgacttgcagcccttgttgaaacttgcttgcatggacacttatgtaataaatttgctagttgtttctaacagtggagccatatgcacggtgagtttcataatcctgcttatctcctatgttatcatcttgtactctctgagaaactacagtgcagaaggaaggcgaaaagccctttcgacctgcacctcccattttattgtggttgtcctattttttggcccatgtatattcatatatacacgcccagcaaccacatttccagtagacaaggtggtggctgtattttataccattggggcacccttgctcaaccctctgatctatacactgaggaatgcggaagtgaaaaatgccatgaaaaagttatggtgtaacaaagtgtga

SEQ ID NO: 2096 - protein, 304 aa, Canis familiaris
MVMNSTVNEFILFGLTQDPRKQKAVFGVFLMFYLATLLGNFLIVVTIKRSRTLGSPMYFFLFYLSFTDACLSTTIAPRLIVDAISQRKTISYNECMTQVFSAHFFGCKEIFVLILMAFDRYVAICKPLRYTTIMNRHVCSVLVILGWVGSCIHSSAQIFLASRLPFCGPNVIDHYFCDLQPLLKLACMDTYVINLLVVSNSGAICTVSFIILLISYVIILYSLRNYSAEGRRKALSTCTSHFIVVVLFFGPCIFIYTRPATTFPVDKVVAVFYTIGAPLLNPLIYTLRNAEVKNAMKKLWCNKV

SEQ ID NO: 2097 - DNA, 930 bp, Canis familiaris
atgactgaggataattactccttgacaactgaatttattctcataggatttacagatcacccaaagttgaagaccgttctgtttgtggtgtttctcactatctatctggtgaccatggtggggaatctgggcctggtggcattgatccttatggagcgtcgccttcacacacccatgtacatctttctgggcaacctggctctaatggattcctgttgtgcctgtgccattacccccaagatgttagagaatttcttttcgaaggacagaatgatttccctctatgaatgcatggcacagttttattttctctgccttgctgaaacggcagactgctttctcctggcagcaatggcctatgaccgctatgtggccatctgcagcccactgcagtaccacaccctgatgtcgaagaagctctgccttcagatgaccgcaggggcctacatagcaggaaacctgcattccatgattcatatagtgtttctctttcgtttaactttctgtaggtctcatcagattaatcactttttttgtgatgttcttccattattcaaactctcctgtgttgacccttatatcaatgaattgttgatatttatcttttctggttcagttcaagtcttctctattatcatagtcataatctcttatctctgcatccttttcatgattttcaaaatgaaatccaaagagggaagaggcaaagccttatctacttgtgcatcacactttctctctgtctcaatgttctatggttctcttctctttgtgtacgttcgaccaaattcagttaaagaggaggataaagatatacctgttgctattttttatactctagtaatccctttattaaacccttttatttatagtctaagaaataaggaagtaataaatgccatgaaaagaaatataaagaaaattttataa

SEQ ID NO: 2098 - protein, 309 aa, Canis familiaris
MTEDNYSLTTEFILIGFTDHPKLKTVLFVVFLTIYLVTMVGNLGLVALILMERRLHTPMYIFLGNLALMDSCCACAITPKMLENFFSKDRMISLYECMAQFYFLCLAETADCFLLAAMAYDRYVAICSPLQYHTLMSKKLCLQMTAGAYIAGNLHSMIHIVFLFRLTFCRSHQINHFFCDVLPLFKLSCVDPYINELLIFIFSGSVQVFSIIIVIISYLCILFMIFKMKSKEGRGKALSTCASHFLSVSMFYGSLLFVYVRPNSVKEEDKDIPVAIFYTLVIPLLNPFIYSLRNKEVINAMKRNIKKIL

SEQ ID NO: 2099 - DNA, 663 bp, Canis familiaris
atgtgtatacccttgattaacaatacagttagctataatccttgtgccactcaattattttttgttattgtcttgggtgtgactgaaatttgcctcctcacagccatgtcctataaccgctatgtggccatctgcaaacccctgcattacatgaccatcatgaacaacagggtctgcatcaagttccttattggatgttatacgttagttctgctcatcgtcctcccaccctatatcatgggcttcaagctcgagttttgtgactccaatgtcatagatcactttggctgtgatgctgctcccatcctgaagattacctgctcagacacagagtttatcgagcgatttgtcttggtcctggctgtgttgacactcattttcaccttggtgtgtgtaattttgtcctacacatacatcatcaggacaattctcagatttccttctgtccagcaaaggaaaaaggcttttactacttgttcttcccatataattgtggtttctattacttatggaagctgcatctttatctatatcaaacctcatgcaaaagaaggggttgctattaataaggtggtgtcagtgcttaccacctcagttgccccagtgatgaatccctttatttatactctgaggaacaagcaagtgactgaagctttcaaagac

SEQ ID NO: 2100 - protein, 221 aa, Canis familiaris
MCIPLINNTVSYNPCATQLFFVIVLGVTEICLLTAMSYNRYVAICKPLHYMTIMNNRVCIKFLIGCYTLVLLIVLPPYIMGFKLEFCDSNVIDHFGCDAAPILKITCSDTEFIERFVLVLAVLTLIFTLVCVILSYTYIIRTILRFPSVQQRKKAFTTCSSHIIVVSITYGSCIFIYIKPHAKEGVAINKVVSVLTTSVAPVMNPFIYTLRNKQVTEAFKD

SEQ ID NO: 2101 - DNA, 945 bp, Canis familiaris
atgttggggaatcagtctagtgccactgaattttatctccttggcttccctggctccaaggaactacaccatcttctctttgctaccttcttcttcttctactcagtgacattaatgggaaacatggtcatcatcttgattgtgtgtgctgataaacgtctgcagtcccccatgtatttcttccttggtcacctctctgccttggagatcttggttacatctgttattgtgcctgtgatgctttgggggttgctgctccctgggatgcagacgatatctttggctgcatgtgtcacccagctcttcctgtacctttctctggggaccaccgagtttgcattactgggagcaatggctgtggaccgttatgtggctgtctgtaaccctttgaggtacaatgtcattatgaacagccgcacctgtatctgggtggtcattgtgtcatgggtgtttggtttcctatttcaaatctggccagtgtatgccacatttcagcttacgttctgcaaatccaatgtggtgaacaatttcttctgtgaccgagggcaattgctcaaactatcctgcaacaatactcttttcatagagtttattctattcctaatggctgtctttgttctttttggttctctgatccctacaatcatctcctacacctacatcatctccaccatcctcaagattccctcagcctctgggcgaaggaaagccttttctacgtgtgcgtcccacttcacttgtgttgtgatcggctatggcagttgcttgttcctctatgtgaaacccaagcaaacacaggcggcagattacaatagagtggtttccttgatggtttcagtggttactcctttcctcaaccctttcatcttcacccttcgaaatgacaaagtcatagaagccctatgggatggaatgaaaagatgctgtcaactattcaataactaa

SEQ ID NO: 2102 - protein, 314 aa, Canis familiaris
MLGNQSSATEFYLLGFPGSKELHHLLFATFFFFYSVTLMGNMVIILIVCADKRLQSPMYFFLGHLSALEILVTSVIVPVMLWGLLLPGMQTISLAACVTQLFLYLSLGTTEFALLGAMAVDRYVAVCNPLRYNVIMNSRTCIWVVIVSWVFGFLFQIWPVYATFQLTFCKSNVVNNFFCDRGQLLKLSCNNTLFIEFILFLMAVFVLFGSLIPTIISYTYIISTILKIPSASGRRKAFSTCASHFTCVVIGYGSCLFLYVKPKQTQAADYNRVVSLMVSVVTPFLNPFIFTLRNDKVIEALWDGMKRCCQLFNN

SEQ ID NO: 2103 - DNA, 945 bp, Canis familiaris
atgttggggaatcagtctagtgccactgaattttatctccttggcttccctggctccaaggatctacaccatcttctctttgctaccttcttcttcttctactcagtgacattaatgggaaacatggtcatcatcttgattgtgtgtgctgataaacgtctgcagtcccccatgtatttcttccttagtcacctctctgccttggagatcttggttacatctgttattgtgcctgtgatgctttgggagttgctgctccctgggatgctaacgatatctctcgctgcatgtgtcacccagctcttcctgtacctttctctggggaccaccgagtttgcattactgggagcaatggctgtggaccgttacgtggctgtctgtaaccctttgaggtataatgtcattatgaacagccgcacctgtatctgggtggtcattgtgtcatgggtgtttgggttcctttttgaaatctggccagtgtatgccacatttcagcttacgttctgcaaatccaatgtggtgaacaatttcttctgtgaccgagggcaattgctcaaactatcctgcaacaatactcttttcatagagtttattctattcctaatggctgtctttgttctttttggttctctgatccctacaatcatctcctacacctacatcatctccaccatcctcaagatcccctcagcctctgggcggaggaaagccttttctacgtgtgcgtctcacttcacctttgtcgtgattgggtatggcacctgcttgttcctctatgtgaaacccaagcaaacccaggcagctgattacaacagagtagcatcactgctggtttcagtggtgaccccttttctgaatccacttatctttaccctccggaatgacaaattcatggaggcctttcgagatgttgtgaaacgctgctgtcaacttctccgggattag

SEQ ID NO: 2104 - protein, 314 aa, Canis familiaris
MLGNQSSATEFYLLGFPGSKDLHHLLFATFFFFYSVTLMGNMVIILIVCADKRLQSPMYFFLSHLSALEILVTSVIVPVMLWELLLPGMLTISLAACVTQLFLYLSLGTTEFALLGAMAVDRYVAVCNPLRYNVIMNSRTCIWVVIVSWVFGFLFEIWPVYATFQLTFCKSNVVNNFFCDRGQLLKLSCNNTLFIEFILFLMAVFVLFGSLIPTIISYTYIISTILKIPSASGRRKAFSTCASHFTFVVIGYGTCLFLYVKPKQTQAADYNRVASLLVSVVTPFLNPLIFTLRNDKFMEAFRDVVKRCCQLLRD

SEQ ID NO: 2105 - DNA, 933 bp, Canis familiaris
atgcagcaaaataacagtactactgagttcatactgttaggattgacccaagatcctatgaaaaagaaaacggtatttgtaatatttttcattttttatttgggaactgtggttgggaatttgcttattattgtgaccatcaagtccagccggacacttgggagccccatgtactatttcttattttatttgtcccttgctgattcctgcttttcaacttccacagcccccaaactaattgtggattcactctctgcaaaaaatatcataacttacaatgaatgcatgactcaagtctttgcactgcatttctttggttgcatggaggtttttgtcctcctcctcatggcctttgaccggtatgtggccatctgtaagcccttacattacacaaccatcatgagccggcaggtctgcaccatcctaattgttctggcatggattggatcttttatccattctacagcccagattatcctggctttgagattgcccttctgtggacccaatttgattgatcattactgctgtgatttgcagcccttgctgaaacttgcttgcatggacacttataagatcaacctactgttggtttctaatagtggggccatttgttcaagcagttttgtgattctgatgatctcctacattgtcatcttgcattccctgcgaaaccacagtgcggaagggaggaaaaaagctctctctacttgcatttctcacatcatcgtagtagtcttatgctttggtccatgtacattcatttatacacgccccccaaccacttaccccatagacaagatgatggctgtattttatactattgggacaccttttctcaacccactcatctacacattgaggaatgcagaagtgaaaaatgccatgagaaagctatggcatatcaagattaccactgaaagcggaagatga

SEQ ID NO: 2106 - protein, 310 aa, Canis familiaris
MQQNNSTTEFILLGLTQDPMKKKTVFVIFFIFYLGTVVGNLLIIVTIKSSRTLGSPMYYFLFYLSLADSCFSTSTAPKLIVDSLSAKNIITYNECMTQVFALHFFGCMEVFVLLLMAFDRYVAICKPLHYTTIMSRQVCTILIVLAWIGSFIHSTAQIILALRLPFCGPNLIDHYCCDLQPLLKLACMDTYKINLLLVSNSGAICSSSFVILMISYIVILHSLRNHSAEGRKKALSTCISHIIVVVLCFGPCTFIYTRPPTTYPIDKMMAVFYTIGTPFLNPLIYTLRNAEVKNAMRKLWHIKITTESGR

SEQ ID NO: 2107 - DNA, 939 bp, Canis familiaris
atgagaaaccacacagaactaacagattttatcctcctgggattgtcagatgacccacagcttcaggaggtgatctttgcctttctgcttatcacctacatgctcagcatcactgggaacctgaccattatcaccctcaccctgctggattcccacctccagacccccatgtatttcttcctcagaaacttctccttactcgagatttcattcacaaatgtgagcatacccaagttcctgagcaccctgattacaggagataaaactgtttcctttaatgattgtatggctcagttattttttttcattctgttgggagtcactgaattttacctgctggctgccatgtcctatgaccgatacattgccatctgcaaacctctgcattacatgaccatcatgaatcccagagtctgcatactccttgtctttgcttcttggtcggcttcattcttaatcatattcccattactcatgctgttcatacagcttgattattgtaagtccaatgctatagaccattttacctgtgactatttccccttactacatctttcttgttcagacactagattcttagagatagtgggtttttcctgtgctgtttttacgttaatgttcacattggtgataataattctgtcctacatatatatcctcagaacaattttgaagattccttctactagtcagaggacaaaggccttttccacctgttcttcccacatgattgtcatctctatctcctatggcagctgcattttcatgtatattaacccagcagcaaaagacagagtgtctctgagcaagggagttgctgtgctaaacacctcggtagcccccatgctgaacccctttatttacagcctaaggaaccagcaagtcaagcgagccttcctggacagggcaaggaagattgtatttttctcaagcaaatga

SEQ ID NO: 2108 - protein, 312 aa, Canis familiaris
MRNHTELTDFILLGLSDDPQLQEVIFAFLLITYMLSITGNLTIITLTLLDSHLQTPMYFFLRNFSLLEISFTNVSIPKFLSTLITGDKTVSFNDCMAQLFFFILLGVTEFYLLAAMSYDRYIAICKPLHYMTIMNPRVCILLVFASWSASFLIIFPLLMLFIQLDYCKSNAIDHFTCDYFPLLHLSCSDTRFLEIVGFSCAVFTLMFTLVIIILSYIYILRTILKIPSTSQRTKAFSTCSSHMIVISISYGSCIFMYINPAAKDRVSLSKGVAVLNTSVAPMLNPFIYSLRNQQVKRAFLDRARKIVFFSSK

SEQ ID NO: 2109 - DNA, 966 bp, Canis familiaris
atggccaacttgacctccatgagtggattcctcctcatggggttttctgatcatcgtgagcttcagattttacatgcattgctttttttggtgacatacctgttggccttgacaggcaacctcctcattatcactgtaaccagcttggaccatcacctacagtcccccatgtattacttcttgaagcacctctctcttctggacctctgcttcatctctgtcacagtcccccagtccatcacaaattcacttatgaacaatggttacatttcctatgtccagtgcattcttcaggtgttcttcttcatagctctggcctcatcagaagtggccatcctcacagtgatgtcttatgaccgctatgtctccatctgtcggcccctgcagtatgagaccattatgaacccctgcatttgtaggtatgcagtgacagctgtgtggctggctgggggcctctctgggctcatgcatacggctgtgaacttctccatacctctctgtggggagagagtcattcaccaattcttctgtgatgttcctcagatgctgaaactagcttgttctcatgaattcatcaatgagattgcagtggctgccttcacaacctcagcagcattcatctgcttggtctccatcgtgctctcctatgttcatatcttttctaccgtgctgaggatcccatcagccgagggccggaccaaagtctttgccacctgcctaccacacctgtttgtagtcaccttcttcctctccactgcaggctttgagtttctgcagcccccttctgactcccaatcagctatggacatcatgttatccatattctatacggtgataccaccaacactcaatccagttatatacagtttacggaatgaagccattaaggctgctctgaagaaggtgctgtcaaaaggagaatttgctcagagaaaaatgtatttaaaaaccatttttaaattctaa

SEQ ID NO: 2110 - protein, 321 aa, Canis familiaris
MANLTSMSGFLLMGFSDHRELQILHALLFLVTYLLALTGNLLIITVTSLDHHLQSPMYYFLKHLSLLDLCFISVTVPQSITNSLMNNGYISYVQCILQVFFFIALASSEVAILTVMSYDRYVSICRPLQYETIMNPCICRYAVTAVWLAGGLSGLMHTAVNFSIPLCGERVIHQFFCDVPQMLKLACSHEFINEIAVAAFTTSAAFICLVSIVLSYVHIFSTVLRIPSAEGRTKVFATCLPHLFVVTFFLSTAGFEFLQPPSDSQSAMDIMLSIFYTVIPPTLNPVIYSLRNEAIKAALKKVLSKGEFAQRKMYLKTIFKF

SEQ ID NO: 2111 - DNA, 939 bp, Canis familiaris
atgagaaatcatacagcagtaacaacattcatcctgctaggattgacagatgacccaaaaatacaagttctactctttgtatttttgtttctcacctacatgttgagtgtaactggaaacctcatcattatcaccctcacactggtggactcccatcttaaaactcccatgtattttttcctccgaaatttctctttcttagaagtctcattcaccactgtctgtattcccagattcctgtatactatgaccactggagataatactgtttcctataatgcttgtgccacccagttattttttgttgtcctctttggagcaacagaattttttctccttgccgccatgtcctatgaccgctatgtggccatttgcaagcccctgcattatacaactatcatgaacaacagagtctgcactaccctcgttctctgctgttggtttgctggcctgttaatcatcctcccacctcttggcctgggcctccagctggaattctgtgactcaaatgtgattgatcattttggctgtgatgcatctccaattttacagataacctgctcagacacagtcttaatcgagagaattgttctgagttttgctgtgctgacactcattattaccttagtgtgtgtagtcctctcctatacctacatcattaagaccattctaagattcccttctgcccaacaaaggaaaaaggccttttccacctgctcttcccatatgattgtggtttccatcacttatggcagctgcatcttcatctacatcaaaccttcagcaaaggaaggagtagctattaataaagtagtgtctgtgctcactacttcagttgctcctttgtttaacccattcatttatacacttcgaaacaaacaagtgaaagatgccttcaaagacacagtaaaatggattgtatttctcacaaagaagtaa

SEQ ID NO: 2112 - protein, 312 aa, Canis familiaris
MRNHTAVTTFILLGLTDDPKIQVLLFVFLFLTYMLSVTGNLIIITLTLVDSHLKTPMYFFLRNFSFLEVSFTTVCIPRFLYTMTTGDNTVSYNACATQLFFVVLFGATEFFLLAAMSYDRYVAICKPLHYTTIMNNRVCTTLVLCCWFAGLLIILPPLGLGLQLEFCDSNVIDHFGCDASPILQITCSDTVLIERIVLSFAVLTLIITLVCVVLSYTYIIKTILRFPSAQQRKKAFSTCSSHMIVVSITYGSCIFIYIKPSAKEGVAINKVVSVLTTSVAPLFNPFIYTLRNKQVKDAFKDTVKWIVFLTKK

SEQ ID NO: 2113 - DNA, 966 bp, Canis familiaris
atgagaaatcatacagtagtaacaacattcatcctgctaggattgacagatgacccaaaaatacaagttctgctctttgtatttttgtttctcacctacatgttgagtgtaactggaaacctcatcattatcaccctcacactggtggactccaatcttaaaactcccatgtattttttcctctgaaatttctctttcttagaagtctcattcaccactgtctgtattcccagattcctgtatactatgaccactggagataatactgtttcctataatgcttgtgccacccagttattctttgttgtcttctttggagcaacagaattttttctccttgccgccatgtcctatgaccgctatgtggccatttgcaagcccctgcattatacaactatcatgaacaacagagtctgcactaccctcgttctctgctgttggtttgctggcccgttaatcatcctcccgcctcttggcctgggcctccagctggaattctgtgactcaaatgtgattgatcattttggctgtgatgcatctccaattttacagataacctgctcagacacagtcttaatagagagaattgttctgagttttgccatactgacactcattattaccttagtgtgtgtagtcttctcctatacctacatcattaagaccattctaagattcccttctgcccaacaaaggaaaaaggccttttccacctgctcttcccatatgattgtggtttccatcacttatggcagctgcatcttcatctacatcaaaccttcagcaaaggaaggagtagctattaataaagtagtgtctgtgctcactacttcagttgctcctttgtttaacccattcatttatacgctttgaaacaaacaagtgaaagatgccttcaaagacacagtaaaaaaataaaataaaaaaaaagacacagtaaaatggattgtatttctcacaaagaag

SEQ ID NO: 2114 - protein, 61 aa, Canis familiaris
MRNHTVVTTFILLGLTDDPKIQVLLFVFLFLTYMLSVTGNLIIITLTLVDSNLKTPMYFFL

SEQ ID NO: 2115 - DNA, 267 bp, Canis familiaris
atgtcaatgaatagcagcgtgaatgaattcattctgcttggcttgacacaggatccaagaaaacagaaagcaatatttggggtcttcttaatgctttaccttgccacactgttgggaaactttctcattgtagtgactattaaaagaagcaggactcttgggagtcccatgtacttcttcctattttacctgtcctttgctgatgcctgcttctctacaaccatagcccccagattgattgtggatgccatttcccagcagaagacc

SEQ ID NO: 2116 - protein, 89 aa, Canis familiaris
MSMNSSVNEFILLGLTQDPRKQKAIFGVFLMLYLATLLGNFLIVVTIKRSRTLGSPMYFFLFYLSFADACFSTTIAPRLIVDAISQQKT

SEQ ID NO: 2117 - DNA, 873 bp, Canis familiaris
ttcttgatcctacttggaatcccaggactggagaattaccaattttggattgcctttcctctatgtgccatgtatttcgtagctatagttggcaatatcattatccttcatataatctgaactgaccacaccctgcttgagcccatgtacctttttctagccatgctggctatcactgacctggctctatcctcttccacgcaacctaaaatgctggctatactctggtttcgtgctcatgaattgcatccatgccttttcctctgtgaagtccaggttgttcatggctatggccttggacaattatgtggctatctgtttcccactccaccactctactttcctgaccccagctgagtgggtaaactgggagtagctgtgatgatgagaggattgctatgggtgagccccttctgcattatggtctccaggatgcccttctgccccaaacacatcattgtccagtcatactgtgagcacatggctgtgttaaagctggtgtgtgcagacactagagtaaaccgtgcctatgggctctttccggctttctcggtggttggctttgatataattgtcatcagtacatcccatgtgatgattctgagaactgttctggggttgccctctgatgaagcccggttcaaggtttttggcacatgtgcttcccttatctgtatcatcttggctttttatatcccagccctctttactttcctcactcaccgctttggacaccatgtgcctcaagtggtacatatcatgtttaccaatttctatctcctggtacctcccatgctcaaccccatcatctatggagtcagtaccaagcagatcagggacagggatattcaaggttgttgtggaaaagatccc

SEQ ID NO: 2118 - protein, 164 aa, Canis familiaris
MMRGLLWVSPFCIMVSRMPFCPKHIIVQSYCEHMAVLKLVCADTRVNRAYGLFPAFSVVGFDIIVISTSHVMILRTVLGLPSDEARFKVFGTCASLICIILAFYIPALFTFLTHRFGHHVPQVVHIMFTNFYLLVPPMLNPIIYGVSTKQIRDRDIQGCCGKDP

SEQ ID NO: 2119 - DNA, 930 bp, Canis familiaris
atgactgaggataattactccttgacaactgaatttattctcataggatttacagatcacccaaagttgaagaccattctgtttgtggtgtttctcactatctatctggtgaccatggtggggaatctgggcctggtggcattgatccttatggagcgttgccttcacacacccatgtacatctttctgggcaacctggctctaatggattcctgttgtgcctgtgccattactcccaagatgttagagaatttcttttcgaaggacagaatgatttccctctatgaatgcatggcacaattttattttctctgtcttgctgaaactacagattgctttctcctggcagcaatggcctatgaccgctatgtggccatctgcagcccactgcagtaccacaccctgatgtcgaagaagctctgccttcagatgaccgcaggggcctacatagcaggaaacctgcattccataattcatatagtgtttctctttcggttaactttctgtaggtctcatcagattaatcactttttttgtgaatttcttccattattcaaactctcctgtgttgacccttatatcaatgaattgttgatgtttatctttccaggttcagttctagtgttctctattatcatagtcataatctcttatctctgcatccttttcatgattttcaaaatgaaatccaaagagggaagaggcagagccttatctacttgtgcatctcactttctctctgtctcaatgttctatggttctcttctctttgtgtacgttcgaccaaattcagttaaagaagaggataaagatatatctgttgctattttttatactctagtaatccctttattaaacccttttatttatagtctacgaaataaggaagtaataaatgctatgaaaaaaaacataaggaaaaatttttga

SEQ ID NO: 2120 - protein, 309 aa, Canis familiaris
MTEDNYSLTTEFILIGFTDHPKLKTILFVVFLTIYLVTMVGNLGLVALILMERCLHTPMYIFLGNLALMDSCCACAITPKMLENFFSKDRMISLYECMAQFYFLCLAETTDCFLLAAMAYDRYVAICSPLQYHTLMSKKLCLQMTAGAYIAGNLHSIIHIVFLFRLTFCRSHQINHFFCEFLPLFKLSCVDPYINELLMFIFPGSVLVFSIIIVIISYLCILFMIFKMKSKEGRGRALSTCASHFLSVSMFYGSLLFVYVRPNSVKEEDKDISVAIFYTLVIPLLNPFIYSLRNKEVINAMKKNIRKNF

SEQ ID NO: 2121 - DNA, 939 bp, Canis familiaris
atgagaaaccacacagaactaacagactttatcctcctgggattgtcagatgacccacagcttcaggaggtgatctttgtctttctgcttatcacctacatgctcagcatcactgggaacctgaccattatcaccctcaccctgctggattcccacctccagacccccatgtatttcttcctcagaaacttctccttacttgagatttcattcacaactgtgagcatacccaagttcctgagcaccctgattacaggagataaaactgtttcctttaatgattgtatggctcagttattttttttcattctgttgggagtcactgaattttacctgctggctgccatgtcctatgaccgatacattgccatctgcaaacctctgcattacatgaccatcatgaatcccagagtctgcatactccttgtctttgcttcttggtcggcttcattcttaatcatattcccatcactcatgctgttaatacagcttgattattgtaagtccaatgctatagaccattttacctgtgactatttccccttactacatctttcttgttcagacactagattcttagagatagtgggtttttcctgtgctgtttttacgttaatgttcacattgatgataataattctgtcctacatatatatcctcagaacaattttgaagattccttctactagtcagaggacaaaggccttttccacctgttcttcccacatgattgtcatctctatctcctatggcagctgcattttcatgtatattaacccagcagcaaaagacagagtgtctctgagcaagggagttgctgtgctaaacacctcggtagcccccatgctgaacccctttatttacagcctaaggaaccagcaagtcaagcaagccttactggacagggcaaggaagattgtatttttctcaagcaaatga

SEQ ID NO: 2122 - protein, 312 aa, Canis familiaris
MRNHTELTDFILLGLSDDPQLQEVIFVFLLITYMLSITGNLTIITLTLLDSHLQTPMYFFLRNFSLLEISFTTVSIPKFLSTLITGDKTVSFNDCMAQLFFFILLGVTEFYLLAAMSYDRYIAICKPLHYMTIMNPRVCILLVFASWSASFLIIFPSLMLLIQLDYCKSNAIDHFTCDYFPLLHLSCSDTRFLEIVGFSCAVFTLMFTLMIIILSYIYILRTILKIPSTSQRTKAFSTCSSHMIVISISYGSCIFMYINPAAKDRVSLSKGVAVLNTSVAPMLNPFIYSLRNQQVKQALLDRARKIVFFSSK

SEQ ID NO: 2123 - DNA, 924 bp, Canis familiaris
atggagaatccaaaaaatgtgactgaattcatacatttgggcattacagagaacccagagctgcggaaaatgctctctgctgtgtttctaatcatgtatgtgttcacggttttgggaaacctagtaattgtggtaactgtgatcacaagtcaaagtctgagatcacctatgtattttttccttactttcttatcctttttggatgttacctactcttctgtcattgcccccaagatgattgtggactccctctccaagagcactgtcacctccttaaaaggttgcatggcgcagctccttgcagagcatttctttggtggtgtggggatcatcctcctcatcgtgatggcctatgaccgctacgtggccatctgtaagcccctgcactactcgaccatcatgagccctcagatgtgctgcctgctgctgggaggggcctgggtggggggatttatccatgcagcaatacagcttctcttcatgtatcaaatacccttctgtggccccaatgtcattgatcattttatatgcgatttgtttcccttgttgaaactggcctgcatggacacccataccctgggtctcctagtcatcctcaacagtggggtgatgtgtatgaccatcttccttattctcattgcctcctacgtggtcatcctctgctctctgaagtcttgcagctctgaagggtggcgcaaagccatctccacctgtggctcccacctcaccgtggttgtcttgttctttgtgccatgcattttcctgtacgtgcggcctgtggccacctaccccattgacaaggcaatggctgtgtctgattccatcatcacacccatgttaaatcctttgatctacaccctgaggaattcagaggtgataaatgccatgaggaaactggggaaacaaaggagttttgttggcaag

SEQ ID NO: 2124 - protein, 308 aa, Canis familiaris
MENPKNVTEFIHLGITENPELRKMLSAVFLIMYVFTVLGNLVIVVTVITSQSLRSPMYFFLTFLSFLDVTYSSVIAPKMIVDSLSKSTVTSLKGCMAQLLAEHFFGGVGIILLIVMAYDRYVAICKPLHYSTIMSPQMCCLLLGGAWVGGFIHAAIQLLFMYQIPFCGPNVIDHFICDLFPLLKLACMDTHTLGLLVILNSGVMCMTIFLILIASYVVILCSLKSCSSEGWRKAISTCGSHLTVVVLFFVPCIFLYVRPVATYPIDKAMAVSDSIITPMLNPLIYTLRNSEVINAMRKLGKQRSFVGK

SEQ ID NO: 2125 - DNA, 933 bp, Canis familiaris
atgaaaaatcattctgcaataacattcatcctactaggattaacagatgatccacgattacaggtttttctttcattatttctgtttttcacctacattttcactgttgctggaaatctaatcattatcctcctcactcttgtagactctcacctcaaaacacccatgtactttttccttcggaatttttccatcttagaaataatatttacaactgtctgtgttcctcgattcttatacagcctgacaactggggacaaaagtattacctataatgtttgtgtcatccaattattttttgttatcctcattggagcaacagaattttttcttctaaccgccatgtgctatgactgctatgtcgccatctgcaagcccttgcactacactatcatcatgaatgaaagggtatgcacaattcttgtcctttgctgttggctgattgggttaattgtcatactcccaccacttagcctgggagttcagctagatttctgtaactccaatctcattgaccattttggttgtgatgcatctcctctcctgaagattgtatgctcagacactcaatttgtagagcaacttgttttaatcatggctgtgttgatgatcatagtcacattagtctgtgtatttgtgtcatacacatatattgttaagaccattttaagactcccttcagctcagcaaaggaaaaagcctttctccacttgttcttcccatatgattgtagtttctatcacctatggaagttgcatattcatctatatcaaacctgcaaaggaaggagtggctcttaataaggtagtgtcattgctcaatacctcaatcatccctttgataaaccctttcatttatacactatggaataagcaagtcaaacaagcctttaaggactcaattaaaaagatggcatttctttcaaaggattag

SEQ ID NO: 2126 - protein, 310 aa, Canis familiaris
MKNHSAITFILLGLTDDPRLQVFLSLFLFFTYIFTVAGNLIIILLTLVDSHLKTPMYFFLRNFSILEIIFTTVCVPRFLYSLTTGDKSITYNVCVIQLFFVILIGATEFFLLTAMCYDCYVAICKPLHYTIIMNERVCTILVLCCWLIGLIVILPPLSLGVQLDFCNSNLIDHFGCDASPLLKIVCSDTQFVEQLVLIMAVLMIIVTLVCVFVSYTYIVKTILRLPSAQQRKKPFSTCSSHMIVVSITYGSCIFIYIKPAKEGVALNKVVSLLNTSIIPLINPFIYTLWNKQVKQAFKDSIKKMAFLSKD

SEQ ID NO: 2127 - DNA, 930 bp, Canis familiaris
atgaagttgcagaattattccttggtgtcagaatttgtgttgtatggactctgcatgtcatgacatctccagcatttattcttcatgtttttctctgggatctatgtggccagtgtgctgggtaacctcatcatggtggtcaccgtaatttctgactcacacttgcactcctctcctatgtacttcctgctaggaaacctatctttcttagacatatggctcgcctcctttgccacccccaagatgctcagggactttcttagtgaccgaaagcttatctcctttggaggatgtatggctcaaatcttcttcttgcactttattggcagggctgagatggtacttctggtttccatggcctatgacagatacgtggctatatgtaaacctctgcattatatgaccgtgatgagacggcagacctgcgtggggctggtgttggtctcatgggtcactggctttgtgcattccatcagtcaagtagcctttactgtgaatttaccgtactgtggccccaatgaggtggacagcttcttttgtgacctgcctcctgtgatcaagcttgcctgcatggacacctacatcttaggtatccttatgatctcagatagtggattactctctatgagctgctttctgctcctcttggtctcttacactgtcatcctcatcactgtctgacagcgcactgctggtggcatatccaaagcactctccacttgctgtgcacacatcatggttgtcacactcttctttgggccctgcattttcattgatgtgtggcctttcagccagttctctgtggacaagctcctgtctgtgttttacaccatttttactccactcttgaacccccttatctacacactgagaaataaagagatgaaaatagctatgaagaaactgtgtaaccaccatgtgacttctcgt

SEQ ID NO: 2128 - protein, 104 aa, Canis familiaris
TRSHMVVTQFLHSYFHLFISQCVDKGVQEWSKNGVKHRQELVHRELAERPHINENAGPKEECDNHDVCTASGECFGYATSSALSDSDEDDSVRDQEEQKAAHRE

SEQ ID NO: 2129 - DNA, 762 bp, Canis familiaris
atgtatgaatcaaattattctgatgtgttttggtttatatccttggcactttctacctatagaccagcactgaattttctccttgccttttcttcagtgttttatgtaacagttatcctgggaaacctccttgttgtgtttagagtgatgtttacccttacttacattccactatgtacttccttttagcaaatctctcattcattgacttgtgtctttccaccttaatgattcctaagaagattcatgacctgcactcagggcacaaaaccatatccttccagggatgtgtcatccatttatttgtatttcatgtcctgggtggatctgagatggtgctgctcattgccatcttggatggtcttggatcgctatgtggccatatgtaagcctctccactatctgactatcatgagcccgcagatgtgaattttgcttctgtctggtgcttgggctgttggcctcattcattcagtggcccagttagctttcgttgtccacttgactttttgtggtcctaatgagatagacagctttgcttttgctttgaaacttccttggttcatcaaacgtgtctgcgcagacccttacaggatggaattcatggtgactgccaacagcaggttcatttccatgggcgccttcttctcattgcttatctcctaagttttcatcctggtcactctctggaaacgttcctcaggtggtttgtctaaggccttttctactctgtcagtgcacattaaagaagctgtggtctat

SEQ ID NO: 2130 - protein, 62 aa, Canis familiaris
MYESNYSDVFWFISLALSTYRPALNFLLAFSSVFYVTVILGNLLVVFRVMFTLTYIPLCTSF

SEQ ID NO: 2131 - DNA, 1032 bp, Canis familiaris
atgaacaatactataaggctatctgtaatatggaaatctgttatttttgcagctttaaaaaaaaaagaatattccaacgtaaataattgttctagctctgtgagtgaattcatccttttgggcttcccttatacctgggaaattcagattctccttttctcaatcttctgtggaacttatattctgacactgactggaaatctgtgcattatctgtgctgtgaggtgggaccatcgcctacaaactccaatgtacatcctgctggccaatttctccttcctggagatctgctttatcacctccactgtccccaaaatgctagccaacttgctgtctgagaccagaaccatctgcttctatggctgcttcctccagttctacttcttcttctccgagggcaccgctgagaccttattcttgtctgccatggcctttgacaggtttcttgctatctgcaggcccctgcactaccccactgtcatgactgctcagcgctgcatcagaataggagctgggtgctgggtgtgtggcttcttatacttcctcttgcctatttacctcatctctcagctcccattttgttgttctaataagattgatcacttcctgtgtgacccaggacctcttatgaagctgtcctgtgtgccagctcctgctactgagatcatctgtgccatctataactcagtcctcattttctccaccttattcttcattaccagctcctataccttggtgatcagagctgtgctcagggtcccctcagcagaaggtcggcataaggccttctccacgtgtggctcccatctggctgtggtgtccctgttttatggctctatcatggttgtatatgtaagccccacagcaggaaatccagcagggatccaaaaatatgtgactttgttctattctgtgttaactccacttttcaaccctttgatctatagtcttcgaaataaagaaatgaaggaagctctgagaaagatatttagaattgtaagatttagtcaaaggcatgaaagaaatatttga

SEQ ID NO: 2132 - protein, 343 aa, Canis familiaris
MNNTIRLSVIWKSVIFAALKKKEYSNVNNCSSSVSEFILLGFPYTWEIQILLFSIFCGTYILTLTGNLCIICAVRWDHRLQTPMYILLANFSFLEICFITSTVPKMLANLLSETRTICFYGCFLQFYFFFSEGTAETLFLSAMAFDRFLAICRPLHYPTVMTAQRCIRIGAGCWVCGFLYFLLPIYLISQLPFCCSNKIDHFLCDPGPLMKLSCVPAPATEIICAIYNSVLIFSTLFFITSSYTLVIRAVLRVPSAEGRHKAFSTCGSHLAVVSLFYGSIMVVYVSPTAGNPAGIQKYVTLFYSVLTPLFNPLIYSLRNKEMKEALRKIFRIVRFSQRHERNI

SEQ ID NO: 2133 - DNA, 972 bp, Canis familiaris
atggttagatttcaaaagtcagtgatgagaaactatacagcaataacaacttttatcctgttgggactgacagacgacccacaactgcaaatcctgctctttatctttctatttctcacctacatcttgagcgtaacagggaacctgactattatcaccctcacactggtgaactcccatcttaaaactcctatgtacttttttctgagaaatttctccttcttagaagtgtcattcaccactgtctgcattcctagattcctgtatagtatatcaacaggggacaatactattacctacaatgcttgtgcaagtcaaatattttttgttattctctttggagcaactgaattttttctcctggcagccatgtcctatgatcgctatgttgctatctgtaaaccacttcattacatgaccatcatgagcaatagggtgtgtagcttattagtcttctgctgttgggtgtctggcttgatgatcattctcccaccccttagcttgggcctccagctggaattctgtgactccaatgccattgatcattttagctgtgatgcaggtcccctcctgaagatctcatgttcagatacatggatgatagagcaaatggttattcttgtggctgtatttgcactcattatcaccttagtgtgtgtatttctgtcctacacatacatcatcaggacgattctgagattcccctctgtccaacaaagaaaaaaggccttttccacctgctcatcccacatgattgtagtttccatcacctatggaagctgcatcttcatctatgtcaagccatcagcaaaagaagagatagccataaataaaggtgtttcggtgctcactacttctgttgcacccttgttgaaccccttcatttacaccttgagaaataagcaagtgaaacaagcttttaatgacttcataaagaagatgacatttcactcaatgaaactgaagttttga

SEQ ID NO: 2134 - protein, 323 aa, Canis familiaris
MVRFQKSVMRNYTAITTFILLGLTDDPQLQILLFIFLFLTYILSVTGNLTIITLTLVNSHLKTPMYFFLRNFSFLEVSFTTVCIPRFLYSISTGDNTITYNACASQIFFVILFGATEFFLLAAMSYDRYVAICKPLHYMTIMSNRVCSLLVFCCWVSGLMIILPPLSLGLQLEFCDSNAIDHFSCDAGPLLKISCSDTWMIEQMVILVAVFALIITLVCVFLSYTYIIRTILRFPSVQQRKKAFSTCSSHMIVVSITYGSCIFIYVKPSAKEEIAINKGVSVLTTSVAPLLNPFIYTLRNKQVKQAFNDFIKKMTFHSMKLKF

SEQ ID NO: 2135 - DNA, 912 bp, Canis familiaris
atgagaaaccaaacggcactaacaactttcatcttgctgggactcacagaggaccctcaactaaaaattttgctttttatgtttctgtttctttcctacatgttgaatgtatctggaaacctaaccatcatcatcctcactctgattgattcccaccttaaaacaccaatgtatcttttcttccaaaatttctccttcctagaaatttcattcacaactgcttgtgtccccagatttttatatagcatatcattgggggacaaatccattacctatcatgcttgtgtcagtcaactgttgtttacagacctctttgcagtaacagaattttttctcttggccactatgtcctatgatccctatgtggccatctgcaaacccctgcattacatgaccatcatgagcagaagagtctgcaagaacttcatcgtcttctgttgggtagcagcactgatcatcattctcccaccaattagtctaggtttgggcctggaattctgtgattcaaacatgattgatcatttttgttgtgatgcatctcctatcctgaagatctcttgctcagacacatggttgaaagaacagatggttatagtctgtgctgtgttgacattcatcatcaccctcatgtgtgtagttctttcttacatttatattatcgggaccattctaaggtttccctctgctcagcaaaggaaaaaggtcttttccacttgttcttcccacatgattgttgtttccattacttatggtagctgtatcttcatttatgtcaaaccttcagccaaggatgaggtagctattaataaagggatttcactccttattacttctatctcaccaatgttgaatccctttatttacacactgagaaacaagcaagtgaagaaagcttttcatgattcaatttaa

SEQ ID NO: 2136 - protein, 303 aa, Canis familiaris
MRNQTALTTFILLGLTEDPQLKILLFMFLFLSYMLNVSGNLTIIILTLIDSHLKTPMYLFFQNFSFLEISFTTACVPRFLYSISLGDKSITYHACVSQLLFTDLFAVTEFFLLATMSYDPYVAICKPLHYMTIMSRRVCKNFIVFCWVAALIIILPPISLGLGLEFCDSNMIDHFCCDASPILKISCSDTWLKEQMVIVCAVLTFIITLMCVVLSYIYIIGTILRFPSAQQRKKVFSTCSSHMIVVSITYGSCIFIYVKPSAKDEVAINKGISLLITSISPMLNPFIYTLRNKQVKKAFHDSI

SEQ ID NO: 2137 - DNA, 960 bp, Canis familiaris
atgagaaaccacacagaactaacagactttatcctcctgggattgtcagatgacccacagcttcaggaggtgatctttgtctttctgctcatcacctacattctcagcatcactgggaacctgaccattatcaccctcaccctgctggattcccacctccagacccccatgtatttcttcctcagaaacttctccttacttgagatttcattcacaactgtgagcatacccaagttcctgggcaccctgattacaggagataaaactgtttcctttaatgattgtatggctcagttattttttgttatttttttcattcttttgggagtcactgaattttacctgctggctgccatgtcctatgacagatacattgccatcggcaaacctctgcattatatgaccatcatgaatcccagagtctgcatactccttgtctttgcttcttggtcggcttcattcttaatcatattcccatcactcatgctgttcatacagcttgattattgtaagtccaatgttatacaccattttacctgtgactatttccccttgctacatctttcttgttcagacactagattcttagagatagtgggtttttcctgtgctgtgtttatgttaatgttcacattggtgataataattctgtcatacatatatatcctcagaacaattttgaggattccttctactagtcagaggacaaaggccttttccacctgttgttcttcccacatgattgtcatctctatctcctatggcagctgcattttcatgtatattaacccagcagcaaaagagcccagcagcaaaagagtgtctctgagcaagggagttgctgtgctagacacgttggtagctcccatgctgaacccctttatttacagcctaaggaaccagcaagtcaagcgagccttcctggacagggcaaggaagattgtatttttctcaagcaaa

SEQ ID NO: 2138 - protein, 320 aa, Canis familiaris
MRNHTELTDFILLGLSDDPQLQEVIFVFLLITYILSITGNLTIITLTLLDSHLQTPMYFFLRNFSLLEISFTTVSIPKFLGTLITGDKTVSFNDCMAQLFFVIFFILLGVTEFYLLAAMSYDRYIAIGKPLHYMTIMNPRVCILLVFASWSASFLIIFPSLMLFIQLDYCKSNVIHHFTCDYFPLLHLSCSDTRFLEIVGFSCAVFMLMFTLVIIILSYIYILRTILRIPSTSQRTKAFSTCCSSHMIVISISYGSCIFMYINPAAKEPSSKRVSLSKGVAVLDTLVAPMLNPFIYSLRNQQVKRAFLDRARKIVFFSSK

SEQ ID NO: 2139 - DNA, 939 bp, Canis familiaris
atgaaaaaccacacagtacccacagagttcattcttctagggctatcagatgacccagagtttcagattgtgatttttctctttttaattatcacatacatattcagtgtcactggaaatttgaccatcatcactctcaccttggtggactcccatctacagacccctatgtatttcttcctcaggaacttctctgtattagaaatatcctttacaaccgtctgtattcctaggtttctgggcacaattatcaccagagacaaaactatttcatacaataattgtacagctcagttgtttttcttcatcttcatgggcataactgagttttatcttctaactgctatgtcctatgatcgctatgtagccatctgtaaacccttgcattacacgactatcatgaacaaaagagtctgcattttacttgtcttttgtgcatggctggcaggattcttaaatatcttcccgccagttattcttttcctccagttagattactgtggctccaatgtcattgatcactttgcttgtgactattttcccctcttgcaattatcttgctcagacacatggctcctagaagtgattggtttttactctgcaatagtgattctgcttttcactctggcactaataattctatcctacatgttcatcattagaacaattctgaaactgccatctgccagtcagagaaaaaaggcattttctacatgctcctcgcacatgattgtcatttccatctcttatggaagctgcatattcatgtatgccaacccctctgcaaaagaaaaggcatccttgaccaaaggagtagctattcttaatacttctgttgctcctatgatgaatccatttatatatactctgaggaatcagcaagtaaaacaagcctttaaggatactatccaaaaggttctgtttttctccagtaaatga

SEQ ID NO: 2140 - protein, 312 aa, Canis familiaris
MKNHTVPTEFILLGLSDDPEFQIVIFLFLIITYIFSVTGNLTIITLTLVDSHLQTPMYFFLRNFSVLEISFTTVCIPRFLGTIITRDKTISYNNCTAQLFFFIFMGITEFYLLTAMSYDRYVAICKPLHYTTIMNKRVCILLVFCAWLAGFLNIFPPVILFLQLDYCGSNVIDHFACDYFPLLQLSCSDTWLLEVIGFYSAIVILLFTLALIILSYMFIIRTILKLPSASQRKKAFSTCSSHMIVISISYGSCIFMYANPSAKEKASLTKGVAILNTSVAPMMNPFIYTLRNQQVKQAFKDTIQKVLFFSSK

SEQ ID NO: 2141 - DNA, 945 bp, Canis familiaris
atgagaaaccacacagaaataacagattttatcctcctgggattgtcagatgacccacagcttcaggaggtgatctttgtctttctgcttatcacctacatgctcagcatcactgggaacctgacaattatcaccctcaccctgctggattcccacctccagacccccatgtatttcttcctcagaaacttctccttacttgagatttcattcacaactgtgagcatacccaagttcctgagcaccctgattacaggagataaaaacatttcctttaatgattgcatggctcagttctttttttttttaatcttcttgggagtcactgaattttgccttctggctgccatgtcctatgacagatacattgccatctgcaaacctctgcattacatgaccatcatgaatcccagagtctgcatactccttgtctttgcttcttggtcggcttcattcttaatcatattcccatcactcatgctgttcatacagcttgattattgtaagtccaatgttatacaccattttacctgtgactatttccccttactacattacatttcttgttcagacactagattcctagagatagtgggtttttcctgtgctgtgtttacattaatgttcacattggcattaataattctgtcctacatatatatcctcagaacaattttgaggattccttctactagtcagaggacaaaggctttttccacctgttgttcttcccacatgattgtcatctccatctcctatggcaactgcattttcatgtatattaacccagcagcaaaagacagagtgtctctgagcaagggagttgctgtgctaaacacctcggtagcccccatgctgaacccctttatttacagcctaaggaaccagcaagtcaagcgagccttcctggacagggcaaggaagattgtatttttctcaagcaaa

SEQ ID NO: 2142 - protein, 315 aa, Canis familiaris
MRNHTEITDFILLGLSDDPQLQEVIFVFLLITYMLSITGNLTIITLTLLDSHLQTPMYFFLRNFSLLEISFTTVSIPKFLSTLITGDKNISFNDCMAQFFFFLIFLGVTEFCLLAAMSYDRYIAICKPLHYMTIMNPRVCILLVFASWSASFLIIFPSLMLFIQLDYCKSNVIHHFTCDYFPLLHYISCSDTRFLEIVGFSCAVFTLMFTLALIILSYIYILRTILRIPSTSQRTKAFSTCCSSHMIVISISYGNCIFMYINPAAKDRVSLSKGVAVLNTSVAPMLNPFIYSLRNQQVKRAFLDRARKIVFFSSK

SEQ ID NO: 2143 - DNA, 936 bp, Canis familiaris
atgaaccacacagtgatcactgagtttgtcctgctaggcctttctgatgatcctgaccttcagattgtgattttcctcttcttattcctcacatacttactcagtgtcactggaaacctgactatcatcaccctaaccttggtggactctcatctacagacgccaatgtatttcttcctccgaaacttctctttcttagaaatcttatttacaactgtatgtattcctagatttctgggggcaattatcaccagggataagactatttcctataacaactgtgcagcccagctgtttttctttattttcatgggggtgacggaattttacattctcactgccatgtcttatgaccgctatgttgccatctgcaagccccttcattataccaccatcatgaacaggaaggtctgcaccctacttgtgctctgtgcatggcttggtgggttcctgaccattttcccaccccttatgcttctactccagctggattactgtgcttccaatgtcattgaccactttgcatgtgactattttccccttttacaactgtcttgttcagatacgtggctcctagaggtaattggtttctactttgctttagttgccttgctattcactttggccttggtgattttatcttatttgtatataatcagaactattttgagaatcccatctgccagtcagagaaaaaaggctttctccacgtgttcttctcatatgattgtcatttccatctcttatgggagctgtatatttatgtatgctaatccttctgcaaaagaaagggcatcattgaccaaaggagtagctattctcaatacttctgttgcccccatgctgaaccccttcatttacactctgagaaaccagcaagtaaaacaagctttcaaagatgtggtccataaagtagtattttcttcaagtaaatga

SEQ ID NO: 2144 - protein, 311 aa, Canis familiaris
MNHTVITEFVLLGLSDDPDLQIVIFLFLFLTYLLSVTGNLTIITLTLVDSHLQTPMYFFLRNFSFLEILFTTVCIPRFLGAIITRDKTISYNNCAAQLFFFIFMGVTEFYILTAMSYDRYVAICKPLHYTTIMNRKVCTLLVLCAWLGGFLTIFPPLMLLLQLDYCASNVIDHFACDYFPLLQLSCSDTWLLEVIGFYFALVALLFTLALVILSYLYIIRTILRIPSASQRKKAFSTCSSHMIVISISYGSCIFMYANPSAKERASLTKGVAILNTSVAPMLNPFIYTLRNQQVKQAFKDVVHKVVFSSSK

SEQ ID NO: 2145 - DNA, 210 bp, Canis familiaris; identical to SEQ ID NO: 539

SEQ ID NO: 2146 - protein, 39 aa, Canis familiaris; identical to SEQ ID NO: 540

SEQ ID NO: 2147 - DNA, 921 bp, Canis familiaris
atggagagccagaggaatgtctcagaattcattcttttgggactctcgcatgaccagaacatgcaaatattttgctttgtgctcttcttattctgttatgctgctctcttggtaggaaaccttctgatccttgtctctattcgatgcagccctctttttcaccaaccgatgtactacttcctcagccacttatccactttggacatctgctatatctctagcgttacacccaaattaattgctgacctgctagtggaaagaaaagccatctcctatggtaattgtatgttacagatctttgccatgcacttctttggaacgattgaggttttaattcttacagtcatggcctttgatcactatgctgccatctgcaaacctctccactacctgcttatcatgaacaggacaaggtgcaatctcctagtcttagctgcttgggctggtggggccgtccactcctttcctcaattttgtatggtaatcaggttgcccttctgtgggcctaatgagattgatcactatttctgtgatatatttcctttgctaaaggttgcctgcactgatacctacatcactggtgtccttatggttgccaattctggaatggttaccttggtgacatttgtggttttatttttttcgttctttcgttcgaatgtcattatattattcactttaagaaatcactcagcggaaggaagacgcaaagccctctctacctgtggatctcacatcacagttatagttttattttttgggccttccatctttgcctaccttagacctccaaccaatttccctgaggataaaatatttgctctgttttacaccatcattgctcctatgttcaatcccttaatctatactctgagaaattcagagatgaaaaatgccatgagaaaattttggtgccaaaca

SEQ ID NO: 2148 - protein, 307 aa, Canis familiaris
MESQRNVSEFILLGLSHDQNMQIFCFVLFLFCYAALLVGNLLILVSIRCSPLFHQPMYYFLSHLSTLDICYISSVTPKLIADLLVERKAISYGNCMLQIFAMHFFGTIEVLILTVMAFDHYAAICKPLHYLLIMNRTRCNLLVLAAWAGGAVHSFPQFCMVIRLPFCGPNEIDHYFCDIFPLLKVACTDTYITGVLMVANSGMVTLVTFVVLFFSFFRSNVIILFTLRNHSAEGRRKALSTCGSHITVIVLFFGPSIFAYLRPPTNFPEDKIFALFYTIIAPMFNPLIYTLRNSEMKNAMRKFWCQT

SEQ ID NO: 2149 - DNA, 846 bp, Canis familiaris
atgactgggggaggaaatactacagagatcacttatttcatccttttgggattctctgatttccccagaatcctagcagtgctctttgctgtattcctgctgatttacattttgactctgacttggaacctgggcctcatcatcttaataaggatggactctcacctccacacacccatgtacttcttcctcagtaatctgtccttcatagatgtctgctatgtgacctctacagctcccaagatgctctccaactttttccaagagcagcaaaccatcacctttgtgggttgtgccgttcagtactttgtcttttcaaccatgggactgagtgagtcttgtctcatgacagccatggcttatgaccgatacactgccatttgtaatccacttctctattcatcagtcatgtcacccacgctctgtattcagatggtgctgggatcctatctggctgcactctctgctagtatatcccagttgtgtgccatgtttcagcttcatttctgtgggcctaatgtcatcaatcacttcttctgtgacatgccccaactattaatcctgtcctgcactgacactttctttgtacatctgttgattgctatactagcaacgatctttgggatgataaatgcctttattattatgatatcctatggctatattgtcatgtccatcatgaaaatcacttcagctaaaggcagatccaaagctttcaacacctgtgcttctcatctgacagcagtttctctcttctatacctcaagtgtctttgtttatttgagttccagctctggtggttcctccagctttgacagatttgcatcagtattctacactgtggtt

SEQ ID NO: 2150 - protein, 282 aa, Canis familiaris
MTGGGNTTEITYFILLGFSDFPRILAVLFAVFLLIYILTLTWNLGLIILIRMDSHLHTPMYFFLSNLSFIDVCYVTSTAPKMLSNFFQEQQTITFVGCAVQYFVFSTMGLSESCLMTAMAYDRYTAICNPLLYSSVMSPTLCIQMVLGSYLAALSASISQLCAMFQLHFCGPNVINHFFCDMPQLLILSCTDTFFVHLLIAILATIFGMINAFIIMISYGYIVMSIMKITSAKGRSKAFNTCASHLTAVSLFYTSSVFVYLSSSSGGSSSFDRFASVFYTVV

SEQ ID NO: 2151 - DNA, 915 bp, Canis familiaris
atggtgatgaatagcactgtgaatgaattcattctgtttggcttgacacaggatccaagaaaacagaaagcaatatttggggtcttcttgatgctttatcttgccacactgttgggaaattttctcattgtagtgactattaaaagaagcaggacccttgggagtcccatgtacttcttcctattttacctgtcctttactgatgcttgcctctctacaaccattatccccagattgattgtggatgccatttctcagaggaagaccatttcctacaatgagtgcatgactcaggtcttttcagcccacttctttggatgcatggaaatcttcgtgctgatcgtcatggcttttgatcgctatgtagccatttgtaagcccttgcgatacacaaccatcatgaacaggcatgtctgcagtgtgctggtgattctgggttgggtgggatcctgtatccactcttcggcacaaattgtcctggctttgagattgcctttctgtggtcccaatgtgattgatcactatttctgtgacttgcagcccttgttgaaacttgcttgcatggacacttatgtaataaatttgctagttgtttctaacagtggagccatatgcacggtgagtttcataatcctgcttatctcctatgttatcatcttgtactctctgagaaactacagtgcagaaggaaggcgaaaagccctttcaacctgcacctcccattttattgtggttgtcctattttttggcccatgtatattcatatatacacgtccggcaaccacatttccagtagacaaggtggtggctgtgttttataccattggggcacccttgctcaaccctctgatctatacactgaggaatgcggaagtgaaaaatgccatgaaaaagttatggtgtaacaaagtgtga

SEQ ID NO: 2152 - protein, 304 aa, Canis familiaris
MVMNSTVNEFILFGLTQDPRKQKAIFGVFLMLYLATLLGNFLIVVTIKRSRTLGSPMYFFLFYLSFTDACLSTTIIPRLIVDAISQRKTISYNECMTQVFSAHFFGCMEIFVLIVMAFDRYVAICKPLRYTTIMNRHVCSVLVILGWVGSCIHSSAQIVLALRLPFCGPNVIDHYFCDLQPLLKLACMDTYVINLLVVSNSGAICTVSFIILLISYVIILYSLRNYSAEGRRKALSTCTSHFIVVVLFFGPCIFIYTRPATTFPVDKVVAVFYTIGAPLLNPLIYTLRNAEVKNAMKKLWCNKV

SEQ ID NO: 2153 - DNA, 924 bp, Canis familiaris
cactttcaagattttgtactagagggatttaggggtggtctggagacccaagccatgctcttcactgtcttcttggccttgtacatggtgactatactgggcaacttcctcatgatcatctttagcaccctggatgcctgcctacacttcccaatgtatgtcttcctcaagaacccctccttcatggacttgtgctactcatctgttattacccccaatgcaccggccaactacttctcctcatccaaggtcatcacctttacagaatgtgccacccagtttttctttttatccctggtggctaccactgaatgcttcctcctgggtgttatgtcctacgaccacttcatggccatttgtagacacttgagctaccctagcaccatgtgccagtctggctgcactcgcctggtgctgtgcacctactgtggaggctgcttcaactctggtgcagagaagcttcacattcaacctctcattctgcagctccaactgcatcaaccacgtcctctgtgatgtgccccctctgttccatatcgcctgtggcaagacggccatcaatgaacttctcttgtttggcatctgtgggctcatgattgtgggtgtgacatatatggtcctcatctcctatggttacataatagtgaccatcctgaggatgggctcaggagcggtagatgcaagatcttctccacctgtggctcccacatgactgcaatgaccctctttttgggatttgggaccgtctttgtaatatatacccagccaggagcaactgagtccatggagcagggcaaggtggtctctgtcttctacacgctggtcatcccagagctcaatcccctcatctacagtctgcaaaacaaggatgtgaaggaggctgtgtggaggctgggccagaaacacatggccacgtgaaggatg

SEQ ID NO: 2154 - protein, 171 aa, Canis familiaris
HFQDFVLEGFRGGLETQAMLFTVFLALYMVTILGNFLMIIFSTLDACLHFPMYVFLKNPSFMDLCYSSVITPNAPANYFSSSKVITFTECATQFFFLSLVATTECFLLGVMSYDHFMAICRHLSYPSTMCQSGCTRLVLCTYCGGCFNSGAEKLHIQPLILQLQLHQPRPL

SEQ ID NO: 2155 - DNA, 1077 bp, Canis familiaris
atggagggtgcaaacctgtcagcagtgacggaatttgtcttcactggcttcccccagctccaggatggtggcctcctgtacttcttccccttactcttcatctacacctttgttgtcgttgggaatctattgatcttctttgcggtcaggatggatgtccgcctccacaaccccatgtacaacttcatcagcaccttctccttcctggaggtctggtacaccacagccaccatccccaagatgctctccaacctggtcagtgagaagaaaaccatctccatgaccggctgcctcctgcagatgtacttcttccattcccttgggaattcagaggcgatcttgctgatcactatggccattgacaggtacgtggccatctgcaaccctctccgctaccagatgatcatgaccccccggctgtgtgctcagctgtctgcaggctcctgcatctttggcttcctcatcctacttcctgagattgtaacgatttccacactgcccttctgtgggcccaaccaaatccatcagatcttctgtgacttggtgccagtgctgaggctggcctgtacaaacgcgtccgtgattctggttgaagatgtgatccacgctgtggccatcatcatcaccatcctaatcattgccctatcctacatcagaatcgtctctgtgatcctgaggatcccctctgctgagggtcggcagaaggccttttctacctgtgggggccatctcactgtcttcctgattttctttggcagtgtgtccctcatgtacttgcgtttcaatgccacctaccccccagctttggacacagccattgcactgatgtttactgtccttgctccattcttccaccccatcatttatagtctgagaaacaaggacatgaagaatgcaattagaaaactcgtccaggggatccctgggtggctcagtggtttggcgcctgcctttggcccaaggcgcgatcctggagtcccgggatcgagtcccacgtcaggctcccggtgcatggagcctgcttctccctctgcctgtatctgtctgtctgtctctctctctgtctatcataaataa

SEQ ID NO: 2156 - protein, 358 aa, Canis familiaris
MEGANLSAVTEFVFTGFPQLQDGGLLYFFPLLFIYTFVVVGNLLIFFAVRMDVRLHNPMYNFISTFSFLEVWYTTATIPKMLSNLVSEKKTISMTGCLLQMYFFHSLGNSEAILLITMAIDRYVAICNPLRYQMIMTPRLCAQLSAGSCIFGFLILLPEIVTISTLPFCGPNQIHQIFCDLVPVLRLACTNASVILVEDVIHAVAIIITILIIALSYIRIVSVILRIPSAEGRQKAFSTCGGHLTVFLIFFGSVSLMYLRFNATYPPALDTAIALMFTVLAPFFHPIIYSLRNKDMKNAIRKLVQGIPGWLSGLAPAFGPRRDPGVPGSSPTSGSRCMEPASPSACICLSVSLSVYHK

SEQ ID NO: 2157 - DNA, 939 bp, Canis familiaris
atggggggacggaacgccaccaaggtcagcgtcttcgtcctgctgggcttccccacggcccctcggctgcagtacgtgctcttcctcgtcttcctgctcacctacctcttcatcctggtggagaacctcgtcatcatcgtcaccgtccgccgcagcgcccccctccacaggcccatgtactacttcctgggcgccctgtctgtcctggaggtctggtacgtgtcggtcatcatccccaagatgctgggggggctcctcctgcagcagaaactcatctcctttgccggctgcatgacccagctctacttcttcagctccctggtgtgcaccgaatgcgtgctcctggcctccatggcctacgaccgctacgtggccatctgccaccccctgcgctaccaagtcatcatgaccacggggctctgcgtccggctggtggccttctccttcgtcagcggcttctccatctctatgatcaaggtgttctttgtctccagggccacgttctgtggctccaacgtcctgaaccacttcttctgtgacatttcccccatcctcaagctggcctgcaccgacttctcgaccgcggagctggtggacttcatcctggccttcatcatcctggtgtcgcccctggtggccaccgtgctgtcctacgggcacatcaccctggccgtcctgcgcatcccctcggccacgggccgctggagggccttctccacctgcgcctcccacctcaccgtggtcaccatcttctacacggccatgatcttcatgtacgtccggccccaggccatcgattcccggagctccaataagctcatctctgcggtgtacactgtcctcaccccgataatcaaccccttgatctactgcctgaggaacaaagaatttaaggctgccttgaaaaaggctctgggctttggtcaaattcccacatag

SEQ ID NO: 2158 - protein, 313 aa, Canis familiaris; identical to SEQ ID NO: 1530

SEQ ID NO: 2159 - DNA, 939 bp, Canis familiaris
atgagaaaccacacagaactaacagactttatcctcctgggattgtcagatgacccacagcttcaggaggtgatctttgtctttctgcttatcacctacatgctcagcatcactgggaacctgaccattatcaccctcaccctgctggattcccacctccagacccccatgtatttcttcctcagaaacttctccttacttgagatttcattcacaactgtgagcatacccaagttcctgagcaccctgattacaggagataaaactgtttcctttaatgattgtatggctcagttattttttttcattctgttgggagtcactgaattttacctgctggctgccatgtcctatgaccgatacattgccatctgcaaacctctgcattacatgaccatcatgaatcccagagtctgcatactccttgtctttgcttcttggtcggcttcattcttaatcatattcccatcactcatgctgttaatacagcttgattattgtaagtccaatgctatagaccattttacctgtgactatttccccttactacatctttcttgttcagacactagattcttagagatagtgggtttttcctgtgctgtttttacgttaatgttcacattgatgataataattctgtcctacatatatatcctcagaacaattttgaagattccttctactagtcagaggacaaaggccttttccacctgttcttcccacatgattgtcatctctatctcctatggcagctgcattttcatgtatattaacccagcagcaaaagacagagtgtctctgagcaagggagttgctgtgctaaacacctcggtagcccccatgctgaacccctttatttacagcctaaggaaccagcaagtcaagcgagccttcctggacagggcaaggaagattgtatttttctcaagcaaatga

SEQ ID NO: 2160 - protein, 312 aa, Canis familiaris
MRNHTELTDFILLGLSDDPQLQEVIFVFLLITYMLSITGNLTIITLTLLDSHLQTPMYFFLRNFSLLEISFTTVSIPKFLSTLITGDKTVSFNDCMAQLFFFILLGVTEFYLLAAMSYDRYIAICKPLHYMTIMNPRVCILLVFASWSASFLIIFPSLMLLIQLDYCKSNAIDHFTCDYFPLLHLSCSDTRFLEIVGFSCAVFTLMFTLMIIILSYIYILRTILKIPSTSQRTKAFSTCSSHMIVISISYGSCIFMYINPAAKDRVSLSKGVAVLNTSVAPMLNPFIYSLRNQQVKRAFLDRARKIVFFSSK

SEQ ID NO: 2161 - DNA, 882 bp, Canis familiaris
ccagagtttcagattgtgatttttctctttttaattctcacatacatattcagtgtcactggaaatttgaccatcatcactctcaccttggtggactcccatctacagacccctatgtattttttcctcaggaacttctctgtattagaaatatcctttacaaccgtctgtattcctagatttctgggcacaattatcaccagagactaaactatttcatacaatgattgtacagctcagttgtttttcttcatcttcatgggcataactgagttttatcttctaactgctatgtcctatgatcgctatgtagccatctgtaaacccttgcattacacgactatcatgaacaaaagagtctgcattttacttgtcttttgtgcatggctggcaggattcttaaatatcttcccgccaattattcttttcctccagttagattactgtggctccaatgtcattgatcactttgcttgtgactattttcccctcttgcaattatcttgctcagacacatggctcctagaagtgattggtttttactctgcaatagtgattctgcttttcactctggcactaataattctatcctacatgttcatcattagaacaattctgaaactgccatctgccagtcagagaaaaaaggcattttctacatgctcctcgcacatgattgtcatttccatctcttatggaagctgcatattcatgtatgccaacccctctgcaaaagaaaaggcatccttgaccaaaggagtagctattcttaatacttctgttgctcctatgatgaatccatttatatataccctgaggaatcagcaagtaaagcaagcctttaaggatactatccaaaaggttctgtttttctccagtaaa

SEQ ID NO: 2162 - protein, 208 aa, Canis familiaris; identical to SEQ ID NO: 1680

SEQ ID NO: 2163 - DNA, 327 bp, Canis familiaris
atgcggggacggaacgccaccaaggtcagcgtcttcgtcctgctgggcttccccacggcccctcggctgcagtacgtgctcttcctcgtcttcctgctcacctacctcttcatcctggtggagaacctcgtcatcatcgtcaccgtccgccgcagcgcccccctccacaggcccatgtactacttcctgggcgccctgtctgtcctggaggtctggtacgtgtcggtcatcatccccaagatgctgggggggctcctcctgcagcagaaactcatctcctttggcggctgcatgacccggctctacttcattggcctgcgcctgtgt

SEQ ID NO: 2164 - protein, 109 aa, Canis familiaris
MRGRNATKVSVFVLLGFPTAPRLQYVLFLVFLLTYLFILVENLVIIVTVRRSAPLHRPMYYFLGALSVLEVWYVSVIIPKMLGGLLLQQKLISFGGCMTRLYFIGLRLC

SEQ ID NO: 2165 - DNA, 939 bp, Canis familiaris
atgcggggacggaacgccaccaagctcagcgtcttcgtcctgctgggcttccccacggcccctcagctgcagtacgtgctcttcctcgtcttcctgctcacctacctcttcatcctggtggagaacctcgtcatcatcgtcaccgtccgccgcagcgcccccctccacaggcccatgtactacttcctgggcgccctgtctgtcctggaggtctggtacgtgtcggtcatcatccccaagatgctgggggggctcctcctgcagcagaaactcatctcctttgccggctgcatgacccagctctacttcttcagctccctggtgtgcaccgaatgcgtgctcctggcctccatggcctacgaccgctacgtggccatctgccaccccctgcgctaccaagtcatcatgaccacggggctctgcgtccggctggtggccttctccttcgtcagcggcttctccatctctatgatcaaggtgttctttgtctccagggccaccttctgtggctccaacgtcctgaaccacttcttctgtgacatttcccccatcctcaagctggcctgcaccgacttctcgaccgcggagctggtggacttcatcctggccttcatcatcctggtgtcgcccctggtggccaccgtgctgtcctacgggcacatcaccctggccgtcctgcgcatcccctcggccacgggccgctggagggccttctccacctgcgcctcccacctcaccgtggtcaccatcttctacacggccatgatcttcatgtacgtccggccccaggccatcgattcccggagctccaataagctcatctctgcggtgtacactgtcctcaccccgataatcaaccccttgatctactgcctgaggaacaaagaatttaaggctgccttgaaaaaggctctgggctttggtcaagttcccacatag

SEQ ID NO: 2166 - protein, 313 aa, Canis familiaris
LCGNLTKAQSLFQGSLKFFVPQAVDQGVDYRGEDSVHRRDELIGAPGIDGLGPDVHEDHGRVEDGDHGEVGGAGGEGPPAARGRGDAQDGQGDVPVGQHGGHQGRHQDDEGQDEVHQLRGREVGAGQLEDGGNVTEEVVQDVGATEGGPGDKEHLDHRDGEAADEGEGHQPDAEPRGHDDLVAQGVADGHVAVVGHGGQEHAFGAHQGAEEVELGHAAGKGDEFLLQEEPPQHLGDDDRHVPDLQDRQGAQEVVHGPVEGGAAADGDDDDEVLHQDEEVGEQEDEEEHVLQLRGRGEAQQDEDAELGGVPSPH

SEQ ID NO: 2167 - DNA, 942 bp, Canis familiaris
atgaaaatgggcaaccgaactgtcatctcagaattcatcctgctgggcctgcccattgatccagatcagcgagacctgttctacgccctgttcctggccatgtacgttaccaccatcctggggaacctactcatcattgtcctcattcacctggactcgcacctccacacacccatgtatttgtttctcagcaatttatccttctctgacctctgcttctcttctgtcacaatgcccaagttgctgcagaacatgcagagccaagtcccgtccatcccctatgctggctgcctgacccaaatgtacttcttcctgttttttggagatctggagagcttcctcctggtggccatggcctatgaccgctatgtggccatctgcttccccctacactacaccaccatcatgagccccaagctctgtttctccctgttggtgctgtcatgggtgctgaccatgttccatgctgtattacacactctgttaatggccagattgtgtttttgtgccaacacaatcccccactttttctgtgatatttctgctctgctgaagctggcctgctctgacactcaagttaatgagttggtgatatttatcatgggagggctcattctcgtgatcccattcctgctcatcatcacgtcttatgcacggattgtgtcctccatcctcaaggttccttctgccataggcatctgcaaggtcttctccacctgtggctcccacctctcagtggtgtctctcttctatgggacagttattggtctctatttatgcccatcagctaataattctactgttaaggagactatcatggctatgatgtacactgtggtcacccccatgctgaaccccttcatctacagcctgaggaataaagacatgaagggagccctgagaagagtcatttgtagaaagaaaattaccttctctgtgtga

SEQ ID NO: 2168 - protein, 313 aa, Canis familiaris
MKMGNRTVISEFILLGLPIDPDQRDLFYALFLAMYVTTILGNLLIIVLIHLDSHLHTPMYLFLSNLSFSDLCFSSVTMPKLLQNMQSQVPSIPYAGCLTQMYFFLFFGDLESFLLVAMAYDRYVAICFPLHYTTIMSPKLCFSLLVLSWVLTMFHAVLHTLLMARLCFCANTIPHFFCDISALLKLACSDTQVNELVIFIMGGLILVIPFLLIITSYARIVSSILKVPSAIGICKVFSTCGSHLSVVSLFYGTVIGLYLCPSANNSTVKETIMAMMYTVVTPMLNPFIYSLRNKDMKGALRRVICRKKITFSV

SEQ ID NO: 2169 - DNA, 939 bp, Canis familiaris
atgcggggacggaacaccaccaaggtcagcgtcttcgtcctgctgggcttccccacggcccctcggctgcagtacgtgctcttcctcgtcttcctgctcacctacctcttcattttggtggagaaccttgtcatcatcgtcaccgtccgccgcagcgcccccctccacaggcccatgtactacttcctgggcgccctgtctgtcctggaggtctggtacgtgtctgacatcgtccccaagatgctgggggggctcctcctgcagcagaaactcatctcctttgccggctgcatgacccagctctacttcttcagctccctggtgtgcaccgaatgcgtgctcctggcctccatggcctacgaccgctacgtggccatctgccaccccctgcgctaccaagtcatcatgaccacggggctctgcgtccggctggtggccttctccttcgtcagcggcttctccatctctatgatcaaggtgttctttgtctccagggccacgttctgtggctccaacgtcctgaaccacttcttctgtgacatttcccccatcctcaagctggcctgcaccgacttctcgaccgcggagctggtggacttcatcctggccttcatcatcctggtgtcgcccctggtggccaccgtgctgtcttacgggcacatcaccctggccgtcctgcgcatcccctcggccacgggccgctggagggccttctccacctgcgcctcccacctcaccgtggtcaccatcttctacacggccatactcttcatgtacgtccggccccaggccatcgattcccggagctccaacaagctcatctctgctctctacactgtcctcaccccgataatcaaccccttgatctactgcctgaggaacaaagaatttaaggctgccttgaaaaaggctctgggctttggtcaagttcccacgtag

SEQ ID NO: 2170 - protein, 313 aa, Canis familiaris
LRGNLTKAQSLFQGSLKFFVPQAVDQGVDYRGEDSVESRDELVGAPGIDGLGPDVHEEYGRVEDGDHGEVGGAGGEGPPAARGRGDAQDGQGDVPVRQHGGHQGRHQDDEGQDEVHQLRGREVGAGQLEDGGNVTEEVVQDVGATERGPGDKEHLDHRDGEAADEGEGHQPDAEPRGHDDLVAQGVADGHVAVVGHGGQEHAFGAHQGAEEVELGHAAGKGDEFLLQEEPPQHLGDDVRHVPDLQDRQGAQEVVHGPVEGGAAADGDDDDKVLHQNEEVGEQEDEEEHVLQPRGRGEAQQDEDADLGGVPSPH

SEQ ID NO: 2171 - DNA, 243 bp, Canis familiaris
atgaatcacacagtgatcaccaagtttgtcctgctaggcctttctgatgatcctgaccttcagattgtgattttcctcttcttattcgtcacatacttactaagtgtcactggaaacctgactatcatcaccctaaccttggtggactctcatctacagacgccaatgtatttcttcctccgaaacttctctttcttagaaatcttatttacaactgtatgtattcctagatttctgggggca

SEQ ID NO: 2172 - protein, 81 aa, Canis familiaris
MNHTVITKFVLLGLSDDPDLQIVIFLFLFVTYLLSVTGNLTIITLTLVDSHLQTPMYFFLRNFSFLEILFTTVCIPRFLGA

SEQ ID NO: 2173 - DNA, 345 bp, Canis familiaris
atgaggaaagagctgaacaggaattcctcagaagtgactgagttcattctactgggcttcagaacagcttcagacatacagatcctctcattcttattcctcttgctggtctacatggtcatcatagtgagaaatatcagcatgataattgtcatcaggatggactccagacttcatacgcctatgtatttcttccttagaaacttgtcctatttagatctctgctactccacagtcattgctcctaaagctctggctattttcttgtccaaggacaagaaaatttcatacaatggccatgcagcatagttcttttcctttgctgtgatgggactgaaggctttc

SEQ ID NO: 2174 - protein, 102 aa, Canis familiaris
MRKELNRNSSEVTEFILLGFRTASDIQILSFLFLLLVYMVIIVRNISMIIVIRMDSRLHTPMYFFLRNLSYLDLCYSTVIAPKALAIFLSKDKKISYNGHAA

SEQ ID NO: 2175 - DNA, 918 bp, Canis familiaris
atgggtgacaggggaaccggcaatcactctgacgtgactgactttattcttgtaggcttcagggtctcccccgaactctacattctcctcttcctgctcttcctgcctgtgtatgccatgatcctgctggggagtgttgggatggtggctattatcctgagtgatcccaggctgaacacactgatgtatttcctcctgggcaacctctccttcattgacctcttctattcctctgtaatagcgcccaaggctatgatcaacttctggtctgagagcaagtccatctcctttgcaggcgtgactcagctctttctctttgccctcttcattgtggctgaggggtttctcctggctgccatggcttatgaccgcttcattgccatctgcaactcactcctctactctgtccagatgtcaacgcgcctctgcattcagttggtggctggttcccatttttgtggctgcatcagctcggttcttcaaacgagtatgacatttactttgtccttttgtgcttcccgagccatcgaccacttttactgtgatgaccgtccacttcaaaggattacttgctctgatctctactttcataggatagtttcctttcccttatgcagcattattattttgcctaccatcattgtcattctcgtgtcctatatgtatattgtgtccacagttctaaagataagatccactgagggatgtaagaaagccttctccacttgcagctctcacctaggagtcatgagcgtcctgtacggtgccatcattttaatgtatttcatccctgacagattccctgagctgagtaaagtagctccttatgttatacattagtcactcatgttgaatcctttgatttactccctgagaaacaaagatgtcaaagaggctctgagaaagatcctggggaaa

SEQ ID NO: 2176 - protein, 279 aa, Canis familiaris
MGDRGTGNHSDVTDFILVGFRVSPELYILLFLLFLPVYAMILLGSVGMVAIILSDPRLNTLMYFLLGNLSFIDLFYSSVIAPKAMINFWSESKSISFAGVTQLFLFALFIVAEGFLLAAMAYDRFIAICNSLLYSVQMSTRLCIQLVAGSHFCGCISSVLQTSMTFTLSFCASRAIDHFYCDDRPLQRITCSDLYFHRIVSFPLCSIIILPTIIVILVSYMYIVSTVLKIRSTEGCKKAFSTCSSHLGVMSVLYGAIILMYFIPDRFPELSKVAPYVIH

SEQ ID NO: 2177 - DNA, 816 bp, Canis familiaris
gggaactgcctggtgctgcatgtgatccggactgagccgagcctgcaccagcccatgttctacttcctggccatgctggccctcactgacctgtgcatggggctgtccacggtgcacacggtgctgggcatcctgtggggacttagccaggaagtcagcctggatgcctgcattgctcaaacttatttcatccatggtctgtccctcacagagtctggagtccttctcgccatggctttggatcgctttacagcgatctgtaaccctctgaggtatacgtccatactaaccagtgccaggattaccaagattgggctgggaattttagttaggagttttgtgttcattatggctcccataatccgcctaaagtttttccactattgccattcccacatactctcgcactctttttgccttcaccaagacttaccaagactagcatgttctgacattcgctttaacagtttctaggccttggctctggtgatttgcacacttttgtttgattccatgctaattattgtatcctacattctgatcctgcattctgtcttggctattgcatcccgggaggagcggcttaagtccttgcagacctgtgtctcccatatctgtgctgtcatggttttctatatcccaataatcggtctgactatggtgcatcgttttgggaaacacctctctcctatggtccatgtcctcatgggcaacatctatatcatcttcccacccttgatgaaccccatcatctacagtgtcaaaacccaacaaatccgtggcaggattcagaagtggttttccatgaaaaaggag

SEQ ID NO: 2178 - protein, 157 aa, Canis familiaris
GNCLVLHVIRTEPSLHQPMFYFLAMLALTDLCMGLSTVHTVLGILWGLSQEVSLDACIAQTYFIHGLSLTESGVLLAMALDRFTAICNPLRYTSILTSARITKIGLGILVRSFVFIMAPIIRLKFFHYCHSHILSHSFCLHQDLPRLACSDIRFNSF

SEQ ID NO: 2179 - DNA, 942 bp, Canis familiaris
atgcctgcttttcctgcttatgacaccaattcctccacctttctactaacaggcttccctggcctggaacaggaatatccctggctgtccatccctttctcctgtatctaggctatggtactgtctgggaactgcctggtgctgcatgtgatccggactgagccgagcctgcaccagcccatgttctacttcctggccatgctggccctcactgacctgtgcatggggctgtccacggtgcacacggtgctgggcatcctgtggggacttagccaggaagtcagcctggatgcctgcattgctcaaacttatttcatccatggtctgtccctcacagagtctggagtccttctcgccatggctttggatcgctttacagcgatctgtaaccctctgaggtatacgtccatactaaccagtgccaggattaccaagattgggctgggaattttagttaggagttttgtgttcattatggctcccataatccgcctaaagtttttccactattgccattcccacatactctcgcactctttttgccttcaccaagacttactaagactagcatgttctgacattcgctttaacagtttctaggccttggctctggtgatttgcacacttttgtttgattccatgctaattattgtatcctacattctgatcctgcattctgtcttggctattgcatcccgggaggagcggcttaagtccttgcagacctgtgtctcccatatctgtgctgtcatggttttctatatcccaataatcggtctgactatggtgcatcgttttgggaaacacctctctcctatggtccatgtcctcatgggcaacatctatatcatcttcccacccttgatgaaccccatcatctacagtgtcaaaacccaacaaatccgtggcaggattcagaagtggttttccatgaaaaaggag

SEQ ID NO: 2180 - protein, 101 aa, Canis familiaris
MLIIVSYILILHSVLAIASREERLKSLQTCVSHICAVMVFYIPIIGLTMVHRFGKHLSPMVHVLMGNIYIIFPPLMNPIIYSVKTQQIRGRIQKWFSMKKE

SEQ ID NO: 2181 - DNA, 282 bp, Canis familiaris
atgtctgttcaatctgattccaaagtcagtaacttcacctttctacttacgggattccctggactggagcaagaatatccctggctgtccatccctttctcctgtatctatgctatggtactgtctgggaactgcctggtgctgcatgtgatccggactgagccgagcctgcaccagcccatgttctacttcctggccatgctggccctcactgacctgtgcatggggctgtccactatgtacacggtactgggcatcctgtgggggctcagccaggagata

SEQ ID NO: 2182 - protein, 94 aa, Canis familiaris
MSVQSDSKVSNFTFLLTGFPGLEQEYPWLSIPFSCIYAMVLSGNCLVLHVIRTEPSLHQPMFYFLAMLALTDLCMGLSTMYTVLGILWGLSQEI

SEQ ID NO: 2183 - DNA, 951 bp, Canis familiaris
atgtccaagctcaatggcacaatcttcatgcccccggtgctgacactgattgggatccccggcttggagtctgtgcagttctggattggaattcctttctgtgccatgtacatcattgctctgtttgggaattccctgctcctggtcatcatcaaatcagaacgcagcctccatgagcccatgtatctcttcctggcaatgcttggagtcacagacattgttctcagcacctgcatcctaccaaaaatgctaggcatcttctggtttcatctgcctgacatatactttgatgcctgtctctttcagatgtggcttatccacaccttccaatccattgaatcaggaattctgttcgccatggccctggaccgctatgtggccatctgtgatcccctgagacacgcatccatctttacacacaaacttctcactcagattggagtgggagtgatgctcagagcagccctccttgtagctccatgtctcatcctcatcaaatgtcggctgaaacacttccggaccactgtggtctcccattcatactgtgagcacatggccattgtgaagttggcagcagaagacattcgagtcaacaagatctgtggtctctttgtggccttcactctacttggatttgacataatcttcatcaccctctcctacatccgaatatttataactgtcttcaatctgcctcagagggaagctaggctcaaagccttcaacacctgcattgcccatatttgcgtcttccttgagttttatctccttggtttcttctccttctttacacacaggtttgggttccatattccaccctacattcatattcttctgtccaacctttacctgcttgtccctcctttgctcaatcctatagtgtatggggtgaagaccaaacagattcgagatcgagtgtccaaggttttccactctaaagattcatcttga

SEQ ID NO: 2184 - protein, 316 aa, Canis familiaris
MSKLNGTIFMPPVLTLIGIPGLESVQFWIGIPFCAMYIIALFGNSLLLVIIKSERSLHEPMYLFLAMLGVTDIVLSTCILPKMLGIFWFHLPDIYFDACLFQMWLIHTFQSIESGILFAMALDRYVAICDPLRHASIFTHKLLTQIGVGVMLRAALLVAPCLILIKCRLKHFRTTVVSHSYCEHMAIVKLAAEDIRVNKICGLFVAFTLLGFDIIFITLSYIRIFITVFNLPQREARLKAFNTCIAHICVFLEFYLLGFFSFFTHRFGFHIPPYIHILLSNLYLLVPPLLNPIVYGVKTKQIRDRVSKVFHSKDSS

SEQ ID NO: 2185 - DNA, 471 bp, Canis familiaris
atggcagacaatgctacacatagctacatctcatcttttttcctggttggtattcctggtttgcaagcttttcactgctggattggcatccctgtctgcctcctgtttgccctggccctgctggggaacagtgtaatcatcatcaccatcaaaatagaacccagcctccacctgcctgtgtatttcttcctttgtatgctggcagtgaatgacatggctcttgtctcttccacagcccccaagatgctgggtatcttctggttggatgctcacaagtttgactttagtatctgtctagcacaaatgtattttatccacacattctgcataattgagtcagccctcttggttgccatggccttcgaccggtatgtagctatttgtatcccactgcgttatacaaccatcttgacaacaccaatggtcactaaaatgggtctagctggtgtgatccgagctacctttatggtg

SEQ ID NO: 2186 - protein, 157 aa, Canis familiaris
MADNATHSYISSFFLVGIPGLQAFHCWIGIPVCLLFALALLGNSVIIITIKIEPSLHLPVYFFLCMLAVNDMALVSSTAPKMLGIFWLDAHKFDFSICLAQMYFIHTFCIIESALLVAMAFDRYVAICIPLRYTTILTTPMVTKMGLAGVIRATFMV

SEQ ID NO: 2187 - DNA, 516 bp, Canis familiaris
atgcctgcttttcctgcttatgacaccaattcctccacctttctactaacaggcttccctggcctggaacaggaatatccctggctgtccatccctttctcctgtatctaggctatggtactgtctgggaactgcctggtgctgcatgtgatccggactgagccgagcctgcaccagcccatgttctacttcctggccatgctggccctcactgacctgtgcatggggctgtccacggtgcacacggtgctgggcatcctgtggggacttagccaggaagtcagcctggatgcctgcattgctcaaacttatttcatccatggtctgtccctcacagagtctggagtccttctcgccatggctttggatcgctttacagcgatctgtaaccctctgaggtatacgtccatactaaccagtgccaggattaccaagattgggctgggaattttagttaggagttttgtgttcattatggctcccataatccgcctaaagtttttccactattgccat

SEQ ID NO: 2188 - protein, 134 aa, Canis familiaris
MVLSGNCLVLHVIRTEPSLHQPMFYFLAMLALTDLCMGLSTVHTVLGILWGLSQEVSLDACIAQTYFIHGLSLTESGVLLAMALDRFTAICNPLRYTSILTSARITKIGLGILVRSFVFIMAPIIRLKFFHYCH

SEQ ID NO: 2189 - DNA, 318 bp, Canis familiaris
atgtctgttcaatctgattccaaagtcagtaacttcacctttctactaacgggattccctggactggagcaagaatatccctggctgtccatccctttctcccgtatctatgctatggtactgtctgggaactgcctggtgctgcatgtgatccggactgagccgagcctgcaccagcccatgttctacttcctggccatgctggccctcactgacctgtgcatggggctgtccacagtgcacacggtgctgggcatcctgtgggggctcagccaggagatttggatgcctgcattgcctaaaacttctttattcatg

SEQ ID NO: 2190 - protein, 106 aa, Canis familiaris
MSVQSDSKVSNFTFLLTGFPGLEQEYPWLSIPFSRIYAMVLSGNCLVLHVIRTEPSLHQPMFYFLAMLALTDLCMGLSTVHTVLGILWGLSQEIWMPALPKTSLFM

SEQ ID NO: 2191 - DNA, 951 bp, Canis familiaris
atgtccaagctcaatggcacaatcttcatgcccccggtgctgacactgattgggatccccggcttggagtctgtgcagttctggattggaattcctttctgtgccatgtacatcattgctctatttgggaattccctgctcctgatcatcatcaaatcagaacgcagcctccatgagcccatgtatctcttcctggcaatgctaggagcaacagacattgctctcagcacctgcatcctaccaaaaatgctaggtatcttctggtttcatttgcctgacatatactttgatgcctgtctctttcagatgtggctaatccacaccttccaaggcagtaaatcaggaattctgttcgccatggccctggaccgctatgtggccatctgtgatcccctgagacatgcaaccatctttacacacaaacttctcactcaaattggagtgggggtgacgctcagagcagccctccttgtagctccatgtctcatcctcatcaaatgtcggctgaaacacttccggaccactgtggtctcccattcatactgtgagcacatggccattgtgaagttggcagcagaagacattcgagtcaacaagatctgtggtctctttgtggccttcactctacttggatttgacataatcttcatcaccctctcctacatccgaatatttataactgtcttcaatctgcctcagagggaagctaggctcaaagccttcaacacctgcattgcccatatttgcgtcttccttgagttttatctccttggtttcttctccttctttacacacaggtttgggttccatattccaccctacattcatattcttctgtccaacctttacctgcttgtccctcctttgctcaatcctatagtgtatggggtgaagaccaaacagattcgagatcgagtgtccaaggttttccactctaaagattcatcttga

SEQ ID NO: 2192 - protein, 316 aa, Canis familiaris
MSKLNGTIFMPPVLTLIGIPGLESVQFWIGIPFCAMYIIALFGNSLLLIIIKSERSLHEPMYLFLAMLGATDIALSTCILPKMLGIFWFHLPDIYFDACLFQMWLIHTFQGSKSGILFAMALDRYVAICDPLRHATIFTHKLLTQIGVGVTLRAALLVAPCLILIKCRLKHFRTTVVSHSYCEHMAIVKLAAEDIRVNKICGLFVAFTLLGFDIIFITLSYIRIFITVFNLPQREARLKAFNTCIAHICVFLEFYLLGFFSFFTHRFGFHIPPYIHILLSNLYLLVPPLLNPIVYGVKTKQIRDRVSKVFHSKDSS

SEQ ID NO: 2193 - DNA, 945 bp, Canis familiaris
atgcctgcttttcctgcttatgacaccaattcctccacctttctactaacaggcttccctggcctggaacaggaatatccctggctgtccatccctttctcccgtatctatgctatggtactgtctgggaactgcctggtgctgcatgtgatccggactgagccgagcctgcaccagcccatgttctacttcctggccacgctggccctcactgacctgtgcatggggctgtccacggtgcacacggtgctgggcatcctgtggggacttagccaggaagtcagcctggatgcctgcattgctcaaacttatttcatccatggtctgtccctcacagagtctggagtccttctcgccatggctttggatcgctttacagcgatctgtaaccctctgaggtatacgtccatactaaccagtgccaggattaccaagattgggctgggaattttagttaggagttttgtgttcattatggctcccataatccgcctaaagtttttccactattgccattcccacatcctctcgcactctttttgccttcaccaagacttactaagactagcatgttctgacattcgctttaacagtttctatgccttggctctggtgatttgcacacttttgtttgattccatgctaattattgtatcctacattctgatcctgcattctgtcttggctattgcatcccgggaggagcggcttaagtccttgcagacctgtgtctcccatatctgtgctgtcatggttttctatatcccaataatcggtctgactatggtgcatcgttttgggaaacacctctctcctatggtccatgtcctcatgggcaacatctatatcatcttcccacccttgatgaaccccatcatctacagtgtcaaaacccaacaaatccgtggcaggattcagaagtggttttccatgaaaaaggagtaa

SEQ ID NO: 2194 - protein, 314 aa, Canis familiaris
MPAFPAYDTNSSTFLLTGFPGLEQEYPWLSIPFSRIYAMVLSGNCLVLHVIRTEPSLHQPMFYFLATLALTDLCMGLSTVHTVLGILWGLSQEVSLDACIAQTYFIHGLSLTESGVLLAMALDRFTAICNPLRYTSILTSARITKIGLGILVRSFVFIMAPIIRLKFFHYCHSHILSHSFCLHQDLLRLACSDIRFNSFYALALVICTLLFDSMLIIVSYILILHSVLAIASREERLKSLQTCVSHICAVMVFYIPIIGLTMVHRFGKHLSPMVHVLMGNIYIIFPPLMNPIIYSVKTQQIRGRIQKWFSMKKE

SEQ ID NO: 2195 - DNA, 915 bp, Canis familiaris
atggtgatgaatagcactgtgaatgaattcattctgtttggcttgacacaggatccaagaaaacagaaagcaatatttggcgtcttcttgatgctttatcttgccacactgttgggaaattttctcattgtagtgactattaaaagaagcaggacccttgggagtcccatgtacttcttcctattttacctgtcctttactgatgcttgcctctctacaaccattatccccagattgattgtggatgccatttctcagaggaagaccatttcctacaatgagtgcatgactcaggtcttttcagcccacttctttggatgcatggaaatcttcgtgctgatcgtcatggcttttgatcgctatgtagccatttgtaagcccttgcgatacacaaccatcatgaacaggcatgtctgcagtgtgctggtgattctgggttgggtgggatcctgtatccactcttcggcacaaattgtcctggctttgagattgcctttctgtggtcccaatgtgattgatcactatttctgtgacttgcagcccttgttgaaacttgcttgcatggacacttatgtaataaatttgctagttgtttctaacagtggagccatatgcacggtgagtttcataatcctgcttatctcctatgttatcatcttgtactctctgagaaactacagtgcagaaggaaggcgaaaagccctttcgacctgcacctcccattttattgtggttgtcctattttttggcccatgtatattcatatatacacgcccagcaaccacatttccagtagacaaggtggtggctgtattttataccattggggcacccttgctcaaccctctgatctatacactgaggaatgcggaagtgaaaaatgccatgaaaaagttatggtgtaacaaagtgtga

SEQ ID NO: 2196 - protein, 304 aa, Canis familiaris; identical to SEQ ID NO: 2152

SEQ ID NO: 2197 - DNA, 156 bp, Canis familiaris
atggtgatgaatagcactgtgaatgaattcattctgtttggcttgacacaggatccaagaaaacagaaagcagtatttggggtcttcttgatgttttaccttgccacactgttgggaaactttctcattgtagtgactattaaaagaagcaggacc

SEQ ID NO: 2198 - protein, 52 aa, Canis familiaris
MVMNSTVNEFILFGLTQDPRKQKAVFGVFLMFYLATLLGNFLIVVTIKRSRT

SEQ ID NO: 2199 - DNA, 924 bp, Canis familiaris
atggagaatccaaaaaatgtgactgaattcatacatttgggcattacagagaacccagagctgcggaaaatgctctctgctgtgtttctaatcatgtatgtgttcacggttttgggaaacctagtaattgtggtaactgtgatcacaagtcaaagtctgagatcacctatgtattttttccttactttcttatcctttttggatgttacctactcttctgtcattgcccccaagatgattgtggactccctctccaagagcactgtcacctccttaaaaggttgcatggcgcagctccttgcagagcatttctttggtggtgtggggatcatcctcctcatcgtgatggcctatgaccgctacgtggccatctgtaagcccctgcactactcgaccatcatgagccctcagatgtgctgcctgctgctgggaggggcctgggtggggggatttatccatgcagcaatacagcttctcttcatgtatcaaatacccttctgtggccccaatgtcattgatcattttatatgcgatttgtttcccttgttgaaactggcctgcatggacacccataccctgggtctcctagtcatcctcaacagtggggtgatgtgtatgaccatcttccttattctcattgcctcctacgtggtcatcctctgctctctgaagtcttgcagctctgaagggcggcgcaaagccatctccacctgtggctcccacctcaccgtggttgtcttgttctttgtgccatgcattttcctgtacgtgcggcctgtggccacctaccccattgacaaggcaatggctgtgtctgattccatcatcacacccatgttaaatcccttgatctacaccctgaggaattcagaggtgaaaaatgccatgaggaaactggggaaacaaaggagttttgttggcaag

SEQ ID NO: 2200 - protein, 308 aa, Canis familiaris
MENPKNVTEFIHLGITENPELRKMLSAVFLIMYVFTVLGNLVIVVTVITSQSLRSPMYFFLTFLSFLDVTYSSVIAPKMIVDSLSKSTVTSLKGCMAQLLAEHFFGGVGIILLIVMAYDRYVAICKPLHYSTIMSPQMCCLLLGGAWVGGFIHAAIQLLFMYQIPFCGPNVIDHFICDLFPLLKLACMDTHTLGLLVILNSGVMCMTIFLILIASYVVILCSLKSCSSEGRRKAISTCGSHLTVVVLFFVPCIFLYVRPVATYPIDKAMAVSDSIITPMLNPLIYTLRNSEVKNAMRKLGKQRSFVGK

SEQ ID NO: 2201 - DNA, 933 bp, Canis familiaris
atgcacctgaataataatgtgactgagttcattctgcttggattgacccaggatcctgttagaaaaaaaatagtgtttgtcacttttttgtttttctatttggggacattgctgggtaactttctgattattactactatcaagaccagccagacactagggagtccaatgtacttcttccttttccacctatccttgtctgacacctgcttctgtacttccatagcccctagaatgattgttgatgcacttttgaaaagggccacaatctctttcagggagtgcatgatacaagtcttttcattccacttctttggctgcctggagatcttcatccttatcctcatggctgctgaccgctatgtggccatctgtaagcccctgcactacacaaccatcatgagtcgacaggtctgtgctgtgctggtggctattgcctgggtggggtcctgtgtgcattctttagctcagatttttctggccctgagtttacctttctgtggtcccaatgtgatcgatcactatcattgtgacttgcagcccttgttgaaacttgcctgtgcagatacccatgtgatcaatctactgttggtatccaatagtggggccatttgtacactgagttttgtcatgctgatgtgctcctatgttgtcatcttgtattctctgagaaatcacagtgctgaagggaggaggaaagccctctccacctgcatctcccacatcattgtagtcgtcttgttctttggtccttgcatatttatatacacacgccctgcaaccacctttcccatggataagatgatagctgtattttatacacttggaacacctttgatcaatcctctgatttacacacttaggaatgcagaagtgaaaaatgccatgaagaagttatggaggaagaagttgatttcagatgacaaaagatga

SEQ ID NO: 2202 - protein, 310 aa, Canis familiaris
MHLNNNVTEFILLGLTQDPVRKKIVFVTFLFFYLGTLLGNFLIITTIKTSQTLGSPMYFFLFHLSLSDTCFCTSIAPRMIVDALLKRATISFRECMIQVFSFHFFGCLEIFILILMAADRYVAICKPLHYTTIMSRQVCAVLVAIAWVGSCVHSLAQIFLALSLPFCGPNVIDHYHCDLQPLLKLACADTHVINLLLVSNSGAICTLSFVMLMCSYVVILYSLRNHSAEGRRKALSTCISHIIVVVLFFGPCIFIYTRPATTFPMDKMIAVFYTLGTPLINPLIYTLRNAEVKNAMKKLWRKKLISDDKR

SEQ ID NO: 2203 - DNA, 603 bp, Canis familiaris
tttgccttccttcttggagcatctgaatgttacctcctggctgtcatgtcctacgatcgttatgtcgccatctgcaagcccctgcattacacaaccattatgagcagcaaaatctgtatccagctagtccttagctcttggatcactggtttcctcatcatctttccaggactcattttaggcttaagcctggacttctgtgattccagtgtcattgatcatttctactgtgacactgctcccctcctgcagatctcctgcacggacagacacgtgttggaaatgatgagtttcatcttagctttggtgactctgctggtcactttggcattcgtaattctatcatacacatatattgccctgacaattttaaaaattccttctaccaaccagagaaaaaagaaaaaagctttctccacctgttcttctcacatgattgtcatctccctctcatatggcagctgcatctttatgtaccttaaaccctcagtcaaacagaggatatccttgatgaagggagtggcagttctcaatacttctgttgctccacttttgaatccctttatttatactttaaggaaacagcaggtgaagcaagcattt

SEQ ID NO: 2204 - protein, 201 aa, Canis familiaris
FAFLLGASECYLLAVMSYDRYVAICKPLHYTTIMSSKICIQLVLSSWITGFLIIFPGLILGLSLDFCDSSVIDHFYCDTAPLLQISCTDRHVLEMMSFILALVTLLVTLAFVILSYTYIALTILKIPSTNQRKKKKAFSTCSSHMIVISLSYGSCIFMYLKPSVKQRISLMKGVAVLNTSVAPLLNPFIYTLRKQQVKQAF

SEQ ID NO: 2205 - DNA, 318 bp, Canis familiaris
atgtctgttcaatctgattccaaagtcagtaacttaaactttctacttacgggattccctggactggagcaagaatatccctggctgtccatcccttcctcccgtatctatgctatggtactgtctgggaactgcctggtgctgcatgtgatccggactgagccgagcctgcaccagcccatgttctacttcctggccatgctggccctcactgacctgtgcatggggctgtccacagtgcacacggtgctgggcgtcctgtgggggctcagccaggagatttggatgcctgcattgcctaaaacttctttattcatg

SEQ ID NO: 2206 - protein, 106 aa, Canis familiaris
MSVQSDSKVSNLNFLLTGFPGLEQEYPWLSIPSSRIYAMVLSGNCLVLHVIRTEPSLHQPMFYFLAMLALTDLCMGLSTVHTVLGVLWGLSQEIWMPALPKTSLFM

SEQ ID NO: 2207 - DNA, 189 bp, Canis familiaris
gttttctatatcccaataatcggtctgactatggtgcatcgttttgggaaacacctctctcctatggtccatgtcctcatgggcaacatctatatcatcttcccacccttgatgaaccccatcatctacagtgtcaaaacccaacaaatccgtggcaggattcagaagtggttttccatgaaaaaggag

SEQ ID NO: 2208 - protein, 63 aa, Canis familiaris
VFYIPIIGLTMVHRFGKHLSPMVHVLMGNIYIIFPPLMNPIIYSVKTQQIRGRIQKWFSMKKE

SEQ ID NO: 2209 - DNA, 954 bp, Canis familiaris
atggcagacaatgctacacatagctacatctcatcttttttcctggttggtattcctggtttgcaagcttttcactgctggattggcatccctgtctgcctcctgtttgccctggccctgctggggaacagtgtaatcatcatcaccatcaaaatagaacccagcctccacctgcctgtgtatttcttcctttgtatgctggcagtgaatgacatggctcttgtctcttccacagcccccaagatgctgggtatcttctggttggatgctcacaagtttgactttagtatctgtctagcacaaatgtattttatccacacattctgcataattgagtcagccctcttggttgccatggccttcgaccggtatgtagctatttgtatcccactgcgttatacaaccatcgtgacaacaccaatgatcactaaaatgggtctagctggtgtgatccgagctacctttatggttttgccctgtcctcttcttattaaaaggctaccgtattacactaaatatgttatcaatcatgcctactgtgagcacatggctgtggtgaagttggccagtgccaacaccctcattaacagagcatatggaatctctgtggccctttcagtgatggtgttggacctagggctcatagctacatcctatatcaagatccttcaggcagtcttccggctatcttctcagaatgcccgctctaaagctctgggcacctgtgctgcccacgtctgcactctacttggattctacacacctgcactatttagtttcctaactcaccgtattggcaagaaggtaccttcaagcattcatataatctttgcaagtttgtatcttttggtgcctcccacagtcaatcccctggtgtatggtgtcaagaccaaacagattcgtgaccgtgtggtcagtctcttcctctcaaacaagattatttctggaaactaa

SEQ ID NO: 2210 - protein, 317 aa, Canis familiaris
MADNATHSYISSFFLVGIPGLQAFHCWIGIPVCLLFALALLGNSVIIITIKIEPSLHLPVYFFLCMLAVNDMALVSSTAPKMLGIFWLDAHKFDFSICLAQMYFIHTFCIIESALLVAMAFDRYVAICIPLRYTTIVTTPMITKMGLAGVIRATFMVLPCPLLIKRLPYYTKYVINHAYCEHMAVVKLASANTLINRAYGISVALSVMVLDLGLIATSYIKILQAVFRLSSQNARSKALGTCAAHVCTLLGFYTPALFSFLTHRIGKKVPSSIHIIFASLYLLVPPTVNPLVYGVKTKQIRDRVVSLFLSNKIISGN

SEQ ID NO: 2211 - DNA, 951 bp, Canis familiaris
atgtccaagctcaatggcacaatcttcatgcccccggtgctgacactgattgggatccccggcttggagtctgtgcagttctggattggaattcctttctgtgccatgtacatcaatgctctgtttgggaattccctgctcctggtcatcatcaaatcagaacgcagcctccatgagcccatgtatctcttcctggcaatgcttggagtcacagacattgttctcagcacctgcatcctaccaaaaatgctaggcatcttctggtttcatctgcctgacatatactttgatgcctgtctctttcagatgtggcttatccacaccttccaatgcactgaatcaggaattctgttggccatggccctggaccgctatgtggccatctgtgatcccctgagacacgcatccatctttacacacaaacttctcactcagattggagtgggagtgatgctcagagcagccctccttgtagctccatgtctcatcctcatcaaatgtcggctgaaacacttccggaccactgtggtctcccattcatactgtgagcacatggccattgtgaagttggcagcagaagacattcgagtcaacaagatctgtggtctctttgtggccttcactatacttggatttgacataatcttcatcaccctctcctacatccgaatatttataactgtcttcaatctgcctcagagggaagctaggctcaaagccttcaacacctgcattgcccatatttgcgtcttccttgagttttatctccttggtttcttctccttctttacacacaggtttgggttccatattccaccctacattcatattcttctgtccaacctttacctgcttgtccctcctttgctcaatcctatagtgtatggggtgaagaccaaacagattcgagatcgagtgtccaaggttttccactctaaagattcatcttga

SEQ ID NO: 2212 - protein, 316 aa, Canis familiaris
MSKLNGTIFMPPVLTLIGIPGLESVQFWIGIPFCAMYINALFGNSLLLVIIKSERSLHEPMYLFLAMLGVTDIVLSTCILPKMLGIFWFHLPDIYFDACLFQMWLIHTFQCTESGILLAMALDRYVAICDPLRHASIFTHKLLTQIGVGVMLRAALLVAPCLILIKCRLKHFRTTVVSHSYCEHMAIVKLAAEDIRVNKICGLFVAFTILGFDIIFITLSYIRIFITVFNLPQREARLKAFNTCIAHICVFLEFYLLGFFSFFTHRFGFHIPPYIHILLSNLYLLVPPLLNPIVYGVKTKQIRDRVSKVFHSKDSS

SEQ ID NO: 2213 - DNA, 945 bp, Canis familiaris
atgcctgcttttcctgcttatgacaccaattcctccacctttctactaacaggcttccctggcctggaacaggaatatccctggctgtccatccctttctcctgtatctatgctatggtactgtctgggaactgcctggtgctgcatgtgatccggactgagccgagcctgcaccagcccatgttctacttcctggccatgctggccctcactgacctgtgcatggggctgtccacggtgcacacggtgctgggcatcctgtggggacttagccaggaagtcagcctggatgcctgcattgctcaaacttatttcatccatggtctgtccctcacagagtctggagtccttctcgccatggctttggatcgctttacagcgatctgtaaccctctgaggtatacgtccatactaaccagtgccaggattaccaagattgggctgggaattttagttaggagttttgtgttcattatggctcccataatccgcctaaagtttttccactattgccattcccacatcctctcgcactctttttgccttcaccaagacttactaagactagcatgttctgacattcgctttaacagtttctatgccttggctctggtgatttgcacacttttgtttgattccatgctaattattgtatcctacattctgatcctgcattctgtcttggctattgcatcccgggaggagcggcttaagtccttgcagacctgtgtctcccatatctgtgctgtcatggttttctatatcccaataatcggtctgactatggtgcatcgttttgggaaacacctctctcctatggtccatgtcctcatgggcaacatctatatcatcttcccacccttgatgaaccccatcatctacagtgtcaaaacccaacaaatccgtggcaggattcagaagtggttttccatgaaaaaggagtaa

SEQ ID NO: 2214 - protein, 314 aa, Canis familiaris
MPAFPAYDTNSSTFLLTGFPGLEQEYPWLSIPFSCIYAMVLSGNCLVLHVIRTEPSLHQPMFYFLAMLALTDLCMGLSTVHTVLGILWGLSQEVSLDACIAQTYFIHGLSLTESGVLLAMALDRFTAICNPLRYTSILTSARITKIGLGILVRSFVFIMAPIIRLKFFHYCHSHILSHSFCLHQDLLRLACSDIRFNSFYALALVICTLLFDSMLIIVSYILILHSVLAIASREERLKSLQTCVSHICAVMVFYIPIIGLTMVHRFGKHLSPMVHVLMGNIYIIFPPLMNPIIYSVKTQQIRGRIQKWFSMKKE

SEQ ID NO: 2215 - DNA, 942 bp, Canis familiaris
atactggcttcagggaacagctcttcacatcctgtgttcttgatcctacttggaatcccaggactggagaattaccaattttggattgcctttcctctatgtgccatgtatttcgaagctatagttggcaatatcattatgccttcatataatctgaactgaccacaccctgcttgagcccatgtacctttttctagccatgctggctatcactgacctggctctatcctcttccacgcaacctaaaatgctggctatactctggtttcgtgctcatgagattgaataccatgcctgcctcatccaggtgttcttcatccatgccttttcctctgtgaagtccaggttgctcatggctatggcctggaccattatgtggctatctgtttcccactccaccactctactttcctgaccccagctgtagtgggtaaactgggagtagctgtgatgatgagaggattgctatgggtgagccccttctgcattatggtctccaggatgcccttctgccccaaacacatcattgcccagtcatactgtgagcacatggctgtgttaaagctggtgtgtgcagacactagagtaaaccgtgcatatgggctctttgtggccttctctgtggttggctttgatataattgtcatcagtatatgctatgtgatgattctgagaactgttctggggttgccctctgatgaagccaagttcaaggcttttggcacatgtgcttcccttatctgtatcatcttggctttttatatcccagccctctttactttcctcacccactgctttggacaccatgtgccccgagtggtacatatcatgttcgccattttctatctcctggtacctcccatgctcaaccccatcatctatggagtcagaaccaagcagatcagggacagggatattcaaggttgttgtggaaaagatccc

SEQ ID NO: 2216 - protein, 164 aa, Canis familiaris
MMRGLLWVSPFCIMVSRMPFCPKHIIAQSYCEHMAVLKLVCADTRVNRAYGLFVAFSVVGFDIIVISICYVMILRTVLGLPSDEAKFKAFGTCASLICIILAFYIPALFTFLTHCFGHHVPRVVHIMFAIFYLLVPPMLNPIIYGVRTKQIRDRDIQGCCGKDP

SEQ ID NO: 2217 - DNA, 960 bp, Canis familiaris
atggaaaaagccaactggtcctcccctgtggcggggttcattatcctgggactctcagaccacccagggttggagaaaatattttttgtgctcatcctcctgatgtacctgatgatcctgctgggcaacggggtcctcatcctggtgaccatccttgactcccgcctgcacacacccatgtacttcttcctggggaacctctccttcctggacatctgctacacaacctcctcagtccctctagtcctggatggcttcctgacccccaggaaaatcatctccttctcagcctgtgctgtgcagatgtttctctcttttaccatgggagccacagagtgtgtgcttctgggcatgatggcatttgatcgctatgtggccatctgtaacccgctgaggtaccctgtggtcatgagcaaggctgcctatgtgcccatggctgtcagctcctgggctattggtggtactgcttctgtggtacacacatccttgacaattcagttgcctttctgtggaaacaatgtcatcaatcaccttgcctgtgagatcctggctgtcctgagattggcctgtgttgacatctccatcaatgtcatcagcatgggagtgacaaatgtgatcttcctgggggtcccagtactctttatctctatctcttatgtgttcatcattgctaccatcctgaggatcccctcagctgaggggaggagaaaggctttctccacctgctctgcccacttcactgtggtggtcatcttctacgggaccttatttttcatgtatagaaagcccaaatctaaggattccctgggacaaaacaaagaggacctttcagataagctcattcctctcttttatggagtggtgacccccatgctcaaccccatcatctatagcctcaggaacaaggacgtgaagtctgctgtgaggaacctgatgtctcagaagtgcttcaccaggtga

SEQ ID NO: 2218 - protein, 319 aa, Canis familiaris
MEKANWSSPVAGFIILGLSDHPGLEKIFFVLILLMYLMILLGNGVLILVTILDSRLHTPMYFFLGNLSFLDICYTTSSVPLVLDGFLTPRKIISFSACAVQMFLSFTMGATECVLLGMMAFDRYVAICNPLRYPVVMSKAAYVPMAVSSWAIGGTASVVHTSLTIQLPFCGNNVINHLACEILAVLRLACVDISINVISMGVTNVIFLGVPVLFISISYVFIIATILRIPSAEGRRKAFSTCSAHFTVVVIFYGTLFFMYRKPKSKDSLGQNKEDLSDKLIPLFYGVVTPMLNPIIYSLRNKDVKSAVRNLMSQKCFTR

SEQ ID NO: 2219 - DNA, 960 bp, Canis familiaris; identical to SEQ ID NO: 2217

SEQ ID NO: 2220 - protein, 319 aa, Canis familiaris; identical to SEQ ID NO: 2218

SEQ ID NO: 2221 - DNA, 708 bp, Canis familiaris
tcattcttgacagcttcgtaactcccaggaaagccattccccttctccacgtctgctgtgcagatgtttctctcctttgccaagggagccacagagattatgctactgagcatggtggcatttgatcactatgtggctctgtaacctcctaggtacattgtgttcaaagcaagactgtgtatgtcctcatgtctgccagtttctggaaggctgggtgcatgactcccatggtgcaaacatcctgagcaatgagaaggccttccatgactatatcatcaatccctttatctgtgagatcctggctgtgctgattttgtcctgtgcggacatctcatcaatgtgatcggtatggcagtagcccatgtaatcttcctaggcattccagttctatttatttttgtctcttatatgttcatcattgctaccatcctgaggatcccctcagctgaagggaggataaaggccttctccacctgctctgcccacctcactatagtggtcgtcttctatggaacaatcctcttcatgtatgggaagcccaaatccaaggatcctcagggggcagacaagcaggagatttcagacaagctcacctacctcttctgtggggtggtgacccccatgctcaaccccatcatctacagcctgaggaacaaggacgtgaaggctgctgtgaggaacctagtacttcacaaacactttatccag

SEQ ID NO: 2222 - protein, 120 aa, Canis familiaris
MAVAHVIFLGIPVLFIFVSYMFIIATILRIPSAEGRIKAFSTCSAHLTIVVVFYGTILFMYGKPKSKDPQGADKQEISDKLTYLFCGVVTPMLNPIIYSLRNKDVKAAVRNLVLHKHFIQ

SEQ ID NO: 2223 - DNA, 930 bp, Canis familiaris
atggaaaatcagagcaatgtcacagaatttgttttcatgggtctgtggggaaataaacaagtggagctactgttctttctcttgttcctgctctgttatttggcaatcttaatgggaaacttcatcatcttactcacgatcatccacagccatctaattgaacaaccaatgtactactttctctgccacctttccctcatggacctctgctacacctccactgtagtccccagactaatcagggacttaggtgcagccagaaaaaacatttcctataacaactgtatgacccagctcttcactgcccacttgctggcaggggtggagatattcatcttggtgtccatggctttagaccgctatgttgccattgtcaagcccctgcattacatggtcatcatgaaccggcggaggtgtaacctgttgatcttcatggcctggggtgtggggttttggcactctgttgctctattgctcttggtactcaatttacctttctgtggtcctaatcagatagatcattacatatgtgatgtgaagcctcttttgaaactggtgtgcagagatattcgtgttgttaatatcttggttatttcaaatgcaggaatggtggtggttgctgtgtttcttgtcctggtggcttcttacattctcatattatacaatctgaagacccactcctctgtagggagacgcaaagctctctccacgtgcagctctcatgtaatggtggtcattttattctttgtgccttgtatctatatttatgttctacctgcagggagtgaaaacaaggataaggagatctctgtgttttacactgtgattgctcccttgttgaatcctctcatctataccctgagaaacgtggagatgagaaatgccatgtggaagatgtggtctaaaatggcacatacgaaattcaggtaa

SEQ ID NO: 2224 - protein, 309 aa, Canis familiaris
MENQSNVTEFVFMGLWGNKQVELLFFLLFLLCYLAILMGNFIILLTIIHSHLIEQPMYYFLCHLSLMDLCYTSTVVPRLIRDLGAARKNISYNNCMTQLFTAHLLAGVEIFILVSMALDRYVAIVKPLHYMVIMNRRRCNLLIFMAWGVGFWHSVALLLLVLNLPFCGPNQIDHYICDVKPLLKLVCRDIRVVNILVISNAGMVVVAVFLVLVASYILILYNLKTHSSVGRRKALSTCSSHVMVVILFFVPCIYIYVLPAGSENKDKEISVFYTVIAPLLNPLIYTLRNVEMRNAMWKMWSKMAHTKFR

SEQ ID NO: 2225 - DNA, 912 bp, Canis familiaris
atggagagccagaggaatgtctcagaattcattcttttgggactttcgcatgaccagaacatgcaaatattttgctttgtgctcttcttattctgttatgctgctctcttggtaggaaaccttctgatccttgtctctattcgatgcagccctctttttcaccaaccaatgtactacttcctcagccacttatccactctggacatctgctatacctctagcgttacacccaaattaattgctgacctgctagtggaaagaaaagccatctcctatggtaattgtatgttacaggtctttgccatgcacttctttggaatgattgaagttctaatccttacagtcatggcctttgatcgctatgctgccatctgcaaacctctccactacctgcttatcatgaacaggacaaggtgcaatctcctagtcttagctgcttgggctggtggggctgtccactcctttcctcaattttgtatggtaatcaggttgcccttctgtgggcctaatgagattgatcactatttctgtgatatatttcctttgctaaaggttgcctgcactgatacctacatcactggtgtccttatggttgtcaattcgggaatggttaccttagtgacatttgtggttttatttttttcttatgtcattatattattcactttaagaaatcactcagcagaaggaagacgcaaagccctctctacttgtggatctcatatcacggttatagttttattttttgggccttccatctttgcctaccttagacctccaactaatttccctgaggataaaatatttgctctgttttacaccatcattgctcctatgttcaatcccttaatctatactctgagaaattcagagatgaaaaatgccatgagaaaattttggtgtcaaacatga

SEQ ID NO: 2226 - protein, 303 aa, Canis familiaris
MESQRNVSEFILLGLSHDQNMQIFCFVLFLFCYAALLVGNLLILVSIRCSPLFHQPMYYFLSHLSTLDICYTSSVTPKLIADLLVERKAISYGNCMLQVFAMHFFGMIEVLILTVMAFDRYAAICKPLHYLLIMNRTRCNLLVLAAWAGGAVHSFPQFCMVIRLPFCGPNEIDHYFCDIFPLLKVACTDTYITGVLMVVNSGMVTLVTFVVLFFSYVIILFTLRNHSAEGRRKALSTCGSHITVIVLFFGPSIFAYLRPPTNFPEDKIFALFYTIIAPMFNPLIYTLRNSEMKNAMRKFWCQT

SEQ ID NO: 2227 - DNA, 213 bp, Canis familiaris
ggtagggtggtggcagccttttctgttgtcttggtggcttcttacatattcatatcacataatcttaggacccactcctccgccgggtaatgcaaagctctctccacctgcagctctcatgtaatggtggtagttttattcctcatgccctgtatctgtactttggttctacctgcaggcagtgaggacagagatgaagaactctccgtattt

SEQ ID NO: 2228 - protein, 40 aa, Canis familiaris
VGWWQPFLLSWWLLTYSYHIILGPTPPPGNAKLSPPAALM

SEQ ID NO: 2229 - DNA, 957 bp, Canis familiaris
atgacagcgcaccaaaatggcaccatctccgttgtggtttccgacttcctcctgaattgtttagtcaggtctcccagctggaagttctggttgtccctgcccctaagcttcctcttcctcctggccatgggggccaatggtgttctcctggtcaccatccagctggaggcctctctgcatgagcccatgtactacctgctcagcatcctctctctgctggacatcgtcctctgcctgactgttatacccaaggtcctggccatcttctggtttgatctcaggtccatcagcttctctgcctgcttcattcagatgtacatcatgaattgcttccttggcatggagtcttgaacattcatggtcatggcctatgaccgctatgtggccatctgccacccactgaggtactcttccatcatcactgatcaatttgtagctagggctgctatgtttattttggcgaggaatgcacttcttactatgttcattcctatcctctctgcccagctccattattgtggaaaaaatataattgagaactgtatctgtgccaacctctctgtgtccaagctctcctgtgataatgttttccttaacagaatataccagttaactatagcctggactcttctgggctctgacctcgtcctcatcttcctctcctacatcctcatcctaagagccattcttagactgaaggcaaaaggggcagctgccaaagctctgagcacatgcggctctcacttcattctcatcctcttctttagcaccatcctgctggtttttgtttttacccacatggctaagaaaaaagtttcccctgatattcccatcttacttaatgtcctacaccatgtaattcctgcagctctcaatcccattgtctatggggtacgaacccaggagattaaagagggaattaggaagttactgagaagggtagtagagagatgcaag

SEQ ID NO: 2230 - protein, 200 aa, Canis familiaris
MVMAYDRYVAICHPLRYSSIITDQFVARAAMFILARNALLTMFIPILSAQLHYCGKNIIENCICANLSVSKLSCDNVFLNRIYQLTIAWTLLGSDLVLIFLSYILILRAILRLKAKGAAAKALSTCGSHFILILFFSTILLVFVFTHMAKKKVSPDIPILLNVLHHVIPAALNPIVYGVRTQEIKEGIRKLLRRVVERCK

SEQ ID NO: 2231 - DNA, 345 bp, Canis familiaris
atggatcttaaaaatggatctgtagtgactgaatttcttttactaggattttctggatgacgggaacttcagattttcttctttgtaacattctccttaatctacagtgctattgtgtggggaaatattctcatgacagtcacagtgacatttagttcctaccttcattctcccttgtactttctccttggaaacctctctttttctcttttgggtacgtgtctctccactgtcaccacacccaaaatgatcacagacttgcttaaacacaagaccatctccatatggggcttcatgactcagatgttctttatgcacttgtttggggatgctgagatgactctg

SEQ ID NO: 2232 - protein, 82 aa, Canis familiaris
QSHLSIPKQVHKEHLSHEAPYGDGLVFKQVCDHFGCGDSGETRTQKRKREVSKEKVQGRMKVGTKCHCDCHENISPHNSTVD

SEQ ID NO: 2233 - DNA, 753 bp, Canis familiaris
ctatttctcacctacacactgaatgtaactggaaatctgaccatcatcatactcacttttgtggatcttcaccttaaaacacccatgtaccattttttacaaaatgtttccttcctagagatctcattcacaactgcctgtattcccaggtacttgtataacatagcaacaggtaacaaggtcatcacctataatgcttgtgtcatccaagtgttttttattgacttctttgctgtgacagaattttttctgctggttgccatgtcctatgactgctatgtggccatttgcaagcccctgcattatataaccatcatgagcagcagagtctgcagaattcatattttttgctgttggttggctggattgttggtcataatcttcccagttattctggggctaaatctgaaattctatgactccaatttcattgatcattctctctgtgatgctgctcccctcctgaagatatcatgttcggacacatggcccatggaacaggctgttttaatctgtgctgtgctgaccctcagtttgacccttatgtgtgtaattctatcttatattatcaaaacaattttaggatttccatctattcagcagagaaaaaagagcagagaaaaaagaaaaaaggccttttctacctgttcttcccacatgattgtggtttccatcacctatggcacatgcatgttcatttatatgaatcctacaacaaaagaagtggctattaataaagtggtttcactactg

SEQ ID NO: 2234 - protein, 251 aa, Canis familiaris
LFLTYTLNVTGNLTIIILTFVDLHLKTPMYHFLQNVSFLEISFTTACIPRYLYNIATGNKVITYNACVIQVFFIDFFAVTEFFLLVAMSYDCYVAICKPLHYITIMSSRVCRIHIFCCWLAGLLVIIFPVILGLNLKFYDSNFIDHSLCDAAPLLKISCSDTWPMEQAVLICAVLTLSLTLMCVILSYIIKTILGFPSIQQRKKSREKRKKAFSTCSSHMIVVSITYGTCMFIYMNPTTKEVAINKVVSLL

SEQ ID NO: 2235 - DNA, 282 bp, Canis familiaris
tcaactagcacagttatcatggttgccatcctgaagatatcttctgctacagggaagaaaaaagccttatccatgtgctcctcccacctgacagccatcatcattttctatgcagtcctttcatacatgtacttacagcctcaggctaataattcccaagaggatatgaaagtgtcttctgtattttacggcattgtgatttctcttttgaaccctctgatctatagtttgagaaaaaaggaggtaaaagaagctctaaaaacgatgaggaagaagttcttc

SEQ ID NO: 2236 - protein, 94 aa, Canis familiaris
STSTVIMVAILKISSATGKKKALSMCSSHLTAIIIFYAVLSYMYLQPQANNSQEDMKVSSVFYGIVISLLNPLIYSLRKKEVKEALKTMRKKFF

SEQ ID NO: 2237 - DNA, 732 bp, Canis familiaris
ggaaatactactatgacagttactgaatttatcatactagggtttggagacctcaaggaattgggccccttgctcttcttggtgtttggcattgtctacctagccaccatatctgggaatcttctccttgtggccttggtgagcactcagtggggactccagacactaatgtacttctttctggaaaacctctcatgcctagaggtctgttatacatccaacattgtgcccaggatgctggtgaacttgctgagaaagaacagttatctccatgacatgttgtgtacagttatctccatgacatgttgtgttatgcatctctacttctttggggctctgggcagcactgaatgctatcttctggcagcgatgtcatatgaccgttacctggctgtctgccggcccttgcactatccaacactaatgcatctagtaattggctcgtgggttagtggcttcacagtaacagctgcattccaggctgctgtggtaaccagtttgaccttctgtggtggcaatgagattgaccattttttctgtgatttgaaacctctgcagaagctcttctgctcagatccccatctggtcaacctggtctacatgagtttaacagtgctggtgactttggccccttttggactaaccctaacttcctactggaagattctttccctggtcttgcatataccttccatgactggtaggcagaaggctttctctacatgttcttct

SEQ ID NO: 2238 - protein, 244 aa, Canis familiaris
GNTTMTVTEFIILGFGDLKELGPLLFLVFGIVYLATISGNLLLVALVSTQWGLQTLMYFFLENLSCLEVCYTSNIVPRMLVNLLRKNSYLHDMLCTVISMTCCVMHLYFFGALGSTECYLLAAMSYDRYLAVCRPLHYPTLMHLVIGSWVSGFTVTAAFQAAVVTSLTFCGGNEIDHFFCDLKPLQKLFCSDPHLVNLVYMSLTVLVTLAPFGLTLTSYWKILSLVLHIPSMTGRQKAFSTCSS

SEQ ID NO: 2239 - DNA, 717 bp, Canis familiaris
gaactcagcctccaaaccctcatgcacttcttttggtccaatctttccttccttgagatctgatatactacttccattgcccctaagatgctgcagaccctctctcagattttggggcaatttcttttgcaggttgtgtggtccagttttacttcttcagttcattactttagtcgagtagtcgagtgctttgtgctaccagccatgtcttctgactatcaccttgctatctgcagccccctccagtacccatcccttatgaacttctacacatgtagtctgtttgcaggtgggccttggctggatgggttcctaacccttgtagtcactgtttccatgactttctagctgccattccatgcagcctatgagattgaccacttcatccgtgacctggctcctgtattgaatctgccctgttctgatcctgagatggtggagaaggccactttcctcctggcttcctttgtcttggtgccaggcatgagactgaatacttggggattcaggccactgctgctccctccttctagggcactggccagcagagcagggaccttccttctgatcctacagcctaaagcccttgggacctccaggttagtctttgcctggtaaaattgagttttccagacaaatgcaactctatcaggctataccaccatatataaatgctttttaggggaaaatatgaaagacccaatttacatgctacaa

SEQ ID NO: 2240 - protein, 59 aa, Canis familiaris
NSASKPSCTSFGPIFPSLRSDILLPLPLRCCRPSLRFWGNFFCRLCGPVLLLQFITLVE

SEQ ID NO: 2241 - DNA, 315 bp, Canis familiaris
atggctagcactgaagaagaaaatataactcaaattacagaatttatccttttgggttttggggatctccatggccttcagtttcttctttttggggtatttctggtcatctatgtggtgactctcatgagcaacattgtaatcctaactgtgtgtcagctgaccactcccttcacaccccccatgtatttctttcttggccacttctccttcctagacattgggtacaccactaccattgagcccttgatgctgaggacattcttatcagctcatgtgcctatttccttcccaggctgtgcttgccagttcttt

SEQ ID NO: 2242 - protein, 105 aa, Canis familiaris
MASTEEENITQITEFILLGFGDLHGLQFLLFGVFLVIYVVTLMSNIVILTVCQLTTPFTPPMYFFLGHFSFLDIGYTTTIEPLMLRTFLSAHVPISFPGCACQFF

SEQ ID NO: 2243 - DNA, 924 bp, Canis familiaris
aatgccagcaagttgagtgacttcttcctcatgggcctcactgatgatcctcagcttcagcctatgttctttgccctcttcttcttgatctatgcaatcacaatggtgggaaacctgggcctccttgccctcattgtggtcagtcctcgactccacaatcctatgtatttctatctatcctttattgacttttgttattcttcagacacagttccaaaaatgttaatgggtttttttctctggttgccaaacaatctccttctctggttgtgtggtacagacaagctgctttgtgatctttgctgtcactgagttcttcctcctggcttccatggcctatgaccactatgtttccatctgcaaccctctgctctatcatatcatcatgtccccaagattctgtttgcagttagtggctgccagctatgcagtgggcctgatgaatatggtgctcttcacaagtacaacgttttatctgaccttctgtaaataacattcatctctcactatttctgtgatatccctccccttttaaaactctcttgctctgacatgcagattctccaacttctcctctttgcctgtggtggttttaatgtgtctgtatccctgataatcatccttgtctcctatgcatgtgtcttcttggctatcatcagaatcccttcagcccagagaaaacacaaaacattctccacttgtgcttcccatctgattgctgtcagcctatactatggaaccacagcattcatttactgtgcccatccgctgagtacttacctgtgcccatccgctgagtacttactaggcagagacaggctggtctctgtattctacacagtggtcatccccatgcttaaccccatgatctacagtctgaggaataaagatgtgaaggaaacatttgggaatattctgaagaag

SEQ ID NO: 2244 - protein, 124 aa, Canis familiaris
MQILQLLLFACGGFNVSVSLIIILVSYACVFLAIIRIPSAQRKHKTFSTCASHLIAVSLYYGTTAFIYCAHPLSTYLCPSAEYLLGRDRLVSVFYTVVIPMLNPMIYSLRNKDVKETFGNILKK

SEQ ID NO: 2245 - DNA, 924 bp, Canis familiaris
atggagaattcatctatggtgactgacttcatccttcttggcatgacagacaaccctcagcttggagtcctactatttgcagtcttccttattgtttatattgtcactgttttggggaatctgggcctggtaatcctgatcagagtcagtccctgcctccacactcccatgtacttttttctttctaatctgtccctacttgatgtctgtttctcttccatcacaatcccaaagactttagcaaatttgttatctaagttgcaagctgtttcttttcttggatgcatgactcaaatgggcttattcataatatttgcttctgctgagtgcaaccttttggcttccatggcctatgaccgctatactgccatctgtcacccattgctctactatgtcaccatgtctagagtccgttgtttcctcttggtagcaggatgctactttggggggttagttaacatggtttctgtgacaacttccatcatacgactatcattctgtcaaccacatgtccttccccacttcttctgtgacatccctccactgttggcattggcttgctcagacccctgggtcacccaggtactagttattggctgtgggggattcaccctggtcacctccattgtggtgatccttgtctcctacatgtctgtcctcatgacgattctgggaattccttcagcttccggaaaacaaaaagctttctctacatgtgcttcccacatcaccgctgttggcctgtattatggaacaactatgtacacttacttgcagccctctcaacatggatcccaggcaggaaatcagatggtttcagtgttttatacaatggtgatccccatgataaatcctcttatctacagtttgagaaaccaggaagtgaaagttgctttatggaaagtattgaagcagagtccctaa

SEQ ID NO: 2246 - protein, 307 aa, Canis familiaris
MENSSMVTDFILLGMTDNPQLGVLLFAVFLIVYIVTVLGNLGLVILIRVSPCLHTPMYFFLSNLSLLDVCFSSITIPKTLANLLSKLQAVSFLGCMTQMGLFIIFASAECNLLASMAYDRYTAICHPLLYYVTMSRVRCFLLVAGCYFGGLVNMVSVTTSIIRLSFCQPHVLPHFFCDIPPLLALACSDPWVTQVLVIGCGGFTLVTSIVVILVSYMSVLMTILGIPSASGKQKAFSTCASHITAVGLYYGTTMYTYLQPSQHGSQAGNQMVSVFYTMVIPMINPLIYSLRNQEVKVALWKVLKQSP

SEQ ID NO: 2247 - DNA, 780 bp, Canis familiaris
atgcaccaaagaaacagaactatttctaaattcttcctcctgggactcactgtggggcctgaacatcagaaactcatttttatgctatttatatgcatgtatctggtcaccatggtaggaaacttacttattatcctggctattatcaatgatgcttaccttcacagccccatgtacttttttcttgccaacctatctttcactgacatctgcttcacaaccactacaatccccaaaatgttggcagacatccaaagtcagaacccagccctctcttttgcataatgccttatacaaatgtactttttgatgttgctgttaaacctggacaatttcctcttggcaaccatggcatatgaccagtatattgccatttgtcccccattacactatgctgtattactgaaacccaagcattgtgccttattggcaatgattcaatgggtcatctccaactttgtctcaatgctgcatctcactctgctgggtctcttgaccacctgcgataaaaaaatatcccactttttctgtaacctaaaactcattttaagtcttgcttgcacagacactcaaatcaatgcattgacaatcctagtcattgggggagcagttatcgttatccctttcacctttattattgtctcttatgcctttatttgttgcactgtacttggggttccttcagctaaggggaagtggaaaacattctccacttgtggctctcatcttttagctgtagcacttttctatggatccatcgttggggtctactttatcccc

SEQ ID NO: 2248 - protein, 161 aa, Canis familiaris
MYFLMLLLNLDNFLLATMAYDQYIAICPPLHYAVLLKPKHCALLAMIQWVISNFVSMLHLTLLGLLTTCDKKISHFFCNLKLILSLACTDTQINALTILVIGGAVIVIPFTFIIVSYAFICCTVLGVPSAKGKWKTFSTCGSHLLAVALFYGSIVGVYFIP

SEQ ID NO: 2249 - DNA, 801 bp, Canis familiaris
ggaatggacttaatcatctttcttatctactttgacctccacctccacactccaatgtacttcttccttactaatctgtctttcttagatctttgctatggaagcacttccatgccccaggccttagtgcattgtttctctacccatccctacctctcttacccaggatgtttgacccaaatgagtgtctccttggtcttggccacagcagagtgcctcctactggctgtcatggcctatgaccatatggctgctatcagcaatcccctgcgctattctgtgatcatgaatgccccagtgtgtgtctggctggctactactttgtggggggaatcacttgtgctcactgccatgctcgtcttatccctgcagcttcacttctatggagttaatatcatcaaccattttgtctgtgaaattctttccctccttaagctggcctgttctgatactaatctcaatgagcttatgatctccaccacaggtatcttcactctgctcctaccctttggatttgttcttctttcctatgcccaaattgccactactgtcttagagattctctcagcccagggtaggctcaaggccttttccacctgtggctctcatttgactgtggtgacagtcttctaaggggcaaccatttccatgtatatgaaacctcagtccaagtcatctgctgagcagaacaagtttatttcagtgttttatggggctttgacacccatgttgaaccccttaatatatagcctgaggaacaaggatgttagaggggcaatgaggaaagttattgcaaaaagg

SEQ ID NO: 2250 - protein, 210 aa, Canis familiaris
GMDLIIFLIYFDLHLHTPMYFFLTNLSFLDLCYGSTSMPQALVHCFSTHPYLSYPGCLTQMSVSLVLATAECLLLAVMAYDHMAAISNPLRYSVIMNAPVCVWLATTLWGESLVLTAMLVLSLQLHFYGVNIINHFVCEILSLLKLACSDTNLNELMISTTGIFTLLLPFGFVLLSYAQIATTVLEILSAQGRLKAFSTCGSHLTVVTVF

SEQ ID NO: 2251 - DNA, 678 bp, Canis familiaris
tcaatggtttaaaagactaccccaccatttcctatactaactgttatgctcagatgatcattgctctctttctggggatgacagtgtctgctccttgttgtcatggcttatgatagattcattacaatttctaatcccctgcgttacaccatcattatgaacaaccaggtctgcatacatttggccatggtgacctgggccactgccttccttttagtaataataccaatcattgcaattcctgcccatttttgtggacacaatgtcatcaatcattttacctgtgaggtccaggctctgtcaaggttcacttgctcagacagcccagtcagacttattctgggtctagtcattggcatcttcacactgcctctgcctttcaccttcattctcatctcctatactcacattgtggttgctatgctaaggatccactgtgcagaagccaggctcaaaactttctccacctgtgggtcccacctgactgtggtcaccatattttatggaacagctatctacatgtacctgaaacctcagtcaagagaatctcagggccagggtgaagtcatctctgggattttatggcattgtaacccctatgttgaaccccctcatttacaccttcagaaacaaagatgtgaaaaatgctctaagagaaatgacaaggaagaaagaacc

SEQ ID NO: 2252 - protein, 192 aa, Canis familiaris
MAYDRFITISNPLRYTIIMNNQVCIHLAMVTWATAFLLVIIPIIAIPAHFCGHNVINHFTCEVQALSRFTCSDSPVRLILGLVIGIFTLPLPFTFILISYTHIVVAMLRIHCAEARLKTFSTCGSHLTVVTIFYGTAIYMYLKPQSRESQGQGEVISGILWHCNPYVEPPHLHLQKQRCEKCSKRNDKEERT

SEQ ID NO: 2253 - DNA, 741 bp, Canis familiaris
tttttcctcagtaatttatccttccttggtatctgttactctatcagctgggaaacatatgtcttggcccaatgtttcagggacttccccatcattttctacaccagctgttaggcccagatgaccacatccctctttccagggatgacagaatgcctcttccttgctgtcatggtttatgacaggtttgttgctaactccaatcccctgcatcacaccacctttatgaataatcaggtttgcatacagttggcattgggaacctgggccagtgcctttttagtagcagtcttgccaatcattgcaattcctgcttattattatggacagaatatcatcaaccattttacctgtgagattcaggccctgctgaagttcatctgctcagacactcctgtcagtctgagtctaggtctggttatccgtatattcacactgtccctgaccttcccttttgtccttatttcctacttctacattgtagttatcatgctgaggatccattctgttccggccaggctcaaacctttctccacctgtgtcacccatctaactgtagtcaccatatttaatggcaaagccatctacatgtacctgaaactacagtcaaaggaatctcaggaagaatacaaattattctagatattttatggagcagttattcccacattaattcccctcatttacactctgagaaacaaggacgtaaaatctacacttaggaagttagccaaagaaaac

SEQ ID NO: 2254 - protein, 40 aa, Canis familiaris
FSSVIYPSLVSVTLSAGKHMSWPNVSGTSPSFSTPAVRPR

SEQ ID NO: 2255 - DNA, 963 bp, Canis familiaris
atggccctattgcaggcaaaccacaccttgaactctgagtttatcatcttgggctttggggacctggccgaactgcaagtcttcttttttggactcttcctaatcatgcatcttgtcaccctagcagggcacacaaccattgtgctcatcaccctcattgactcctgcctccagacccccatgtatttcttccttcgcaacctgtcaaccattgagatttgctatatattggtgattgtccccaacatgctggccaatttcctatccaggagccagcggatgcccttcctgggctgtgccttgcagatgcacctcttcatcgccctgggtggtgcagagtgtttcctcttggccgtgatggcctatgatcgttttgtagccatctgcaacccgctgcgctacacagtcatcatcactagggccctctgcctgcagatgctgactctggcatgcatcagtggctttacactctcactcacccttactacgctgatattccttctgcccttttgtcggtcccacgagatcaatcatttcttctgtgacatccctgctgtgctgtttctggcctgctcggacacaagagccaatgagattgcggtcttcctcgtctgcatgctcattctgttgattcctttcttgctgattctgctctcctatgcgttcattattgctgccatcctcagaatccactcagctgagggaaggagcaaagccttctccacctgtgctgggcacctgctggtctctgttctgcactatggctgcgcaatattcatctacattcgccccaagtcatgctacaccccagaacaggacaaagttgtgtccttaatctataccaacgtaactcccatgctctaccctatgatctacagtctgaggaacaaggaagtcaagggtgccctcagaagacttctggagagctatagccagatgaggcagctacccaatgcaaggtga

SEQ ID NO: 2256 - protein, 320 aa, Canis familiaris
MALLQANHTLNSEFIILGFGDLAELQVFFFGLFLIMHLVTLAGHTTIVLITLIDSCLQTPMYFFLRNLSTIEICYILVIVPNMLANFLSRSQRMPFLGCALQMHLFIALGGAECFLLAVMAYDRFVAICNPLRYTVIITRALCLQMLTLACISGFTLSLTLTTLIFLLPFCRSHEINHFFCDIPAVLFLACSDTRANEIAVFLVCMLILLIPFLLILLSYAFIIAAILRIHSAEGRSKAFSTCAGHLLVSVLHYGCAIFIYIRPKSCYTPEQDKVVSLIYTNVTPMLYPMIYSLRNKEVKGALRRLLESYSQMRQLPNAR

SEQ ID NO: 2257 - DNA, 867 bp, Canis familiaris
ctgagacacccaggtgtcctgactgaattcattcttgtggggctgtccaagcaccccacatcccatactgttctctcctgggcagtgatgtttctctacatagtaactttggcaggaaacagtatgatcattttccaggtaggagtcaattctcggctccacatgccaatgtatttctttctcagcaacttctctttactgaatgtcctgttttccaccagtgctgtaccatgttttccaccagtgctgtaccactggttagccaactctctgcagaactttcccaccatttcctacagttcctgttttgcccagctcaccatctgagccttcttggtgctgattgaatatttccttcttgacattatggcttatgacagatttgtggctatctcagatccactcaggtacaacctgatcatgtcttctcgagtatgcatctcaatgtctttgcttgcatggataatgtctttcttgctcactattatgcccattatgctctttcccatcagtttttgtgggcataagtcagtcaatcacttctcctgtgaagtccaagccatttttatgagactgacatgctgtctaccacgctaaggaggcaggttccaagccatctttaaattgctctgttccaacaccattttcctagagattatgatgatggtgtgcattgtcatttcaatgccaggccctttaattctcatccttatctcttacctttgtatctgcagggtggtctgaaggacccacctaactgaggccaggcttgaagttttttccacatctggaaaaaactcaccttgtcatggtcaccatctactttggaactctaatatatatttatgtgagactccaaaccaaaaa

SEQ ID NO: 2258 - protein, 108 aa, Canis familiaris
LRHPGVLTEFILVGLSKHPTSHTVLSWAVMFLYIVTLAGNSMIIFQVGVNSRLHMPMYFFLSNFSLLNVLFSTSAVPCFPPVLYHWLANSLQNFPTISYSSCFAQLTI

SEQ ID NO: 2259 - DNA, 939 bp, Canis familiaris
atggcgagaggcaaccaaaccatcgtctcagaattcttcctcctggggctgtcagaagtgcctgagcatcagcccctcctcttcggtctgttcctatgcatgtacgtggttgctgtggtggggaacctgctcatcatcctggccattggctctacctccaatctccacacccccatgtacttcttcatagccaacctgtcctgcgttgacatctgcttcacctctgtcactataccaaagatgctgctcaatatccaaacccagagccagtccatcccctatgttggatgcctaactcagatgtattttctaatcttgtttctagaactggacaatgtcctcttggcagtgatggcatatgacagatttgtagccatatgtcaccctcttcattataccataaccatgagccctaaattctgtatcacagtggtgtctgtggctctgattatcacaaacatctatcccttgatccacaccctcttgatggatacactgtcattctgtgcaagtgtcagaattcaccatattttctgtgaactctacgcattgctaaagctttcctgttcagatatccacatcaatgagttagtcgtttataccctggggagctgtctttttgttgctcctttcctctttatttctgtttcctacatgcacattttctcagccatcctaagacttcattcttcccagagcaagctgaaagccttttctacttgcagttcccaccttgctgtggtgtcattgttctatggaactttatttggggtgtatctacgaccttcgtcttcctacacaattgaagactcagtggccactgtgctatatgcggtggtggctcccatgctcaaccccttcatttatagtcttaggaataaggacatgaaaggggctttgaggaacctcctcaggtggagaaagatctggtcttggtga

SEQ ID NO: 2260 - protein, 312 aa, Canis familiaris
MARGNQTIVSEFFLLGLSEVPEHQPLLFGLFLCMYVVAVVGNLLIILAIGSTSNLHTPMYFFIANLSCVDICFTSVTIPKMLLNIQTQSQSIPYVGCLTQMYFLILFLELDNVLLAVMAYDRFVAICHPLHYTITMSPKFCITVVSVALIITNIYPLIHTLLMDTLSFCASVRIHHIFCELYALLKLSCSDIHINELVVYTLGSCLFVAPFLFISVSYMHIFSAILRLHSSQSKLKAFSTCSSHLAVVSLFYGTLFGVYLRPSSSYTIEDSVATVLYAVVAPMLNPFIYSLRNKDMKGALRNLLRWRKIWSW

SEQ ID NO: 2261 - DNA, 908 bp, Felis catus
tccagacttgcccttccccatatcttcatgaatactctggccatttgttgtggagtctatagataaggggatttggcatgggcataaggatggtgtagaaaacagagatcattttttcttggatgggagaacgatctgaagtgggcagcatgtatatgaacaatactgttccatagtacattcccaccaccctgaggtgagaggaacaggtggcaaaagcttttcagcgaccatctccagaacccatgcaaatgacagccagcatgacacaagcataggaagcaatgatggttgttacagggataacaatccttacaatacagcggtagaaaagaacttcttcaaatgttgagatatcattgcatgagacgattagcatggaaggaaaatcacagaagaagttggctatttccctgaacccacaataggagaaagaaaacgataccatcagtagagcccaggatcaaagaagatgcggccataagtccacaaattttagggctcatagattgaaatatcttagaagatggcaaatggcaacataatggtcctaagacatgattgccaacaggaaacattcacaacctattagtgatgcatagaagaaaatttgtgtggcacacactgccacagtaatggacttgctgccagacaagtaattgaaggccatcttgggtacagtagtgcagatgagtatgagatccatgagggacagttggctgaggaggaagtacatgggggtgtggaactgggtgtccaggtagataaggagaaccatgacagtgtttcccgtgaaggccaccatgaagatacagaagaccaaagaaaagaggaagatgtgcatagggctttgatcaacgattcccaaaaggatgaaatcagaggtaaatctgattgtcccatgccat

SEQ ID NO: 2262 - protein, 118 aa, Felis catus
WHGTIRFTSDFILLGIVDQSPMHIFLFSLVFCIFMVAFTGNTVMVLLIYLDTQFHTPMYFLLSQLSLMDLILICTTVPKMAFNYLSGSKSITVAVCATQIFFYASLIGCECFLLAIMS

SEQ ID NO: 2263 - DNA, 914 bp, Felis catus
atggcaaattccaatgtgatgatgggatttctcctcacagggttttctgatgtatgggaactgcaggttttgcatgccataaccttctctgtgatgttgggaaacactgtcattgttactgtcaccacccttgacaggagtcttcacacacccatgtatttcttccttaggaatctgtccatcttggttgcatgctacatttctgtaacagttcctaactcatgcatcaattctctacttgacagcagcaccatttcaaaggctgggtgtaaagctgaggtcttcctagtggttttctttgtatatacggagcttctgtttctgactctcatggcccaagaccattatgtggctatctgccaacccctttactaccctataatcatgaactctcaaaatctgcatacaaatgactctggatttcatactcagtagtctcatctatgctgctgtacacactggcaatacattcaggctgccattctgtcaatccagtgttatccatcagttttttttttttttttttgtgatatcccttctctgctaaagctctcctgatctgacacctttagcaatgagatggtgctcattgtctgtggtctagggattgttggtggctgtttaattttcatcatcagctcttagagtcacatgttttctacagttttcaagttttcgagaggagcagacagaaaaaaggctttttctacctgtgtctctaatatatttgtggtatctgtcttcctcagctcaggtgtttatgtatacctgaggcaatcagaaaactattccaccatccaagacatattccccacttttcaaccttattatctcagttttagaaatgaacaaataaatgtgccattaataaaataaagagaatgtttactcaggaaatgtgcagaaaatttctg

SEQ ID NO: 2264 - protein, 144 aa, Felis catus
MANSNVMMGFLLTGFSDVWELQVLHAITFSVMLGNTVIVTVTTLDRSLHTPMYFFLRNLSILVACYISVTVPNSCINSLLDSSTISKAGCKAEVFLVVFFVYTELLFLTLMAQDHYVAICQPLYYPIIMNSQNLHTNDSGFHTQ

SEQ ID NO: 2265 - DNA, 929 bp, Felis catus
atggcatgggagaatcagactttcaactttgactttatcctcctgggaatcttcaatcacagttccacccacatcttcctcttctctctggtcttgggaatcttcacatttgccatcatgggaaacactgtcatgattctcctcatctacctggacaaccagctccacacccccatgtacttcctcctcagccaactctccctcatggacctcatgctcatctgcaccactgtacccaagatggccttcaactacttgtctggcaggaagtgcatctctctagctgggtgtggagcccagatatttttatatgtgtctctgcttggagcagaatgtttcctgttggctgtaatggcctatgaccgttatgttgccatttgccgcccattaagatactcaattctcatgaaccagaaaatctgtcatcttatggtcctttcttcctggattgttggctctcttgatggtataattgttgttgcagtcgcactatccttcccatattgtggtgcccgggaaatacctcactttttctgtgatgtccctgcccttctcactctctcatgcactaatacattgctatttgaaaggttaatgtttatttgctgtgtaattatgcttcttttccctgtaacagtaattattgcttcctaccttcaggtcattgtagctgtcattcaaatggggtctggggaaagccgccaaagagcttttgctacctgttcctctcacctcatggtggtaggaatgtattatggagcagccatgttcatatacatgaggcctgtttctgaccgttcccccacccaggacaagatggtgtcagccttttataccatccttactcctatgctgaatcccctcatctatagcctccgcaacaaggaagtggccagaggattaatgaaggtgttagggaggggaagtct

SEQ ID NO: 2266 - protein, 310 aa, Felis catus
MAWENQTFNFDFILLGIFNHSSTHIFLFSLVLGIFTFAIMGNTVMILLIYLDNQLHTPMYFLLSQLSLMDLMLICTTVPKMAFNYLSGRKCISLAGCGAQIFLYVSLLGAECFLLAVMAYDRYVAICRPLRYSILMNQKICHLMVLSSWIVGSLDGIIVVAVALSFPYCGAREIPHFFCDVPALLTLSCTNTLLFERLMFICCVIMLLFPVTVIIASYLQVIVAVIQMGSGESRQRAFATCSSHLMVVGMYYGAAMFIYMRPVSDRSPTQDKMVSAFYTILTPMLNPLIYSLRNKEVARGLMKVLGRGSL

SEQ ID NO: 2267 - DNA, 936 bp, Felis catus
atggcatgggagaatcagaccttcaactcagactttatcctggtaggaatcttcaatgacagccccactcacatcttccttttctcactggtcttgggcatcttcacagtggccttcatgggaaacactgctatggttctcctcatctgcctggacaaccaactccacacccccatgtacttccttctcagccaactctccctcatggacctcatgctcatctgcaccactgtacccaagatggccttcaactacttgtctggcaggaagtctatctctctggctgattgtggagcccagatattcttatatgtgtctctgcttggagcagaatgtttcctgttggcttcaatggcctatgaccgttatgttgccatttgccacccattaagatactcaattctcatgaaccagaaaatatgtggtctcatggcagctttttcatggattcttggctcacttgatggtataattgaagctgcagttgcattgtctttctcatattgtggtgcccgagaaataccccactttttctgtgatgtccctgcccttctcactctctcatgcactaacacattgttatttgaaaggatgatatttatatgctgtattattatgcttcttttccctgtagcagtaatcattgcttcttatgttcatgttattgtggctgtcattcacatgggatctggagagggcccacgtaaagcttttggcacctgttcttctcacctcatggtagtaggaatgtattacggagcagccatgttcatatacatgaggcccagttcagatcgtacccccacccaggacaaattcgtgtctgtcttctacactatccttactcccatgctgaatcctctcatctatagcctccgcaacaaggatgtggccagagcattcatgaaagtgttaggaaggggtaagtctggagag

SEQ ID NO: 2268 - protein, 312 aa, Felis catus
MAWENQTFNSDFILVGIFNDSPTHIFLFSLVLGIFTVAFMGNTAMVLLICLDNQLHTPMYFLLSQLSLMDLMLICTTVPKMAFNYLSGRKSISLADCGAQIFLYVSLLGAECFLLASMAYDRYVAICHPLRYSILMNQKICGLMAAFSWILGSLDGIIEAAVALSFSYCGAREIPHFFCDVPALLTLSCTNTLLFERMIFICCIIMLLFPVAVIIASYVHVIVAVIHMGSGEGPRKAFGTCSSHLMVVGMYYGAAMFIYMRPSSDRTPTQDKFVSVFYTILTPMLNPLIYSLRNKDVARAFMKVLGRGKSGE

SEQ ID NO: 2269 - DNA, 932 bp, Felis catus
atggaaaacaccacttgggtagtcaaccatactggactagattttgacctagtaggactcttcagtcaatataagtacccagctctcctttgtgtgatcgtctttgtggttttcctgatggccctgtctggaaatatcatcctgatccttgtgatatactgtgatgcccaccttcataaccctatgtacttttttatcacccagttgtctttcatggatgtgatgtacatttctgtcactgtgcccaagatgctcatggaccaggtcttgggtgtaaataagatctcagcccctgaatgcgggatgcagatgtttctctatttgacattaggaggttcagaagttttccttctagctgccatggcctatgaccgctatgtggccatctgtcatccactcctttatcctatcctaatgaaccatagggtgtgtctcctcttggtctcttcttcatggtttctgggatctttggatggatttactctcacacctgtcaccatgacattccccttctgtagatcccgggagatccaccatttcttctgtgaggttcctgctgtaatgaagctttcctgctcagacacttccctctatgagacactcatgtacttatgttgtgttctcatgctcctcattcctgtgacagtcatttcaagttcctattcttttatcctctttaccatccacaggatgaactcagcagtgggacagaagaaggcctttgccacttgttcttcccacatgactgtggtcatcctcttctatggggcttctgtctatacctacatgctccccacctcctaccacacccctgagaaggacatgattgtatcttttctttataccatactcactcctgttctaaaccctttaatttatagtcttaggaataaggatgtcacaagggctctaaaaagaatgttaaatgtggg

SEQ ID NO: 2270 - protein, 311 aa, Felis catus
MENTTWVVNHTGLDFDLVGLFSQYKYPALLCVIVFVVFLMALSGNIILILVIYCDAHLHNPMYFFITQLSFMDVMYISVTVPKMLMDQVLGVNKISAPECGMQMFLYLTLGGSEVFLLAAMAYDRYVAICHPLLYPILMNHRVCLLLVSSSWFLGSLDGFTLTPVTMTFPFCRSREIHHFFCEVPAVMKLSCSDTSLYETLMYLCCVLMLLIPVTVISSSYSFILFTIHRMNSAVGQKKAFATCSSHMTVVILFYGASVYTYMLPTSYHTPEKDMIVSFLYTILTPVLNPLIYSLRNKDVTRALKRMLNVG

SEQ ID NO: 2271 - DNA, 959 bp, Felis catus
taagcatcacttgtggatactttctgagcagataaacatcttgacagtatcttttgaaatgcccccatgacatccttgtttctgaggctgtagataagaggattgagcatgggtgtgacaatggtatagaaggctgaaactactttgtcctgctcaggagtgtgaaaagactggggcagaacataagtgtagaaggcagccccatagaaaatgctgaccacagtcaagtgggaagagcaagtagtaaaggcctttttccggccttcagcagagcgcattctgtggacagttaacaaaataagagagtaggagattgagatgatagagatagggatgagcaacatgagtacacagcagatgtacatcaaggtttcatacaaggatgtgtcagcacaggctagtctgagaactgcagggatctcacagaaaaaatggttgatatttcgggagtgacaatagggaacattcatggtgatgggggtgagcagaaagccatccagggaccccccaaaccaggcaccagcagccagcaggagacacaccctgcggttcatcaggactggatacctaagagggttacagacagccacatagcggtcataggccatgaggcccaagaggaagaactccgagccaatcatgctcaagtagaggaagatctggatgccgcaacccacaaaggaaatggtcttctctttagaaaccatgtcgaccagaagttttgggacagtggtacaaatgaaaagagtatccatgatggacagctggctgagcagaaagtacataggagtatggagacgggagtccacctgaatcaagaatatcatgaccaaatttgcagttacagctaccacaaaaatagcaaaaataacagcaaagacaatcccagtagttttattgttcaccagaagccccaggaggataaaatcagaagataaagttatattcttcatttacat

SEQ ID NO: 2272 - protein, 318 aa, Felis catus
  MOD_RES (318)..(318): Any amino acid
MKNITLSSDFILLGLLVNNKTTGIVFAVIFAIFVVAVTANLVMIFLIQVDSRLHTPMYFLLSQLSIMDTLFICTTVPKLLVDMVSKEKTISFVGCGIQIFLYLSMIGSEFFLLGLMAYDRYVAVCNPLRYPVLMNRRVCLLLAAGAWFGGSLDGFLLTPITMNVPYCHSRNINHFFCEIPAVLRLACADTSLYETLMYICCVLMLLIPISIISISYSLILLTVHRMRSAEGRKKAFTTCSSHLTVVSIFYGAAFYTYVLPQSFHTPEQDKVVSAFYTIVTPMLNPLIYSLRNKDVMGAFQKILSRCLSAQKVSTSDAX

SEQ ID NO: 2273 - DNA, 975 bp, Felis catus
ctagtgtttcctggacaaatccaccactctggttttctgggaggaggggcatctactcagcacttttcttagagctgtagccacatctttattcctcaagctgtagatgagtggattgagcattggggtgaggatggtgtagaaagcggatacaatcttgtctttctctggtgtgtggtaggaatgtggcaacacattggtgtagaaggctgccccatagaaaatgcttactaccattatatgggaagaacaggtagctaaggctttgcaccggccctcagcagaattaatgtgatggacagtgagcaggatgcgtgtgtaggaaacagagattacggatataggaatgagcagcattagcacgcagcaggcgtacatcagagtctcatagagagacgtgtcaacacatgacagtttcagtacagctgggatctcacagaaaaaatgattgatttctcgggagccacagtaggggaaactcatagtgaagggggtcagcatgaacccatctaaggagccaccaacccaggaacccaccaccatgaacaagcaaatcctgcgattcatgaggagagggtaccgaaggggtttgcatacagccacgtatcggtcataagccatgagacctagcaggaaaaattcacctccaactagtgtcaggtagaggaagatctgaagtgtgcatccaaagaaagagatgatcttttccttggacagaaggtcttgcagcatcttgggaacggtgatacagatgtaaactgtgtccataatggagagctggctgagtaaaaagtacatgggtgtattcaggcgagagtccacatggatgagcagaatcatgaccacattggctgttacagacaccagaaaaatggagaagactactgcaaaaataagcccagggaattcagggtgggtgatgaggcccaagaggatgaaatcagtggagttctggagaatggcttccatgatcat

SEQ ID NO: 2274 - protein, 324 aa, Felis catus
MIMEAILQNSTDFILLGLITHPEFPGLIFAVVFSIFLVSVTANVVMILLIHVDSRLNTPMYFLLSQLSIMDTVYICITVPKMLQDLLSKEKIISFFGCTLQIFLYLTLVGGEFFLLGLMAYDRYVAVCKPLRYPLLMNRRICLFMVVGSWVGGSLDGFMLTPFTMSFPYCGSREINHFFCEIPAVLKLSCVDTSLYETLMYACCVLMLLIPISVISVSYTRILLTVHHINSAEGRCKALATCSSHIMVVSIFYGAAFYTNVLPHSYHTPEKDKIVSAFYTILTPMLNPLIYSLRNKDVATALRKVLSRCPSSQKTRVVDLSRKH

SEQ ID NO: 2275 - DNA, 954 bp, Felis catus
ttagaacgtggatacacttcctgatgacaaacacttgcccagagctttctgtagagcccctgtaacatccttgttcctgaggctatagatgagtgggttgagcaagggagtgaggatagtgtagaaggcagacacagccttgtccttgtcaggggtatggtaagagtgaggcagcacataggtgtacatggcagccccatagaaaaggctgacaaccaccatgtgtgaggagcaagtggccactgcctttcgtctcccctctgcttcactcattctataaacagtgatgagaatccttgtataagaggctgagatgacagagaaagggatgaggagcatcatgatgcagcagacatacatggctgtctcgtaagttgatgtgtcagtacaggagagcttcagaagggcaggaacctcacagaagaagtggttgatttctcgagaggcacagaacgggaactgcatggtgactggggtaagcaggaagccatctatggaccctcccagccaggctgccagtacaatcaacatgcagacctttcggctcatgaggacaggatagcgcaaagggttacagatggctacatagcggtcataagacatgagtcctaggagaaaaaactcagcccctgccaatgtcaggtaaaggaagtgctgggcagtgcatcctgcaaaggatatggccctctggcccaagatctggtcaaccagcatttttggcacaatggtggaaatgtacaagatgtccatgagggagagttgactgagcaagtagtacatgggggtgtggaggcgggagtctatgtggatcagaatgatcatgatggtgttgctggctatggagatgacaaaaataaagaggatgagggcaaagagaagccagggaaaatcattgtcactgaacaagcccaggagaagaaagtcggcatacatggaataattgccccactccat

SEQ ID NO: 2276 - protein, 317 aa, Felis catus
MEWGNYSMYADFLLLGLFSDNDFPWLLFALILFIFVISIASNTIMIILIHIDSRLHTPMYYLLSQLSLMDILYISTIVPKMLVDQILGQRAISFAGCTAQHFLYLTLAGAEFFLLGLMSYDRYVAICNPLRYPVLMSRKVCMLIVLAAWLGGSIDGFLLTPVTMQFPFCASREINHFFCEVPALLKLSCTDTSTYETAMYVCCIMMLLIPFSVISASYTRILITVYRMSEAEGRRKAVATCSSHMVVVSLFYGAAMYTYVLPHSYHTPDKDKAVSAFYTILTPLLNPLIYSLRNKDVTGALQKALGKCLSSGSVSTF

SEQ ID NO: 2277 - DNA, 957 bp, Felis catus
tcaaaacacatctcctgacactttttgtgtacatttgaacctgcccattgccctcttcagagctccagtcacatccttgttcctcagactgtagatgagtggattcagcattggtgtaaggattgtgtagaacacagagaagactgtatcctgcgctgggttatggtaagagtgtggcagcatgtaggtgtacatggcagccccatagaacaaggtcactactgtcatgtgagatgaacaggtggcaaatgccttctttcttccctcaactgaactcatgtggtggactgtggtcaggatttgggcataagaagccagcactacagagaaaggaatcagcaacatcaggacacagcacacatacattactgtttcatagagggctgtgtctgcacatgccaaactcaagactgcaggtgcctcacaaaagaaatggttaatttcccgggagttgcagaaaggaaaggtcatggttatgggagttagaaggaagccatccaaaaagcctccaaaccaggaacctgctatgatcatccaacagacctggcgactcataaggacagggtagcgaagggggttacagatggccacatagcagtcataggccatgaggcccagtaggaagaactcagctcccacaagggtgaggtagaggaagtgctgagctgtgcaccccataaaggatatggttctttgacccagcagataatcaaccagcatcttgggcacaatggtggagatatacatcatgtcaatgaaggagagatggctgagaaggaagtacataggagtgtgcagtcgtgaatcagtgtggatcaggaagatcataatcccattggccatcaatgcagtgaaaaagatgatagagacaatggcaaagagaaggcctgagatgtccttcttgttgaacagtcccatcaaggtgaagtctgtagaggatgtgttgtacacttccat

SEQ ID NO: 2278 - protein, 318 aa, Felis catus
MEVYNTSSTDFTLMGLFNKKDISGLLFAIVSIIFFTALMANGIMIFLIHTDSRLHTPMYFLLSHLSFIDMMYISTIVPKMLVDYLLGQRTISFMGCTAQHFLYLTLVGAEFFLLGLMAYDCYVAICNPLRYPVLMSRQVCWMIIAGSWFGGFLDGFLLTPITMTFPFCNSREINHFFCEAPAVLSLACADTALYETVMYVCCVLMLLIPFSVVLASYAQILTTVHHMSSVEGRKKAFATCSSHMTVVTLFYGAAMYTYMLPHSYHNPAQDTVFSVFYTILTPMLNPLIYSLRNKDVTGALKRAMGRFKCTQKVSGDVF

SEQ ID NO: 2279 - DNA, 960 bp, Felis catus
tcagaatccttcccgtgtcacaccacgaatcccttgacatcttgccaagacccttttaaaggccccggttacatctgtgtttctcaagctgtaaatgagaggatttaacaaaggagtgagaatggtgtaaaaggcggagaagaccttgtctttgatcggtgtgtggtaggattggggaaccatatatgtatacagggcagccccataaaacaaggtcaccaccattatgtgtgatgagcaggtggcaaaagccttcttcttcccttctgctgacttcatctggtgcactgtgatgagaattcgggcataggaagcaattatcacagagaaggggatcagcagcatcatgacacagcaaacatacattaccatttcataggcagctttgtcaccacaggccagcctcagcatggtaggtgcttcacagaagaagtgattgatcttgcgggaactgcagaatgggagactcatggtgatcggagtgaggaggaagctgtccaaagcaccaccaaaccaagagctggccaagatcatccaacagacccggtggctcataagaacaggatagcgaagcgggttgcagatggccacatagcggtcataagccatgagtcctagcaggaaaaattcagcccccacaaagcccatgtagagaaagtgctgggctgtacaggcaacgaaggagatagtccccttgcccacaagataattgaccagcatcttgggcacaatggtagagatgtacatcatgtcaatgaaggagaggtggctgagcaggaagtacatgggggtatggaggtaagggtctatatggatcaggaagatcatgaccccattaactatcatggccatgaagaatacagcacaaattatgctgaaaaggaagcctgaggttgcaccatgagtgaagagccctatgagggtgaagtcactggaacaagttttattgtctccaaccat

SEQ ID NO: 2280 - protein, 319 aa, Felis catus
MVGDNKTCSSDFTLIGLFTHGATSGFLFSIICAVFFMAMIVNGVMIFLIHIDPYLHTPMYFLLSHLSFIDMMYISTIVPKMLVNYLVGKGTISFVACTAQHFLYMGFVGAEFFLLGLMAYDRYVAICNPLRYPVLMSHRVCWMILASSWFGGALDSFLLTPITMSLPFCSSRKINHFFCEAPTMLRLACGDKAAYEMVMYVCCVMMLLIPFSVIIASYARILITVHQMKSAEGKKKAFATCSSHIMVVTLFYGAALYTYMVPQSYHTPIKDKVFSAFYTILTPLLNPLIYSLRNTDVTGAFKRVLARCQGIRGVTREGF

SEQ ID NO: 2281 - DNA, 963 bp, Felis catus
ctacttttaagtttcgtgaaagacacgttccacattccacattttcttcagagccccaataacatccttatttcttagactatagatcaaagggttgagcacaggagtgagtattgtgtaaaagacagataccatcatgtccttctcaggtgtatggtaggacttggggagcatgtaagtataaatggcagccccatagaagaggatgaccacagtcatgtgggaagaacaagtggcaaaggccttcttttggccttctgctgagttcatcctatggatggtgatgaggataaagtagtaggatcctgaaatgactgtcacaggaatgagaagcatgaggacacagcacaagtacatgaaaatctcatagatggaggtgtctgaacaagagagtttcaacaccgctgggacttcacagaagaaatgatggatctcccgagatctgcagaaggggaaggtcatggtgatgggagtgaacaagaagccatccactgaacccaggaaccagcagccagatgctagaaggagaaacaccctagggttcatgaggactgggtaacggaggggatggcagatggctacatagcggtcataggccatagaggctagaagaaaaaattctgaacctgctagtgtcacatagagaaacatctgtatcccacattctgtggttgagatcttgttcatacccatgacttggtccatgagcatcttcggcacagtaacagaaatgtacattatgtccatgagagacagctggctgatgaaaaagtacatgggggtgtggaggtaggcatcagaatgtatcagtaggatcagaatggtgtttccagtcaaggccatcaggaaagccacaaaaatcaccaaacaaaggagagctgggtgtttggattcactgaagattcccaccaggatgaaatctgacctcgcagtgtagttagccacccagttggttttctccat

SEQ ID NO: 2282 - protein, 318 aa, Felis catus
MEKTNWVANYTARSDFILVGIFSESKHPALLCLVIFVAFLMALTGNTILILLIHSDAYLHTPMYFFISQLSLMDIMYISVTVPKMLMDQVMGMNKISTTECGIQMFLYVTLAGSEFFLLASMAYDRYVAICHPLRYPVLMNPRVFLLLASGCWFLGSVDGFLFTPITMTFPFCRSREIHHFFCEVPAVLKLSCSDTSIYEIFMYLCCVLMLLIPVTVISGSYYFILITIHRMNSAEGQKKAFATCSSHMTVVILFYGAAIYTYMLPKSYHTPEKDMMVSVFYTILTPVLNPLIYSLRNKDVIGALKKMWNVERVFHET

SEQ ID NO: 2283 - DNA, 957 bp, Felis catus
tattttctaatttattgaaagacagttcccacattcaacattttctttaaagtccttgtgacatctttattcctcagactatagattaaaggatttagcagtggaaggaggatggtataaaaaacagataccattatgtccttttcagggatgtagtgaaagctgggaagcatggagttgtagactccagccccaaaaaagaggataacaacagtcatatgggaggaaaaagttgcaaaggacttcttctggctctttgctgagttcatcctgtagatggtgaggaggatgaaaaaataggagtttgaaatgactctcactgggaaaaggagcgtgaggacacaacacaggtacatgagtgtctcatggagggaagtgagcaggaaagctttactatgtcaggaacttcacagaagaaatgatggatctccagagatctgcagaaagggaatgccatggtgacagatgtgagcatgaatccatccacagatgccagaaaccagcagccaaataccagtaggagacaaaccctatggttcatgatgacaggataataaagagactggcagaggcaacatagtagtcataggctatggtggctagaaggaaacattctgaacctcctagtatcacatagagaaacatttgtatcccacagtcgagggttgagatcttattcacacccataacctggtccataagcatctcgggcacagtgatataaatgtacattacatccatgggagacaactggctgatgaaaaagtacataggggtgtgcagataagcatcacagtatatcagaaatatcaggatagagtttccagacaataccaacaagaaaaacacaaaaatgaccacacagaggagagttgggtgttttgactgactgaaaattcccaccaggatgaaatcagactgtgccgtttcattgaccacccgagttttgttgtccat

SEQ ID NO: 2284 - protein, 139 aa, Felis catus
MDNKTRVVNETAQSDFILVGIFSQSKHPTLLCVVIFVFFLLVLSGNSILIFLIYCDAYLHTPMYFFISQLSPMDVMYIYITVPEMLMDQVMGVNKISTLDCGIQMFLYVILGGSECFLLATIAYDYYVASASLFIILSS

SEQ ID NO: 2285 - DNA, 963 bp, Felis catus
atggagaacaacacttgggtgaacaaccatactggacgatcagattttgacctagtgggactcttcagtcaatccaagcacccagctctcctttgtgtggtaattttagtggatttcctgatggctttgtctggaaacatcatcctgatccttctgatatactttgatgctcaccttcataatcccatgtacttttttatcacccagttgtctctcatggatgtgatgtacatttctgtcactgtgcccaagatgctcatggaccaggtcatgggtgtgaataagatctcagcccccgaatgtgggatgcagatgtttctctatttgacactaggaggttcagaatttttccttctagcagctatggcctatgaccgctatgtggctatctgccatccactccgttatcctatcctcatgaacaatagggtgtgtctcctcctggtgtcttcttcctggtttctgggatctgtggatggatttatgataacccccatcaccatgaccttacccgtctgcagatctcgggagatctatcatttcttctgtgaagttcctgctgtaatgaaactttcctgctcagacacttccctctatgagacattcatgtacctctgttgtgtcatctcactcctcttccctgtgacagtcatttcaagctcctattctttcatcctcttcaccatccacaggatgaagtcagcagaggggcggaagaaggcctttgccacttgttcttcccacatgaccgtggtcgtcctcttctatggggctgctgtctatacctacatgctccccaacacctaccacacccctgagaaggacctgattgtatctgtcttttacaccatactcactcctgttctacaccctttaatttatagtcttaggaataaggatgttacaagggctctaaaaaaaatgttgaatgttaagtctgtctctcaggaaagtataaaataa

SEQ ID NO: 2286 - protein, 320 aa, Felis catus
MENNTWVNNHTGRSDFDLVGLFSQSKHPALLCVVILVDFLMALSGNIILILLIYFDAHLHNPMYFFITQLSLMDVMYISVTVPKMLMDQVMGVNKISAPECGMQMFLYLTLGGSEFFLLAAMAYDRYVAICHPLRYPILMNNRVCLLLVSSSWFLGSVDGFMITPITMTLPVCRSREIYHFFCEVPAVMKLSCSDTSLYETFMYLCCVISLLFPVTVISSSYSFILFTIHRMKSAEGRKKAFATCSSHMTVVVLFYGAAVYTYMLPNTYHTPEKDLIVSVFYTILTPVLHPLIYSLRNKDVTRALKKMLNVKSVSQESIK

SEQ ID NO: 2287 - DNA, 947 bp, Felis catus
tcatatattttctaagtaagaccatttctcattaccagtgttctccaggcccctttcacatctttgtttctcagagtatagataatggggtttaagactggggtgactatggtgtagaaaagagagacaaacttaccctgtttttttgacctacttttggccggctgaaggtacataaaaatgatggtgccatagaaaatgatgaccacaatcaggtgggatgaacaagtcccaaaaaccttccagcgccctgctgctgattttatcctcagcacagcttttgttatgaagccataggagactaagatgagtgacactgggacaactagaaaaatcacactagccacaaagagttctacttcattgaaagttgtgtccacacaggccagtttgatgagcacaggaacctcacagaaaatgtggtccagtttgcgatgtccacaaaggggtagctgaacagtaagggagcactggattaaggaggtgatcagtccactgagccatgctatgctggctagggatgcacagagttgaggatgcataatggttgtatattgcagaggctggcagacagcagcataacgatcataagccatgaccgccaggagaatacattcagaggaacccaaccccatggccacatacagctgggccacgcatccaccatagctcacacttttctctttcttattcatggtaactagcaactgtggggcaacactggtggtaaagcagatgtccacacaagacagattgctgaggaaaaagtacattggcgtgtggagtttggggactaaacaagatactaaaataatggtagtgttccccagaatgttaaagatgtacaaaagcaaaattatgatgaaaaggatcctttcaagccagggttcatctgcaaatcccaggagaagaaaacccttttcagagctgttgctgctttcctccat

SEQ ID NO: 2288 - protein, 311 aa, Felis catus
MEESSNSSEKGFLLLGFADEPWLERILFIIILLLYIFNILGNTTIILVSCLVPKLHTPMYFFLSNLSCVDICFTTSVAPQLLVTMNKKEKSVSYGGCVAQLYVAMGLGSSECILLAVMAYDRYAAVCQPLQYTTIMHPQLCASLASIAWLSGLITSLIQCSLTVQLPLCGHRKLDHIFCEVPVLIKLACVDTTFNEVELFVASVIFLVVPVSLILVSYGFITKAVLRIKSAAGRWKVFGTCSSHLIVVIIFYGTIIFMYLQPAKSRSKKQGKFVSLFYTIVTPVLNPIIYTLRNKDVKGAWRTLVMRNGLT

SEQ ID NO: 2289 - DNA, 960 bp, Felis catus
ctactttatagtttcctgaaagacaaattccacattcaacattttttttagtgcctttgtaacatccttattcctaagactataaattaaagggtttagaacaggagtgagtatggtgtaaaagacagatacaatcatgtcattctcaggggtgtggtaggaattggggagcatgtaggtatacacggcagccccatagaagaggatgacaacagtcatgtgggaagaacaagtagcaaaggcctttttctgcccctctgctgacttcatcctgtggatggtgaagaggatgaaagaataggagcttgaaatgactgtcacaggaatgaggagcatgagaacgcaacataagtacataagtgtctcatagatggaagtgtctgagcaggaaagcttcattacagcagggacttcacagaagaaatgatggatctcccgggatctgcagaaagggaaggtcatggtgacgggagtgagcataaatccatccacagatcccagcaaccagcaggaagacaccaagatgaggcataccctatggttcatgaggataggataacggagtggatggcagatggccacatagcggtcataggccatggcagctagaaggaaaaattctgaacctaccagtgtcaaatagagaaacatctgcatcccacattcaggggctgagatcttattcacacccataacctggtccatgagcatcttgggcacaatgacagaaatgtacatcacatccatgagagacaactgagtgataaaaaagtacatggggttatgaaggtgaacatcatagtgtatcaaaaggatcagcatggtgtttccagacaaggccatcaggaaaaccacaaaaatgaccacacaaagcagagatgggtgcttggattgactgaagagtcccactagatcaaaatctgatcgtacagtatggttggcgacccaagtgttttccat

SEQ ID NO: 2290 - protein, 319 aa, Felis catus
MENTWVANHTVRSDFDLVGLFSQSKHPSLLCVVIFVVFLMALSGNTMLILLIHYDVHLHNPMYFFITQLSLMDVMYISVIVPKMLMDQVMGVNKISAPECGMQMFLYLTLVGSEFFLLAAMAYDRYVAICHPLRYPILMNHRVCLILVSSCWLLGSVDGFMLTPVTMTFPFCRSREIHHFFCEVPAVMKLSCSDTSIYETLMYLCCVLMLLIPVTVISSSYSFILFTIHRMKSAEGQKKAFATCSSHMTVVILFYGAAVYTYMLPNSYHTPENDMIVSVFYTILTPVLNPLIYSLRNKDVTKALKKMLNVEFVFQETIK

SEQ ID NO: 2291 - DNA, 955 bp, Felis catus
ggagaacaacacttgggtggccaagcatactcgacgatcagattttgacctagtgggactcttcagtcaatccaagcacccaactctcctttgtgtggtaatttttatggatttcctgatggccttgactggaaacattatcctgatccttgtgatatgccatgatgcccaccttgacaaccccatgtactattttatcacccagttgtctctcatggatgtgatgtacatttctgtcactatgcccaagatgctcatggaccaggtcatgggtgtgaataagatctcagcccctgaatgtgggatgcagatgtttctctacttgacactagcaggttcagaagttttccttctagctgccatggcttatgaccactatgtggccatctgccatccactctgttatcctatcctcatgaaccatagggtgtgtctcctcctggtctcttcctcctggtttctgggatctctggatggatttatgctcacgcccatcaccatgacctcccccttctgcagatcccaagagatccatcatttcttctgtgaagcccctgctgtaatgaagctttcctgctcagatacttccctctatgagacactcatgtacttatgttgtgttctcatgctcctcatccctgtgacagtcatttcaagctcctattctttcatcctcttcaccatccacaggatgaattcagaagaggggtggaaaaggcctttgccacttgttcttcccacatgaccatggtaatcctcttctatgggactgctgtctacacctacatgctccccaattcctaccacacccctgagaatgacatgattgtatctgtcttttataccatactcactcctgttctaaaccctttaatttatagtcttaggaataaggatgtcacaagggcactaaaaaaatgttgaatgtagaatctgtcaggaaactataaagtag

SEQ ID NO: 2292 - protein, 247 aa, Felis catus
ENNTWVAKHTRRSDFDLVGLFSQSKHPTLLCVVIFMDFLMALTGNIILILVICHDAHLDNPMYYFITQLSLMDVMYISVTMPKMLMDQVMGVNKISAPECGMQMFLYLTLAGSEVFLLAAMAYDHYVAICHPLCYPILMNHRVCLLLVSSSWFLGSLDGFMLTPITMTSPFCRSQEIHHFFCEAPAVMKLSCSDTSLYETLMYLCCVLMLLIPVTVISSSYSFILFTIHRMNSEEGWKRPLPLVLPT

SEQ ID NO: 2293 - DNA, 942 bp, Felis catus
tgccaaaagcaccagtgatgaccaacaagagtttcccaactggcttcattcttcttggtttctctgaatggcctcatctagaaatgcttcttttctggattgtgatcatcttgtacacaatgatcatcctctccaactcaactattatcttgctttcttgtgtggaccctcatctctacactcccatgtacttctttcttagcaatctttccttcttggatctctgctttaccacaaccactgttccccatatgttgtccaacttgtggggacctggcaagatcatcacctacacaggctgtgtcatccaactctgcatgttactctgtcttggtgccacagaatgtgtcatgttggtggtgatggcctttgatcgttacattgctatctgccaacccctgcactataccatcatcatggatcatcagttctgttggaagctggtgctaatagcctggatctctggcctaatagaatctgttacccagattcctgtcacacttcagcttcccttctgcacccaccaccgcctagatgactttctctgtgaggttcctgccctcatacgcttgacatgtggagacacctcggccagtgagtggcagatgacagtctctgctgttcttttcaccatcgtaccactggggttgatcctgacttcttatggctacatagctcaagctttaggtaaaatccaatccaaggatggcagacagaaagccattgccacctgctcctcccacctcattgtggtctttatgttttatggaacagtggcaccagtgtatacataccctaagaatcactttgcttcaaattatagcaagttctttacattcttctacactgcggtcacaccattgttaaatccactcatctattccctaaggaacaaagatgtaaaaaatgccctgatacaactgctaagaagaggatcaccat

SEQ ID NO: 2294 - protein, 309 aa, Felis catus
  MOD_RES (309)..(309): Any amino acid
MTNKSFPTGFILLGFSEWPHLEMLLFWIVIILYTMIILSNSTIILLSCVDPHLYTPMYFFLSNLSFLDLCFTTTTVPHMLSNLWGPGKIITYTGCVIQLCMLLCLGATECVMLVVMAFDRYIAICQPLHYTIIMDHQFCWKLVLIAWISGLIESVTQIPVTLQLPFCTHHRLDDFLCEVPALIRLTCGDTSASEWQMTVSAVLFTIVPLGLILTSYGYIAQALGKIQSKDGRQKAIATCSSHLIVVFMFYGTVAPVYTYPKNHFASNYSKFFTFFYTAVTPLLNPLIYSLRNKDVKNALIQLLRRGSPX

SEQ ID NO: 2295 - DNA, 879 bp, Felis catus
atgcacctgttcctcttcagcatggttgtggtagtctacacacttgccatggctggcaacactgccatggttttcctgatctgggcagatgcccggctccacacacccatgtatttcctcctcagccagctgtcttttctggacatcttcttcacctcagtcaccatccccaagatgatagcaggcttcctctttggctggactagcatctcatttgtgggctgtggagcacaaatgtttttcttcatgttctttggggccacagagtgcctcctgctggccctcatggcctatgaccgttacgtggccatctgcaaccctctgcgctacccatcactcatgagtcatcagacctgtctgctcatggtggctgcctcctggctgggagggtctctcaatgcctccatccagactgcactgaccctgcagttcccctattgtggctcaagaaagattgcacactttttctgcgaggtgccttcactgctgaggctggtttgtgctgacacagcctcctacgagcacgttctttttgtgacaggtgtggtagtccttctgctgcccattgcctttatcactatgtcctatgccctcatcttggcagcagtgcttgggatgcactctgtggaggggcgtcggaaggccctagccacctgctcctcccacttaacagttgtcaacctcttctatggacccctcgtctatacctatatgttacctgcatcctaccactctcctggccaggatgatgtagtgtccatcttctatacagtcctcacacccatgctgaatcctgtcatctacagtctcaggaacaaggaagtgacaggagcaatgaagaatgtcatagggaagtgtgggatgggtaagattgcttaa

SEQ ID NO: 2296 - protein, 292 aa, Felis catus
MHLFLFSMVVVVYTLAMAGNTAMVFLIWADARLHTPMYFLLSQLSFLDIFFTSVTIPKMIAGFLFGWTSISFVGCGAQMFFFMFFGATECLLLALMAYDRYVAICNPLRYPSLMSHQTCLLMVAASWLGGSLNASIQTALTLQFPYCGSRKIAHFFCEVPSLLRLVCADTASYEHVLFVTGVVVLLLPIAFITMSYALILAAVLGMHSVEGRRKALATCSSHLTVVNLFYGPLVYTYMLPASYHSPGQDDVVSIFYTVLTPMLNPVIYSLRNKEVTGAMKNVIGKCGMGKIA

SEQ ID NO: 2297 - DNA, 932 bp, Felis catus
atgaaaaatgggaacaccacctctgatttcattctcctaggactctttaaccacacaggaacccatctatttctctttgcaatggttctcacaattgccttcgcctccctagtgggaaatgccctcatgattctcctgattcaccaagatgcccggctccacacacccatgtacttcctactgagccaactctccctcatggacatgatgctggtctctaccattgtgcccaaaatggctactaactacttgactggaaagatgtccatctcccctgctgagtgcgggttgcagatattcttccttctaactttaggagggggtgagtgtttcctcttagcagccatgtcctatgaccggtatgtggctgtttgtcacccactgcgatacccagccctcatgagctggcaattatgcctgagaatgactgtggggtcttgggtcctgggggcagttgatgggctcatgcaggctgctgctaccctgagttttccattttgcgatgcacatgagatcaatcatttcttctgtgaggcccctactctggtgggtttagcttgtgccgacacgtttgtctttgagtatgtgatgtacgtatgctgtgtgttaatgctcctggtcccattttctctcattctgatttcctatagtctcatccttgctgcagttctccagatgcattctagagaagcccgcaaaaagccttttgccacctgctcctcacatctttctgtggtgggactcttttatggagctgcaatttttacctatatgcaacccaaatcctacaggtcagctcaccatgataaagtagtgtcagtgttctatactatcttcacccctgtactcaatcccctcatctacagtctgagaaacagtgaagtcaagggtgccttgagaaagtgtatgggtcagtgttctgccttaagtca

SEQ ID NO: 2298 - protein, 311 aa, Felis catus
  MOD_RES (311)..(311): Any amino acid
MKNGNTTSDFILLGLFNHTGTHLFLFAMVLTIAFASLVGNALMILLIHQDARLHTPMYFLLSQLSLMDMMLVSTIVPKMATNYLTGKMSISPAECGLQIFFLLTLGGGECFLLAAMSYDRYVAVCHPLRYPALMSWQLCLRMTVGSWVLGAVDGLMQAAATLSFPFCDAHEINHFFCEAPTLVGLACADTFVFEYVMYVCCVLMLLVPFSLILISYSLILAAVLQMHSREARKKPFATCSSHLSVVGLFYGAAIFTYMQPKSYRSAHHDKVVSVFYTIFTPVLNPLIYSLRNSEVKGALRKCMGQCSALSX

SEQ ID NO: 2299 - DNA, 939 bp, Felis catus
ttagtcatggcttaaggcagaacactgacccagacattttctcagggctaacttgacttctctgttcctcagactgtagatgagggggttcagtataggggtgaagatagtatagaacactgaaactactttatcatggtgagctgacctgtaggatttaggttgcatataggtaaaaattgcagctccgtaaaagagtaccaccacagagagatgtgaggagcaggtggtaaaagcctttttgcgggctgatctaaaacgcatctggagaactgcagcaaggatgagactataggaaatcagaatgagagacaatgggaccaggagcattaacacacagcatacgtacatcacatactcaaagacaaacgtgtccgcacaagctaaacgcaccagagtaggggtctcacagaagaaatgattgatctcatgtgcatcacaaaatggaaaactcagggtagcagcagcctgcatgagcccatcagctgcccccaggacccaagaccccacagtcattctcaggcataattgccagctcatgagggctgggtatcgcagtgggtgacaaacagccacataccggtcataggacatggctgctaagaggaagcactcgccccctcccaaagtgataaaaaagaagatctgcaacccacagccggcaagggagattaacttctctccagtcaagtagtcagtaaccattttgggcacaatggtggaaaccagcatcatgtccatgagggagagttgactcagtaggaagtacatgggtgtgtggagtcgggcatcttgatgaatcaagaagatcatgaaggcattgcccactagggaggcgaaggaagttgtcacaaccatcacaaaaagaaatagtttggcttctgtgtggttaaagagtcctaggagaatgaaatatgaggtggtgttcccgtttttcat

SEQ ID NO: 2300 - protein, 312 aa, Felis catus
MKNGNTTSYFILLGLFNHTEAKLFLFVMVVTTSFASLVGNAFMIFLIHQDARLHTPMYFLLSQLSLMDMMLVSTIVPKMVTDYLTGEKLISLAGCGLQIFFFITLGGGECFLLAAMSYDRYVAVCHPLRYPALMSWQLCLRMTVGSWVLGAADGLMQAAATLSFPFCDAHEINHFFCETPTLVRLACADTFVFEYVMYVCCVLMLLVPLSLILISYSLILAAVLQMRFRSARKKAFTTCSSHLSVVVLFYGAAIFTYMQPKSYRSAHHDKVVSVFYTIFTPILNPLIYSLRNREVKLALRKCLGQCSALSHD

SEQ ID NO: 2301 - DNA, 966 bp, Felis catus
tcattgaagcatggaaacctgttttgatggggcacttttcaaacaccttcatcattgtgcccacaacctcccacttttttagactgcagatgagggggttaagtataggagtgaggatggtgtcaaacataaagagaacctggttcaggatgaaggtgtgggaagatcaaggcctcatttatatcagcatgcatggaccaaagtaaatgataagcaccatcagatggaaggagcaagtagtcagggccttgatcctgcattcacaggtgtttatttgcaagacgtgcaggaagatgaggatgatggaggtcagggtaaagcttttgggaagaagaaccacaacaatatggatcactactatcactttctcataggctgagatgtcctcacaaaacagtttcaagatgtcaaagacctctcaacaatacctcacagaagaacaggtggagttctcaggggctaaagagaagaaagttcatggcataaatggcacagaccaaggatgccagagtccctcccacccaggtcccaaagaccatattctggaagacctgtagacaggtataactgggtatctgaatggattgctggtggccacatcgaatcataatccatgagactcaagagaagagtaggcacttagtaatcccaagagtcaaggtgaagaggacctgggtcccagagttgatcaatggtacttttcttttacctaagaaaaagatgaccaatatttttggaagtatgctaaagatgaaaaccgggtcaatgagtgagttgtcaaatcagtaaatacatggaggtgtggaagtggggatctgacaagatgaggaggatcaaaacagtgtttcctgtgatagcaaaagtgtagatgaggaggacaacagagacaaggaggtcagtatgtctcattccagggaagaagcccaggagaatgaagtctgtgcccaatgtctcatttcctttctc

SEQ ID NO: 2302 - protein, 67 aa, Felis catus
IEAWKPVLMGHFSNTFIIVPTTSHFFRLQMRGLSIGVRMVSNIKRTWFRMKVWEDQGLIYISMHGPK

SEQ ID NO: 2303 - DNA, 945 bp, Felis catus
tttcacctttttcaggaagcatctactaatgactatactcttcatagctgctattacatccttgtttctcaggctatagatgagagggttaagcataggggtaagaatagcattaaacataaagagggactggtttattttgggggtcttaaaggatcctggcctcatgtagactaatacagcaggaccaaagtaaaggctgaccacacagagatgggagaagcatgtggccaaggccttgttcttgccttcaggggaattcatgtggacaacagcaaggaatatacggatataggaagccaggataagactcagagggatgaggaccaccagaaagcttgagaccaccactgaatttacataggctgaaatgtcctcacaagtgagcttcaggagtgccatgacctcacacaagaagtgtgggatctctcgaggatgacagatgggtaagtgcatgacataagctgtatgaaccagtgaagttattgcccctccgacccaggacacaatgaccatctgtttacaaatggtatggctcatcatgactgaataacgcagtggattgcagatggcaatgtagcggtcataggacatgagggtaagcagaaggcactcagaaattcccaaggttaagctgaataagatctgggatccacaaccaatctgtgatatggttctcttccctgagaagaaatttgtggccattttggggacagtagttgagatcagagccacatcaataagggaaagctgactgagcaggaagtacataggacagtggagtcgagaatccagccagatgaggagaatgagaacagcattgcctatcacagccataatatagaccagaagaatgaggaagataaggatcacaaggtggctgaactcaggccagagccccaaaagaataaaatctgtggtgacagtcttattgtttttctccat

SEQ ID NO: 2304 - protein, 315 aa, Felis catus
MEKNNKTVTTDFILLGLWPEFSHLVILIFLILLVYIMAVIGNAVLILLIWLDSRLHCPMYFLLSQLSLIDVALISTTVPKMATNFFSGKRTISQIGCGSQILFSLTLGISECLLLTLMSYDRYIAICNPLRYSVMMSHTICKQMVIVSWVGGAITSLVHTAYVMHLPICHPREIPHFLCEVMALLKLTCEDISAYVNSVVVSSFLVVLIPLSLILASYIRIFLAVVHMNSPEGKNKALATCFSHLCVVSLYFGPAVLVYMRPGSFKTPKINQSLFMFNAILTPMLNPLIYSLRNKDVIAAMKSIVISRCFLKKVK

SEQ ID NO: 2305 - DNA, 929 bp, Felis catus
ttacctggaggactgacaccgccccattaactttttcagtgcacttagaacttccttgttcctgagactgtaggcaagagggtttaggagaggggtgaggacagttccaaacagaaaaagaccctgatttaactttggagtcttggcagaaccaggtctcatgtatatgcacaaacctggaccaaaatagagacccaccacacagagatgagaggagcaggtggccagagccttgttcctcccttctggggagttcattcggagtacagcaaggaagatgagaacataagaagacaaaatgagagataagggcaggagcagaacaaggatgcttgttatcaccactgccttctcataggctgagatatcctcacagacgatcctaagcacagccataacttcacagaagaagtggggaatttctctggggctgcagatattaaaatgcaaggtaaaagccgtgtggcccaaggaagtaagtgcccctccaacccaagacatagcaatcatctgtaagcataccctaagatttataatggctgggtaccgaagaggatcgcatatggctacataacgatcaaaacacatgagcgttataaggatgcattccgcaatggccacagtcagggagaagaaaatttgagtcccacaagccaagaatgatatgctccgccatccagagaagaagttggtggccatcttggggatgatgctagaggtcaaagttaagtccattaaggagagctgactgagcaggaagtacatgggggtgtggagatgggagtacaaccaaatgaggaggatcagaagagtattgccagtgaaggttgccatgtagatcaggagaatgatggagaccatggctgaaatgtatttaaattcagggaagaagcccaggaggatgaaatctgtgggttttgtctcattcc

SEQ ID NO: 2306 - protein, 308 aa, Felis catus
NETKPTDFILLGFFPEFKYISAMVSIILLIYMATFTGNTLLILLIWLYSHLHTPMYFLLSQLSLMDLTLTSSIIPKMATNFFSGWRSISFLACGTQIFFSLTVAIAECILITLMCFDRYVAICDPLRYPAIINLRVCLQMIAMSWVGGALTSLGHTAFTLHFNICSPREIPHFFCEVMAVLRIVCEDISAYEKAVVITSILVLLLPLSLILSSYVLIFLAVLRMNSPEGRNKALATCSSHLCVVGLYFGPGLCIYMRPGSAKTPKLNQGLFLFGTVLTPLLNPLAYSLRNKEVLSALKKLMGRCQSSR

SEQ ID NO: 2307 - DNA, 825 bp, Felis catus
atggtgggtggaaacaaatcctcaataaccgatttcatccttgtcggactctttcctgaatttcagcattctattgtcctcaactttatgatcatctttgtctacattcttgccttcctgggaaacatacttttgattgtcttaatttggggagactctcgacttcatacgcccatgtacattctcctcagtcaactctccctcattgacttgacattaacttccaccattgttccaaagatggcttctaactattttactgggaaaagaaccatatcatggattggctgtggaacacagagtttcttcttcctgatgttgggaatgtcagaatgcctcatcttgactctcatggcttatgaccgctatgtggctgtctgcaacccattgcgttatcccattattatgagccccaggttctgtatgcacatggttttaggttgttggattggaggctctataagttcatttatccatacagtctaccctatgcattttcccatctgtgggtcacgggagatccaccacttcttctgtgaggtcccagtcctcattaagctctcctgtgaagacacttcagtgtaccagttagtggtggtggtgacaagcattgtgttgcttgttgtacctttcagtctcatcacagtttcctatactctcatcttcctcactgtatttcgtatgaactctgtcaaaggcaggaaaaaaactctggccacttgttcttcccatctaactgtggtgagtctcttctttggcccaaacatatttatctatatgactttcacttcctcccatagtgcagagcaggaccaagctctttct

SEQ ID NO: 2308 - protein, 275 aa, Felis catus
MVGGNKSSITDFILVGLFPEFQHSIVLNFMIIFVYILAFLGNILLIVLIWGDSRLHTPMYILLSQLSLIDLTLTSTIVPKMASNYFTGKRTISWIGCGTQSFFFLMLGMSECLILTLMAYDRYVAVCNPLRYPIIMSPRFCMHMVLGCWIGGSISSFIHTVYPMHFPICGSREIHHFFCEVPVLIKLSCEDTSVYQLVVVVTSIVLLVVPFSLITVSYTLIFLTVFRMNSVKGRKKTLATCSSHLTVVSLFFGPNIFIYMTFTSSHSAEQDQALS

SEQ ID NO: 2309 - DNA, 831 bp, Felis catus
aatggtgttcagcactgtggcaaatttgttaacatccatcacatcacccttttttgggcggacgtaaataaagatggagcttccataataaagtgtcacaacagtgatgtgtgaaacacaagtggagaaagctttctgccgtccctggtcaaaaggaattctaaggatagcaataataatgtacatgtaagacactcctgtgaagagcaaggagcccaagagcaacacagcagaggagataaagtcagccagctcagccagagcgatatctgcacagaccagctttagcacagggccactgtcacaaaagaagtgattgataatatttggtccacaaaagggcagaggagcagttaagattgatggtgctaaaattgacaaaaatgcacctaaataggatcccagaagcaacaatatgcatgtctgtttgttcatgatgatggcatacctcaatgggttgcagatggcaatgtatcgatcatatgacatgacgaccaggatgaagaattccgtggatcccaagaggaagtaaaagaaagattgcgtgagacatcccataaaggatattgctttggtgagggaaaatgtgtttgctagcatcttaggcaccactgtggaggtgatggcgacttcaaggaaggaaagattggctacaaagaaatacatgggtgaatgcagacggtagtcaccacacaccaaaaggatgatcatggtgttgccaatcagagacgtcatatacatgagcaagaatgcagaaaaaagaagaatttctacttccttctcattctgaaaccccagaagaataaactcagtgactgcggtcttgtttct

SEQ ID NO: 2310 - protein, 277 aa, Felis catus
RNKTAVTEFILLGFQNEKEVEILLFSAFLLMYMTSLIGNTMIILLVCGDYRLHSPMYFFVANLSFLEVAITSTVVPKMLANTFSLTKAISFMGCLTQSFFYFLLGSTEFFILVVMSYDRYIAICNPLRYAIIMNKQTCILLLLGSYLGAFLSILAPSILTAPLPFCGPNIINHFFCDSGPVLKLVCADIALAELADFISSAVLLLGSLLFTGVSYMYIIIAILRIPFDQGRQKAFSTCVSHITVVTLYYGSSIFIYVRPKKGDVMDVNKFATVLNTI

SEQ ID NO: 2311 - DNA, 831 bp, Felis catus
agaaacaagaccagagtcatggagtttattcttctggggtttcagaatgaaaaggaagtagaaattcttcttttttatgcattcttgctcatgtacatgacgtctctgattggcaacaccatgatcgtccttttggtgtgtggtgactaccatctgcattcactcatgtatttctttgtagccaatctttccttccttgaagttgccatgacctccacagtggtgcctaagatgctggcaaacatattttccctcaccaaggcaatatccttcataggatgtctcacacagtctttcttctacttcttcttgggatccacggaatccttcatcctggtcgtcatgtcatatgatcgatacattgccatctgcaacccattgaggtatgccatcatcatgaacaaacagacatgcatattgttgcttctgggatcctatttaggtgcatttttgtcaattttagcaccatcaatcttaactgctcctctgcccttttgtggaccaaatattatcaatcacttcttttgtgacagtggccctgtgctaaagctggtctgtgcagatatcgctctggctgagctggctgactttatctcctctgctgtgttgctcttgggctccttgctcttcacaggagtgtcttacatgtacattattattgctatccttagaattccttctgtccagtgacagcagaaagctttctccacttgtgtttcacacatcactgttgtgacactttattatggaagctccatctttatttacgtccgcccaaaaaagggtgatgtgatggatgttaacaaatttgccacagtgctgaacaccatt

SEQ ID NO: 2312 - protein, 229 aa, Felis catus
RNKTRVMEFILLGFQNEKEVEILLFYAFLLMYMTSLIGNTMIVLLVCGDYHLHSLMYFFVANLSFLEVAMTSTVVPKMLANIFSLTKAISFIGCLTQSFFYFFLGSTESFILVVMSYDRYIAICNPLRYAIIMNKQTCILLLLGSYLGAFLSILAPSILTAPLPFCGPNIINHFFCDSGPVLKLVCADIALAELADFISSAVLLLGSLLFTGVSYMYIIIAILRIPSVQ

SEQ ID NO: 2313 - DNA, 972 bp, Felis catus
ttacctaataaagaaactgcccttcacttttcctccatagatatcacacttttttctcatgagttttctaacagcctctttgaattcttgattcctcaagctgtagataatagggttcagaagtggggtgaccacagtgtagaagacagaaataatcttgttgatttcaggtgacaggtggtcattggggcgaacatacatggagatcatggtgccatagtagatagtgacaacagccaaatgggagccacatgtggaaaaggtcttcatccagccagagcctgaaggaattctcaatatggtggacacaatgaaaacataggatacaagtgtgagaaaaaagcaaatgcacaacactgcaattgacagaataaagatgaccatcctggtgatatacacactggaacatgagagctgcatgaggggagggaggtcacagaagaaatgattgatctggttaggcccacagaaatccaacttggaaatcattagggagggcagaagccctgtgccaacacctgtcaaccaggagattgccactaacttggtgcagatctcaggactcatcaaggaagagtactggagtgggctgtagatggccagatatcggtcataggccatcatggccagaagaaaacactcagtagctccaaagaacacaaagaagtaaagctgtgtcatacaggtggagaaggagatgacttgtccatgggagaacaggttggctaggagaaggggcacaatagtgaatgtatagcagatctccagaaaggagaggtgtttgagaaatatgtacataggcaagcggagtcgctggtcctggctcaccactgtaataatgacaacatttcctgttactgtgagaaagtagatgaacaagaagacggcaaagagtagtgtctgccattcaagaaggttctggaatcctaaaagctgaaactcagtgacactggacacatttagaggcttcat

SEQ ID NO: 2314 - protein, 323 aa, Felis catus
MKPLNVSSVTEFQLLGFQNLLEWQTLLFAVFLFIYFLTVTGNVVIITVVSQDQRLRLPMYIFLKHLSFLEICYTFTIVPLLLANLFSHGQVISFSTCMTQLYFFVFFGATECFLLAMMAYDRYLAIYSPLQYSSLMSPEICTKLVAISWLTGVGTGLLPSLMISKLDFCGPNQINHFFCDLPPLMQLSCSSVYITRMVIFILSIAVLCICFFLTLVSYVFIVSTILRIPSGSGWMKTFSTCGSHLAVVTIYYGTMISMYVRPNDHLSPEINKIISVFYTVVTPLLNPIIYSLRNQEFKEAVRKLMRKKCDIYGGKVKGSFFIR

SEQ ID NO: 2315 - DNA, 939 bp, Felis catus
atggatgggaccaatgacagcacccagggaaatttcatccttttggggttttctaaccatccccatctcgagaggatcctctttgtggtcatcttgattgcatacctcctgactcttatgggcaacaccaccatcatcctggtgtcccggctggacccccacctccacactcctatgtacttcttcctcacccacctatctttcctggacctcagtttcaccaccagctccattcctcagctgctctataacctgaatggccatgacaagaccatcagttacacaggctgtgccatccagctcttcctgtttctgggtctaggtggcgtggagtgcttgctcctggctgtcatggcatatgaccggtttgttgcagtctgcaaacccctgcactacctggtgatcatgaatccacgtctctgcatgggcttagtgttggtggcctggggctgtggtgtggctaactccttggtcatgtccccagtcaccctgcagttaccccgctgtgggcgccacagtgtggaccacttcctgtgtgagatgcctgccctgattcggatggcctgtgtcaatacagctgccattgaaggcactgtctttgtcctggcagtgggcattgtgctgtcacctctagtgtttatcctggtgtcctacggctacattgtaagggctgtgttacagattcaaccagtgtcagggagacaaaaggcgtttaacacctgtggctcccatctcacagtggtctcccttttctatggaaatatcatctacatgtacatgcaacctggaaacagctcttcccaggaccagagcaaattcctcaccctcttctacaacattgtcacaccactcctgaaccccctgatttacaccctccgaaacaaagaggtgaagggggcactgaggagaatgctgctggataacagaggggtaggaaag

SEQ ID NO: 2316 - protein, 313 aa, Felis catus
MDGTNDSTQGNFILLGFSNHPHLERILFVVILIAYLLTLMGNTTIILVSRLDPHLHTPMYFFLTHLSFLDLSFTTSSIPQLLYNLNGHDKTISYTGCAIQLFLFLGLGGVECLLLAVMAYDRFVAVCKPLHYLVIMNPRLCMGLVLVAWGCGVANSLVMSPVTLQLPRCGRHSVDHFLCEMPALIRMACVNTAAIEGTVFVLAVGIVLSPLVFILVSYGYIVRAVLQIQPVSGRQKAFNTCGSHLTVVSLFYGNIIYMYMQPGNSSSQDQSKFLTLFYNIVTPLLNPLIYTLRNKEVKGALRRMLLDNRGVGK

SEQ ID NO: 2317 - DNA, 906 bp, Felis catus
atggatggaacaaatgacagcactcagggaaatttcatccttttggggttttctgaccgtccccatctcgagaggatcctctttgtggtcatcttgattgcatacctcctgactcttatgggcaacaccaccatcatcctggtgtcccggctggacccccacctccacactcctatgtacttcttcctcacccacctatctttcctggacctcagtttcaccaccagctccattcctcagctgctctataacctgaatggccatgacaagaccatcagttacacaggctgtgccatccagctcttcctgtttctgggtctgggtggtgtggagtgcttgctcctggctgtcatggcatatgaccgatttattgcagtctgcaaacccctgcactacctggtgatcatgaatccgcatctctgcatgggcttagtgtcccttgcttggggctgtggtgtggccaactctttgattatgtctccaatgactctgtggctaccccgctgtggatattggaaagtagaccacttcctgtgtgagatgcctgccctgattcggatggcctgtgtcaatacagctgcaattgaaggcattgcctttatcctggcagtgggcattgttctgtcacctctggtgtttatcctgatatcctatggctacatcgtgagggctgtgttaagtatccagtcatcctcagggaggcacaaagtcttcaacacctgtggctcccatctcacagtggtctcccttttctatggaaacatcatctacatgtacatgcaaccaggaaccagctcctccaaggaccagggaaagtttctcactcttttctacaacattgtcacaccgctcctgaaccccatgatctataccttcagaaacaaagaggtgaaaggggcactgaga

SEQ ID NO: 2318 - protein, 302 aa, Felis catus
MDGTNDSTQGNFILLGFSDRPHLERILFVVILIAYLLTLMGNTTIILVSRLDPHLHTPMYFFLTHLSFLDLSFTTSSIPQLLYNLNGHDKTISYTGCAIQLFLFLGLGGVECLLLAVMAYDRFIAVCKPLHYLVIMNPHLCMGLVSLAWGCGVANSLIMSPMTLWLPRCGYWKVDHFLCEMPALIRMACVNTAAIEGIAFILAVGIVLSPLVFILISYGYIVRAVLSIQSSSGRHKVFNTCGSHLTVVSLFYGNIIYMYMQPGTSSSKDQGKFLTLFYNIVTPLLNPMIYTFRNKEVKGALR

SEQ ID NO: 2319 - DNA, 944 bp, Felis catus
atggaagatgcaaataacaccacagacacaaacttcattcttctgggactctttaaccacactcagacccatctgttcctcttttccatggtgctcatggtcttcctttcctccctgatgggcaatgccctcttgattgtgctcatctatgaggacccccgactgcacatgcccatgtacttcttgcttagccagctctccctcatggatgtgatgcttgtctccaccatagtccccaaaatggcagccaactacctaatggacaccagatccatctctcctgctggctgtggggcccagatattcctgtttctgactctgggagggggcgagtgcttcctcttagctgccatggcatatgaccgatatgtggccatatgtcaccccctgcgctaccccatcctcatgaatcagaagctctgcttgaacatgaccacaggctcctggcttctgggaggggtagatgggctgatgcaagctggcaccactctgagcttcccttactgccattctcgggaaatcaaccacttcttctgtgaggcaccctcgctggttcgccttgcatgtgcagacactacattttttgagtttttcatgtatgtgtgctgcatcctgatgctcttgatccctctgtctatcattttggcttcctacagtctcatcctggctgctgtgctcaacatgaggtccactgcagctcgaaagaaagcctttgccacctgctcctctcacctggctgtcgtggggctcttctatggcactctcatattcacctacatgcggcccaaatcctaccgtacagtggcccatgacaaggtggtctctgctttttacaccatctttacacctgtgttgaaccctcttatatatagtgtgaggaataaagaagtcaagggggctttgaaaaagtggctggagaaacattttctgggacatctatagtg

SEQ ID NO: 2320 - protein, 313 aa, Felis catus
MEDANNTTDTNFILLGLFNHTQTHLFLFSMVLMVFLSSLMGNALLIVLIYEDPRLHMPMYFLLSQLSLMDVMLVSTIVPKMAANYLMDTRSISPAGCGAQIFLFLTLGGGECFLLAAMAYDRYVAICHPLRYPILMNQKLCLNMTTGSWLLGGVDGLMQAGTTLSFPYCHSREINHFFCEAPSLVRLACADTTFFEFFMYVCCILMLLIPLSIILASYSLILAAVLNMRSTAARKKAFATCSSHLAVVGLFYGTLIFTYMRPKSYRTVAHDKVVSAFYTIFTPVLNPLIYSVRNKEVKGALKKWLEKHFLGHL

SEQ ID NO: 2321 - DNA, 939 bp, Felis catus
atgatgggacatgaaaatcacactttcaccagtgattttattcttttgggactcttctcttcttctcaatcaagtctagttttcttttcctttatattcatcatttttattatgactgtaacagaaaacacagtcataatcctccttatcctcagggactcaagactccacactccgatgtatttcctgctgagccatctctcttttatggacatcttgcatatttccaacattgttcccaaaatggtcactgactttctgtcaggcagcagaactatttcatttgtaggttgtggcttccaggtatttctatccctcactctcctgggtggtgagtgccttctcctggcagcaatgtcttatgatcgctatgtagccatctgtcatccattgcactatcccattcttatgaatgactatgtctgcattgtcatggctagagggtcctggcttattgggactgtcaactccatagtccacacagcttatgcactccactttcccttctgtgcctcaagagctattgatcactttttctgtgaagtccctgccatgttgaagttgtcctgtgtggacacaacactgtatgaacgaagaatttatgtaagtggcttaatttttctgcttgtccctttctccctaatcattgcttcttatgtccaaattctcattactgtatttcaaatgaaatcatcagaagcacggaaaaagtcattttctacctgttccttccacatgatggtggtcacaatgtattatgggccatttattttcacatacatgagacccaaatcataccacactccaggccaggacaagtctttggcaatattctataccatcctcacacctacattcaaccctataatctacagctttaggaataaagatgtccttgaggcaatgaaaaatatgctcaaaagtaactttctccattaa

SEQ ID NO: 2322 - protein, 312 aa, Felis catus
MMGHENHTFTSDFILLGLFSSSQSSLVFFSFIFIIFIMTVTENTVIILLILRDSRLHTPMYFLLSHLSFMDILHISNIVPKMVTDFLSGSRTISFVGCGFQVFLSLTLLGGECLLLAAMSYDRYVAICHPLHYPILMNDYVCIVMARGSWLIGTVNSIVHTAYALHFPFCASRAIDHFFCEVPAMLKLSCVDTTLYERRIYVSGLIFLLVPFSLIIASYVQILITVFQMKSSEARKKSFSTCSFHMMVVTMYYGPFIFTYMRPKSYHTPGQDKSLAIFYTILTPTFNPIIYSFRNKDVLEAMKNMLKSNFLH

SEQ ID NO: 2323 - DNA, 940 bp, Felis catus
atggaaaataataaccaaacatctactgattttttcttattgggattattcccaccatcagaaattggcctgttttccttcattttcattgttctcattttcttaatggctctttttggcaacatgtccatgatcatcgtcatcctcctggacactcatctccacacacccatgtattttctacttagtcagctctccctcatggacctgaactacatctccaccattgtccccaagatggcgtccaattatctctttggaaataagtcgatttctttcattgggtgtggagttcagagtttcttcttcattacattagctggtgcagaaggattactgttggcctgtatggcttatgatcgttatgtggccatttgctttcctcttcactatgtcattcatatgagaaaaagagtacttgtgttgatgattacaggatcttggataatgagctcgatcaactcctgtgcccacaatgtatatgccctccatatcccttattgtcgatccagaaccatcaatcatttcttctgtgatctcccggccatgttgacactggcctgcatggacacctgggtctatgaatacacggtgtttgtgagcaccacactcttccttgtgttacctttcattggcattgcatgttcctatggccgagttctcctcaccatctgccgcatgcactcaacagaagggaggaagaaggcctattccacctgtagcacacacctcactgtggtaactttctactatgcaccctttgcttacacttacctacgcccaagatcactgagaactccaacagaggacaaaattctggccgtcttctacacgatcctgaccccaatgctcaaccccatcatttacagcttgagaaacaaggaggtgatgggagccctgagaagagtgattcagaggatctgctgctctgtataagtgt

SEQ ID NO: 2324 - protein, 311 aa, Felis catus
MENNNQTSTDFFLLGLFPPSEIGLFSFIFIVLIFLMALFGNMSMIIVILLDTHLHTPMYFLLSQLSLMDLNYISTIVPKMASNYLFGNKSISFIGCGVQSFFFITLAGAEGLLLACMAYDRYVAICFPLHYVIHMRKRVLVLMITGSWIMSSINSCAHNVYALHIPYCRSRTINHFFCDLPAMLTLACMDTWVYEYTVFVSTTLFLVLPFIGIACSYGRVLLTICRMHSTEGRKKAYSTCSTHLTVVTFYYAPFAYTYLRPRSLRTPTEDKILAVFYTILTPMLNPIIYSLRNKEVMGALRRVIQRICCSV

SEQ ID NO: 2325 - DNA, 939 bp, Felis catus
atggaaaattatactcaaaaatcaactgatttcattttattggggttgtttccaccatcaagaataggcctgctcctttttattctcattgtcctcatttttctaatggctctgtttggcaacctgtccatgattctactcatcttcctagacacccatctacacacacccatgtatttcttacttagtcagctctccctcattgacctaaattacatctccactattgttcccaagatggcttccaattttgtgtttggaaacaagtctatctccttcattgggtgtggttttcagagcttctttttcttgactttaggaggggcagaagcattgctcttgacatctatggcttatgatcgttatgtggctatttgctttcctcttcactatcccattcgtatgagcaaaaaagtgtgtgtgttgatgataacaggatcttggataatgggctcaatcaactcctgtgcccacactgtatatgccctccatatcccttattgtcgatccaggtccatcaaccatttcttctgtgatgtcccagccatgttgactctggcttgcatggacacttgggtctatgagtacacagtgtttgtgagtaccaccctctttcttgtgtttcctttcattggcattgcatgttcctatggccgagttctccttgccatctgccgcatgcactcaacagaagggaggaagagggcctattcgacctgcagcacacacctcacagtggtaactttatactatgtaccttttgcttacacttacctacgcccaagatcgctgagatctccagcagaggacaaggttctggctgtcttctacaccattctgaccccaatgctcaaccctatcatttacagcctgcgaaacaaggaggtgatgggagccctgagaagaatgattcagagaatctgctttttgaaaatgtag

SEQ ID NO: 2326 - protein, 312 aa, Felis catus
MENYTQKSTDFILLGLFPPSRIGLLLFILIVLIFLMALFGNLSMILLIFLDTHLHTPMYFLLSQLSLIDLNYISTIVPKMASNFVFGNKSISFIGCGFQSFFFLTLGGAEALLLTSMAYDRYVAICFPLHYPIRMSKKVCVLMITGSWIMGSINSCAHTVYALHIPYCRSRSINHFFCDVPAMLTLACMDTWVYEYTVFVSTTLFLVFPFIGIACSYGRVLLAICRMHSTEGRKRAYSTCSTHLTVVTLYYVPFAYTYLRPRSLRSPAEDKVLAVFYTILTPMLNPIIYSLRNKEVMGALRRMIQRICFLKM

SEQ ID NO: 2327 - DNA, 924 bp, Felis catus
atggaaaataacagccaaacattaacaggcttccttttattggggtttttcccccatcaagaattgggttgtttcttttcattctcattattgtcattttcctaatggctttttttggcaacatgtccatgattctcctcatcctcctggacacccatctccacacatccatgtattttctacttagtcacctctccctcatggacttgaacttcatctccaccatcattccccagatggcatccaattatgtctttggaaacaagtctatctccttcattgggtgtgggatacagagcttctttttgactttagcagatgcagatgggttactattggcctccatgtcccatgatcgctatgtgactatttgctttcctcttcattatcccattcgtatgagcaaaaaagtgtgtgtgttgataataacaggatcttggataatgggctcaatcaactcctgtgcccacactgtatatgccctccatatcccttatggttgatccgggttcatcaaccatttcttctgtgatgtcctagccatgttgactctggcttgcatggacacctatgatctatgagtacacagtgtttgtgagcaccacactcttgattgcatttctcttcatcggcattgcatgttcctgtggccgagttctccatgctatctgccacatgcactcaacagaaggaaggaagaagccctattcaacctgcagcacacacctcattgtggtgactttctactctgcaccctttgcttacatttacctatgcccaagatcgctgagatctcccacagaagccaaggttctggttgtcttctacattattctgaccccaatgctcgaccccatcatttatatcctgagaaacaaggaggtgatgggagccttgagaagagtgattcagaggatctgctct

SEQ ID NO: 2328 - protein, 118 aa, Felis catus
MIYEYTVFVSTTLLIAFLFIGIACSCGRVLHAICHMHSTEGRKKPYSTCSTHLIVVTFYSAPFAYIYLCPRSLRSPTEAKVLVVFYIILTPMLDPIIYILRNKEVMGALRRVIQRICS

SEQ ID NO: 2329 - DNA, 914 bp, Felis catus
atggccaatgtcactttagtgacaggatttcttcttgtggagttttctgacatccaagagcttcagatattatatggtgtgctcttcctactgatttatctggctgtcctgatgagtaaccttctcatcatcactctcattaccctagaccagcatctacagacaccgatgtactttttcctgaagaatttgtcattcctggatgtcttccttgtgtctgtcccaatccccaaattgattgtcaacagcctaacatacagcaattccatctccattttagggtgtgccttccagctacttttcatgacttccttctcagcaagtgagatatttgtccttactgccatgtcctatgaccgctatgtagccatatgctgtcctctgcagtacgaagtcatcatgaacgctggtgcctgtacactgatggcaggtgtttcctgggccattggaggactctttggaactgtgtatactgctggcacatttttcatgccattctgtggctccaatgtgattccacagtttttctgtgatgtttcctcattgctaagtatctcctgttctgaaacactcctagtggtgtatacaagtattgggataggtatgtgtttaggcatatcttgtttcatctgtattgtgatctcctatgcttacattttctccactgtgctgaagattcctaccacaaaaggtcagtcaaaagctttctccacatgctttccccatcttgttgtttttactctttttattataactgcctgttttgtttatctgaaagcaacctcaaatacacccctagttattgacaggttgctttctgtggtttacaccgtgatacctccaatactcaaccctgtaatctacagcctgaggaacaaggacatgaaatgggctcttacgagattgctgcagaa

SEQ ID NO: 2330 - protein, 305 aa, Felis catus
  MOD_RES (305)..(305): Any amino acid
MANVTLVTGFLLVEFSDIQELQILYGVLFLLIYLAVLMSNLLIITLITLDQHLQTPMYFFLKNLSFLDVFLVSVPIPKLIVNSLTYSNSISILGCAFQLLFMTSFSASEIFVLTAMSYDRYVAICCPLQYEVIMNAGACTLMAGVSWAIGGLFGTVYTAGTFFMPFCGSNVIPQFFCDVSSLLSISCSETLLVVYTSIGIGMCLGISCFICIVISYAYIFSTVLKIPTTKGQSKAFSTCFPHLVVFTLFIITACFVYLKATSNTPLVIDRLLSVVYTVIPPILNPVIYSLRNKDMKWALTRLLQX

SEQ ID NO: 2331 - DNA, 927 bp, Felis catus
atgggcacagacaatgcaactcactcccaggatttcctcttgctgggctttcctgggtcccagggccttcagctatctctccttatgctttttctggtgatgtacatcctcacagtgagtggtaacatggctatcttgatgttggtgagtacctcccaccagctacatacccctatgtacttctttctgagcaacctctctttcttggagatttggtataccacagctgcagtccccaaagtcctggccatccttctggggagaagccaaaccatatcatttactggatgtcttttgcagatgtactttgttttttcattgggctgcacagagtactttctcctggcagccatggcttatgaccgctatttggccatctgctatcctctacactatggggccattatgagcagtctgctctcagcactgctagccctgggatcctgggtgtgcggtttcctagccattgcagtgcccacagccctcattagcaccctgccgttctgtggtccccacactatcaaccacttcttctgtgacattgcaccctggattaccctggcttgcaccagcacgcaggcagtggaactcgtggcctttgtgattgcttttgtggtcatcctgagctcgtgcctcatcactctggtctcttatgtgtatatcatcagcaccattctcaggatcccttcagccagtggcaggagtaaagccttctccacatgctctttgcatatcactgtggtgctagtctggtacgggtccacgatctttcttcatgtccgcatctccatcaaagaggccttggatctgaccaaagtcgtgcatgtcctgaacaccattgtgactccagttctaaaccccttcatctacactctccgtaacaaggaagtaagagaaactctgctgaagaaatggaagggaaaataa

SEQ ID NO: 2332 - protein, 308 aa, Felis catus
MGTDNATHSQDFLLLGFPGSQGLQLSLLMLFLVMYILTVSGNMAILMLVSTSHQLHTPMYFFLSNLSFLEIWYTTAAVPKVLAILLGRSQTISFTGCLLQMYFVFSLGCTEYFLLAAMAYDRYLAICYPLHYGAIMSSLLSALLALGSWVCGFLAIAVPTALISTLPFCGPHTINHFFCDIAPWITLACTSTQAVELVAFVIAFVVILSSCLITLVSYVYIISTILRIPSASGRSKAFSTCSLHITVVLVWYGSTIFLHVRISIKEALDLTKVVHVLNTIVTPVLNPFIYTLRNKEVRETLLKKWKGK

SEQ ID NO: 2333 - DNA, 924 bp, Felis catus
atgaataacagcattgtaactgagtttatgattctgggacttacccaaaatcctgaactgcagggagttctcttcattgtctttctctgcatctaccttgtggccttttttggcaatggcctaattatcattgttataatctataataccaccttgcatacgcccatgtatgtgttcctcctggcactagctattgtggatatcatctgtacaacaagcattataccaaagatgctggggaccatgctaacatcaggaaagagtatttcatatggaagctgcatgtcccagctcttcttcttcacgtggtcattgggggctgagatggtactcttcaccacaatggcctatgaccgttatgtggccatctgttttcctcttcgctacagcactattatgaaccaccatatgtgtgtggccttgcttagcattgccatggttattgcagtaaccaattcctgggtacacacaggtctcatcctgaacctgactttctgtgggccaaataacattgaccacttcttctgtgagatacccccactgctctctttgtcctgcagtcctgtgagaattaatgaggtgatggtatatgttgctgatatttccctggccataggtgacttcagcctcacctgcctgtcttatggttttatcattgctgccattctccgcatccgcacagcagaaggcaagaggaaggctttttcaacatgttcatcccacctcatagttgtgtccctttactactgccctgtaatctacacatatatccgccctgcttccagctactcatttgaaagggacaaggtgatagctgcactatatactcttgtgaccccaacattaaacccaattgtgtatagtttacgaaacaaggagatgcagacagggattcagaaagtctttgcatttttgaaacattag

SEQ ID NO: 2334 - protein, 307 aa, Felis catus
MNNSIVTEFMILGLTQNPELQGVLFIVFLCIYLVAFFGNGLIIIVIIYNTTLHTPMYVFLLALAIVDIICTTSIIPKMLGTMLTSGKSISYGSCMSQLFFFTWSLGAEMVLFTTMAYDRYVAICFPLRYSTIMNHHMCVALLSIAMVIAVTNSWVHTGLILNLTFCGPNNIDHFFCEIPPLLSLSCSPVRINEVMVYVADISLAIGDFSLTCLSYGFIIAAILRIRTAEGKRKAFSTCSSHLIVVSLYYCPVIYTYIRPASSYSFERDKVIAALYTLVTPTLNPIVYSLRNKEMQTGIQKVFAFLKH

SEQ ID NO: 2335 - DNA, 873 bp, Felis catus
agtatagataataggatttaaggttggggtcaccatggtgtagaagagggagataaacttgccttggtcctgagcataactgttacctggttgtaggtacatgtagattatggtgccatagaaaatgatcaccactgtaaggtgggaggaacaggtgctgaaggctttgtgtcttgcctctgctgattttatcctcagcacagcttgacttatgaagccataggagataagaatgagtgctgggggaattaggagaaacaggatactaaccacaaaaagcaccaactcattgacagtggtgtccacacaagccaatttgaggagagctggtacttcacaaataaaatgattgagtctatggttgccacagagaggcaattgcaaggtaaaagtagcatggatcagggaattgctcaaaccactgagccaggagagggatgccagctgttggcatagctgtggattcatgatagccacatagtggaggggtttgcagacagcaatgtagcgatccaaagccattacagccaagaggatacactcagtggaacccagcgctagagaaatatagagttgtaccacacaaccaccataggtgatagtcttctctggacctctcaggttgactaaagtctgaggtgcaaggctggtagtgaagcagaggtccagtagggagaggttgctgaggaagaagtacatgggggtgtggaggagaggatccacgtatgatataatgatgatggcaaagttccccacaagcgtcaggatatagaaaaaaaggactaatacaaagagtgcagactccaggcgagggttgtctgagaagcctagaaggatgaaactcatcagggaactttcattggccctttccat

SEQ ID NO: 2336 - protein, 291 aa, Felis catus
MERANESSLMSFILLGFSDNPRLESALFVLVLFFYILTLVGNFAIIIISYVDPLLHTPMYFFLSNLSLLDLCFTTSLAPQTLVNLRGPEKTITYGGCVVQLYISLALGSTECILLAVMALDRYIAVCKPLHYVAIMNPQLCQQLASLSWLSGLSNSLIHATFTLQLPLCGNHRLNHFICEVPALLKLACVDTTVNELVLFVVSILFLLIPPALILISYGFISQAVLRIKSAEARHKAFSTCSSHLTVVIIFYGTIIYMYLQPGNSYAQDQGKFISLFYTMVTPTLNPIIYT

SEQ ID NO: 2337 - DNA, 962 bp, Felis catus
tgatgatgggaatagccaatgcaagttctccagaagtctttgtactcctgggcttctctgcacgaccctcactggaacctatcctcttcatcattgccttagggttttatgtggtgtctgtcttggacaatggcatcatcattctggtttcctgcatggatgtgcacctccacactcctatgtatttcttccttgccaatctctccttcctggacattagctttaccacaagcattgtcccacaactcctggtcaacctctggggaccacagaaaaccataagctctgtagggtgtatggtccagttctacatctctcactggctgggggccaccgaatgtgtccttctggcagtcatgtcctatgatcgctatgccgccatttgtaggccactacattatactgtcatcatgcatccacagctttgtctcagcttggcctttgcttcctggcttgggggtctgactacaagcatagtgggctccacactcactatgcttctgccactgtgtggaaacaatcgcattgaccacttcttctgtgagatgcccctcattatgcaactggcttgtgtggataccagcctcaatgaggtggagatgtatgtggccagctttatctttgttgtcttgcctctgggtctcatcctggtttcatatggccacattgcctgggctgtaatgaagatcaggtcagcagaaggacggagaaaggccttcaacacctgctcttcccatgtggcagttgtgactctattttatgggagcatcatctttatgtatctccagccagccaagagtaactctcatgaacagggtaaattcatagccctcttctatactgttgtcaccccgatgctgaaccccctgatttacacactcaggaacaaagatgtgaagaaggctctcaggcacattgcatcagagaattgctgtggctttgcaggatcattgggacatatt

SEQ ID NO: 2338 - protein, 320 aa, Felis catus
MMGIANASSPEVFVLLGFSARPSLEPILFIIALGFYVVSVLDNGIIILVSCMDVHLHTPMYFFLANLSFLDISFTTSIVPQLLVNLWGPQKTISSVGCMVQFYISHWLGATECVLLAVMSYDRYAAICRPLHYTVIMHPQLCLSLAFASWLGGLTTSIVGSTLTMLLPLCGNNRIDHFFCEMPLIMQLACVDTSLNEVEMYVASFIFVVLPLGLILVSYGHIAWAVMKIRSAEGRRKAFNTCSSHVAVVTLFYGSIIFMYLQPAKSNSHEQGKFIALFYTVVTPMLNPLIYTLRNKDVKKALRHIASENCCGFAGSLGHI

SEQ ID NO: 2339 - DNA, 945 bp, Felis catus
ttaggtttccctgtcctccttctctcccttcaggagctttctcattgctccctttacatctttgttcctcagagtatagataagggggttgacactgggagtgacgatggtgtagaagagggtgaggaacttgccttggtcttgggagtagctattggctggctgcaggtacatgtagatgatggttccatagaaaagagagaccaccgttaggtgagaagagcaggtgttgaaagctttcttgcaccctgctgctgatttgatcctaagcacagtggcagaaatcatgccataggagatgaggatcagggagaggggcaccaggagaagggcaacacccaggacaaaggcaaatgcttccaccaacatggtgtcttcacaagacatggcaataagagcaggcatctcacacagaaagtggtccactttgtggcgcccacatcgggagagttgcattgtctggggacacatgacaaaggaatttagaaagccacagaaccaggacacaatcaccaattgcaggcagagatgtgggtgcatgaccacagtgtagtgcaggggccggcagacggccacgtagcggtcataagacatgacagccaggagaacacactcggttgagcccaacaccatgtagatatagagctgggccacacagccttggtaggtgatggtcttctctggaccccaaaggttccacagcagctggggagcaatgctggttgtaaagcagaggtccaagaaagaaaggttcccaagaaagaagtacatgggagtgtggagcctggtgtccatgactgataagaaaatgatggcactattgcccacaagggccaggatgtagaagaccaagacaaaagcaaagagaattacctccagttgaggtcgatcagaaaagcccaccaagatgaatgcttgttggtaactgtcattgtctcttcccat

SEQ ID NO: 2340 - protein, 314 aa, Felis catus
MGRDNDSYQQAFILVGFSDRPQLEVILFAFVLVFYILALVGNSAIIFLSVMDTRLHTPMYFFLGNLSFLDLCFTTSIAPQLLWNLWGPEKTITYQGCVAQLYIYMVLGSTECVLLAVMSYDRYVAVCRPLHYTVVMHPHLCLQLVIVSWFCGFLNSFVMCPQTMQLSRCGRHKVDHFLCEMPALIAMSCEDTMLVEAFAFVLGVALLLVPLSLILISYGMISATVLRIKSAAGCKKAFNTCSSHLTVVSLFYGTIIYMYLQPANSYSQDQGKFLTLFYTIVTPSVNPLIYTLRNKDVKGAMRKLLKGEKEDRET

SEQ ID NO: 2341 - DNA, 962 bp, Felis catus
tcagagcctaatctgcagagcctccagatccttgacaggagctttcttagggctccctttacatccttgttcctcagagtgtagataaaaggattgagggtgggggtgattatggaatagaagagggagataaacttgccctgttcttgggagtagctggaagagggttgcaggtacatgtagatggctggcaggtagaagagggacaccaccaccaggtgggaggaacaggtcccaaaggctttgtgccttcccctggaggattggatcctgagcactgttcgggcaatgaagccataggagaaaaggatgagagctaggggaaccagcacaaagaaggctaccagcacagccagtgtggtatcattcatggctgtgtcagcacatgacaacttaatcatggctggcacctcacagaagaagttgttcagcacctgccgcccacagaaaggcagctgcactgtcagcactacctgaacaagggagttgccaaagccactgagccaggccacagccacgagctgttgacagagaggatgatgcatgataacggcataccggagaggctcacagatggccacatagcggtccagcgccatagcagccaagacaatgcactcagtgcatcccaaccagtggaaaattgcatactgcattgtgcagccaccatagctgatggtcttactggagctccccatgttgaccagcatctgagggactgtggtggtggtatagcagaggtcgaggaaggataggtgcccgagaaagatgtacatggggctgtggagctgagaatccagtcgagacaccaggatgatagcaatgttccccaacatggccagaatgtaggacaccaggaggaccacaaaaagagggagctccagccatggcctgtcagaaacacctagaaggatgaagtctttagggggttcccgcagaatgctgtggttatgacctctcat

SEQ ID NO: 2342 - protein, 321 aa, Felis catus
  MOD_RES (321)..(321): Any amino acid
MRGHNHSILREPPKDFILLGVSDRPWLELPLFVVLLVSYILAMLGNIAIILVSRLDSQLHSPMYIFLGHLSFLDLCYTTTTVPQMLVNMGSSSKTISYGGCTMQYAIFHWLGCTECIVLAAMALDRYVAICEPLRYAVIMHHPLCQQLVAVAWLSGFGNSLVQVVLTVQLPFCGRQVLNNFFCEVPAMIKLSCADTAMNDTTLAVLVAFFVLVPLALILFSYGFIARTVLRIQSSRGRHKAFGTCSSHLVVVSLFYLPAIYMYLQPSSSYSQEQGKFISLFYSIITPTLNPFIYTLRNKDVKGALRKLLSRIWRLCRLGSX

SEQ ID NO: 2343 - DNA, 873 bp, Felis catus
atgaccctatttatggcggtttctgtcttttacacagtcacactagtgggcaacaccaccatcatactcctgtctcacctggacccccacctccacacccccatgtacttcttcctcacccacctctccatcctggacctctgctttaccaccagctgcatccctcagatgctcgtgaatttctggagttcggacaagaccatcagctatttggggtgtgcagtccagctctacatcttcctgggactcggagcttcagaatgtgttctgctgctggtcatggccttcgaccgctatgtggcagtgtgccggcccctgcactatgcagtaatcatgcacccacccctgtgtcacaagttggctttcctggtctgggcaagtggggtttttggcacattggtgcagtctcccactaccatgaaactccccttttgccatcaccaccaggttgatgactttgtctgtgaggtccctgcactgatccgcctggcttgtggagacacacatgtcaatgagcttcagatctcagtgattggtgccatcttcctgctggggcccctgctgctcatccttgtctcctatggccgtattacccaggcagtgctggccatccagtcccagaatggaaggattaaggccttccatacctgctcctcccacctggctgttgtttttctcttctactgcagtgtcaccgctgtctatatccaaccctgtagtcatttttcccagaaaggagggaaatttctaactctcttctacactgtggtgacccccactctcaaccccctcatctatactttaaggaacaaggacatgaagcaagctttcaggagactcctagggaaaggcagaatgtccagtgaagagtga

SEQ ID NO: 2344 - protein, 290 aa, Felis catus
MTLFMAVSVFYTVTLVGNTTIILLSHLDPHLHTPMYFFLTHLSILDLCFTTSCIPQMLVNFWSSDKTISYLGCAVQLYIFLGLGASECVLLLVMAFDRYVAVCRPLHYAVIMHPPLCHKLAFLVWASGVFGTLVQSPTTMKLPFCHHHQVDDFVCEVPALIRLACGDTHVNELQISVIGAIFLLGPLLLILVSYGRITQAVLAIQSQNGRIKAFHTCSSHLAVVFLFYCSVTAVYIQPCSHFSQKGGKFLTLFYTVVTPTLNPLIYTLRNKDMKQAFRRLLGKGRMSSEE

SEQ ID NO: 2345 - DNA, 943 bp, Felis catus
tcagtgctggctgccaatcctgcaatggttcagacctttcctcagggcctccatcacgtcccgattcctcaaactataaatgagggggttgagcataggcgtaaggaccatgtagatgatagagacaaccttgtcatgactaggggcctggtagcgccgaggcctcaggtagatgaacatggctgccctgtagaagaggaagacagctgctaggtgggaggaacaggtggccagggcctttttacaggcctgagcagagtgcatgtggagcacagccctcaggctgtgagcataggaggccactatgatggaaaagggaaggagcagcatgaagacacagaagcaaagagcagagtgtcaaaaagggttgtgtccatacaggccagttttaataaagctggtacctcacagaagtaatccacattccttgagccacagtaaggtaagctcatggctgccaccatctggataattccatctagtatcccaaaggcccaggaactcccagaaatctggagacagactctgactcatgaggacagtatagtgaagggagtggctgattgccacataacaatcataggccatgagtcccagaaaaattccctcagatcccacaagagagacaaaaaaaccaatttgtatgccacaacccacaaaggagatggacttcctgccagagagaaaagttgaccgccatctttggcatgatattacagatcaaaataagatccataagggagagctgactgagaaagaagtacatgggtgtgtgaagccaaggatctgtgtagatgaggaagatgaagaggacattcccacagagggccacagtgaagactaccataaccacagagaagaggacaacaccagtctggctatgggaaaagatgcccaagaggatgaagccatctatagatgatcgattcaaccatatccccat

SEQ ID NO: 2346 - protein, 111 aa, Felis catus
MGIWLNRSSIDGFILLGIFSHSQTGVVLFSVVMVVFTVALCGNVLFIFLIYTDPWLHTPMYFFLSQLSLMDLILICNIMPKMAVNFSLWQEVHLLCGLWHTNWFFCLSCGI

SEQ ID NO: 2347 - DNA, 948 bp, Felis catus
atggagatatggttgaatcaatcatccacagacgacttcatcctcttgggcattttttctcacagtccaactgaccttgtcctcttctctgttgttatggtggtcttcacagtggccctctgtggtaatgtcctcctcctcttcctcatctatggagatcctcaacttcacacacccatgtacttcttcctcagtcagctctccctcatggacctcatattggtctgtaccaatgtgccgaagatggtggtcaatttcctgactggcaggaagtccatctcctttgtgggttgtggcatacaaattggcctctttgtgtgtcttgtgggatctgaagggttcttgctgggattcatggcttatgaccgctatgtagccattagccacccacttcactatcctgtcctcatgagtcagagggtctgtcttcaaattgttgggagctcctgggcctttggaataatagatggtgtgatacagatggtggtagtaatgactttcccatactgtggcttgagagaagtgaaccacttcttttgtgagatgctttccttgttgaaactagcctgtatagacacatccatttttgagaacgtgatatatgcttgctgtgtcttcatgctgtttcttcccttctcaatcaccatggcctcctatgctttcatcctgagggctgtgctcctcatgcgctctgctcaggcaggcaagaaggctctggccacctgttcctctcacctaacagctgtctccctcttctacggggcagccatgttcatctacctgaggcctcggcgctaccgggtgcctagtcatgacaaggtggtctctattttctacacagtccttactcctatgctcaaccccctcatttatagcttgagaaaccgcgatgtgatgagggccctaaggaaggggctggaccattgcaggattagcagccagcactga

SEQ ID NO: 2348 - protein, 315 aa, Felis catus
MEIWLNQSSTDDFILLGIFSHSPTDLVLFSVVMVVFTVALCGNVLLLFLIYGDPQLHTPMYFFLSQLSLMDLILVCTNVPKMVVNFLTGRKSISFVGCGIQIGLFVCLVGSEGFLLGFMAYDRYVAISHPLHYPVLMSQRVCLQIVGSSWAFGIIDGVIQMVVVMTFPYCGLREVNHFFCEMLSLLKLACIDTSIFENVIYACCVFMLFLPFSITMASYAFILRAVLLMRSAQAGKKALATCSSHLTAVSLFYGAAMFIYLRPRRYRVPSHDKVVSIFYTVLTPMLNPLIYSLRNRDVMRALRKGLDHCRISSQH

SEQ ID NO: 2349 - DNA, 933 bp, Felis catus
ctatacctgctctgtccccatcaagctcctgactgctttcttcacatccttattcctcagtgtgtagaccagagggttgagtgtgggcgcaagaatcatgtaaagcactgccagtgctttgctctggtcctgggagtagttgtccttgggctgcagatacaaaaacataatggtcccatagaagagtgagactaccattaggtgggaggcacaggtcccaaaggcctttttccttccctctgctgagcgcatttttactactgccctggcgatgcacacgtaagtggtcaggatgatggagacaggcatgcctaggatgattagccgggcaataaacattttagattctgtcgggccagtatcaacgcaggagagtttaacaatgatcaatagttcacagaagaaatggtccacacgccggtttccacatagaggcagcaccatggccattgaggactggagaaaggagttagcaaaaccagaggaccaggaagctgctgccaggaggtggcacagcctggggtgcatgatggaggtatagtgtagaggccagcaaactgcaacatagcgatcaactgccatcaccgcaaggagcacacactctgtggagccaagtgccaaggccacccagtactggaccatgcagccagcatagctgatctttttgttacctccccacatgttcaccagcatctggggcacaatgctggtggtgaagcagaggtcaagcacagagaggtttctgaggaagaagtacatgggtgtatgaagtccagcatccaggatagaaagtaggattatggccacgttgcccacaagagttatggtgtagaacatcaggacaaagaaagagaggatcagctctaacttgggccactcagagaagcccactaagatgaaatccccacctgtgctctcattagctgtttccat

SEQ ID NO: 2350 - protein, 310 aa, Felis catus
METANESTGGDFILVGFSEWPKLELILSFFVLMFYTITLVGNVAIILLSILDAGLHTPMYFFLRNLSVLDLCFTTSIVPQMLVNMWGGNKKISYAGCMVQYWVALALGSTECVLLAVMAVDRYVAVCWPLHYTSIMHPRLCHLLAAASWSSGFANSFLQSSMAMVLPLCGNRRVDHFFCELLIIVKLSCVDTGPTESKMFIARLIILGMPVSIILTTYVCIARAVVKMRSAEGRKKAFGTCASHLMVVSLFYGTIMFLYLQPKDNYSQDQSKALAVLYMILAPTLNPLVYTLRNKDVKKAVRSLMGTEQV

SEQ ID NO: 2351 - DNA, 925 bp, Felis catus
ttctagaatttgagatcagtttccttaaggctcccttcatatcacgatttctcagactgtagatgaagggattgaccaggggagtcaccactgtgaagatgacagtggccaccgtgtcttggactgagtaggaggatgaagggcgcatatagacccccaggattgccccatagaagagggacaccacagtgagatgggatccacatgtggacagggatttccttattccatgggcagatggcaacttcagtacattagagaggatatacgcatatgaaatgatgatacatgtaaatggtgtcagaaatatcagtccacccacagtgaataccatcaggtcattgataaaagtatcagaacaagacagctttagaactgcataggggtcacagaaaaagtgatgcacagtattgttgaaacaaaaggtgagtcggaccatgagaagagtgtgtaggagagcatgcaggtttgtaatgacccaagagaccaccaccagaaggatacagagtttgggcttcatgatcatgctgtagtggagtgggcaacagatggctacataacggtcataggccatcacactcagaaggaacccatccatgttgatgaaagtgatgaagaagtagatctgggtcatgcattccacataagagataaacttgcttcccagtatgtgattcagcagcatcttgggggttgtgactgatgaaaagcagatgtcgatgcaggagaggttagccaagaagaagtacatgggggtatggagatgactgtcacagctgatggccaggatgatgagaatgttcccaatgatggtgaccaggtacatccacaagaacagcccaaagagaatctcttcctgctttgactgcccagagagtcccaggagaaggaattctgtgaccgtagtctggttgtctctatccat

SEQ ID NO: 2352 - protein, 309 aa, Felis catus
  MOD_RES (309)..(309): Any amino acid
MDRDNQTTVTEFLLLGLSGQSKQEEILFGLFLWMYLVTIIGNILIILAISCDSHLHTPMYFFLANLSCIDICFSSVTTPKMLLNHILGSKFISYVECMTQIYFFITFINMDGFLLSVMAYDRYVAICCPLHYSMIMKPKLCILLVVVSWVITNLHALLHTLLMVRLTFCFNNTVHHFFCDPYAVLKLSCSDTFINDLMVFTVGGLIFLTPFTCIIISYAYILSNVLKLPSAHGIRKSLSTCGSHLTVVSLFYGAILGVYMRPSSSYSVQDTVATVIFTVVTPLVNPFIYSLRNRDMKGALRKLISNSRX

SEQ ID NO: 2353 - DNA, 942 bp, Felis catus
atgtccagggggaaggagaatgggacaggagtcaccgagttcctcctgcttggcctcactggtgacccagagcagcagcgaatcctcttctggctcttcctgtgtacatacttggtcactgtggctgggaacacactcatcatcctggccatcggctctgacccccgcctgcacacccccatgtacttcttccttaccaatctctcctttgttgacatctgcttcaccaccaacctgatccccaagctgttggtcaaccacatagcaggaacatggacaatctcttacccccattgcctgacccagatgtacttcctcatctcctttgccaacctggacacctttctgctggctgccatggccctggaccgttacgtggccatctgcaagcccctgcagtactacgccatcatcaccccccagctctgtcggggattgaccacactcgtgtggacatgctctggcctcatctccctagtccacacgctcctcatgaacagactgacattctgctcctgtgcccgcgagatctcacacttctactgcgatgcctacctgctgatgaagatcgcctgctcggacacgcgtgtcaatcagcacgtgttcctaggtgctgtggtcctgtttgtggccccctctgcactcattgtggtctcctacatgtgcatagttgcagctgtcctccggattccctccaccccaggaaggcgcaaggcattttccacatgcagctcccatctgtctgtggtcatcgtgttctatggaactatcctgggggtatatattcgaccccccaactccttctcagctcaggacacggtagcaaccatcatgtacacagtggtgacccccatgctaaacccctttatctacagcctgaggaaccaagacatgaagaaggctatgggaagtctcttcagcaggagctcaaaatcttcttag

SEQ ID NO: 2354 - protein, 313 aa, Felis catus
MSRGKENGTGVTEFLLLGLTGDPEQQRILFWLFLCTYLVTVAGNTLIILAIGSDPRLHTPMYFFLTNLSFVDICFTTNLIPKLLVNHIAGTWTISYPHCLTQMYFLISFANLDTFLLAAMALDRYVAICKPLQYYAIITPQLCRGLTTLVWTCSGLISLVHTLLMNRLTFCSCAREISHFYCDAYLLMKIACSDTRVNQHVFLGAVVLFVAPSALIVVSYMCIVAAVLRIPSTPGRRKAFSTCSSHLSVVIVFYGTILGVYIRPPNSFSAQDTVATIMYTVVTPMLNPFIYSLRNQDMKKAMGSLFSRSSKSS

SEQ ID NO: 2355 - DNA, 918 bp, Felis catus
tggaacaagaaaaccaaacccgaatttctgaatttagtcccctcctgggactgtcagacgagcggggactgcagtcactgcgcttttggccgttcctgtccatgtacctggtcactttcactgggaacctgctcatgatcctggccattatcacagactcccgcctccacacgcccatgtacttcttcctctccaacctgtccttttcagacatctgtttcacctccaccaccgtcccaaagatgctgctgaacatccagacgcagagcaaagtgatcacctatgaaggctttctcagccagatgtactttttcatggtttttgcaggattagacaccttcctcttgacagtgatggcctatgaccggtttgtggccatctgtcagccactgcactacatggtcatcatgaaccccaagttctgtggcatcctactcctgggatcctaaggtgttgagtgttctcgactctctattacatgacttattgattttgcgactctccttttgcacagagctggaaatccttcactttttctgtgaacttaagcagatgatccaacttgcttgctctgatacgttcctcaatgtcctggtgacctatctcacaagtggacttctgagtgttgttccaatcgctggtatcctgtattcttactctaagattgtagtctccgttttgagaatttcatcaacgagtggcaagtagaaagcattttccacgtgtgggtctcacctctcagtggtctctttgttctatgctacaggccttggggtgtatctgagttctgctgctgcacaaaactccaggacaagtgccatagcctcagtcatgtgcacggtggtgacgcccatgctgaaccccttcatctatggcctgaggaacagagacatcaaacaagccctgagaaagctcttt

SEQ ID NO: 2356 - protein, 148 aa, Felis catus
EQENQTRISEFSPLLGLSDERGLQSLRFWPFLSMYLVTFTGNLLMILAIITDSRLHTPMYFFLSNLSFSDICFTSTTVPKMLLNIQTQSKVITYEGFLSQMYFFMVFAGLDTFLLTVMAYDRFVAICQPLHYMVIMNPKFCGILLLGS

SEQ ID NO: 2357 - DNA, 918 bp, Felis catus
atggaaggaagaaatcaaactcatgttacagaatttatcctcctgggactctccaaccagggggaacagcagtctctgctcttttgggtgttcctgtccatgtacctggtcaccttcactgggaacctgctcatgatcctgaccattatcacagacccccgcctccacacgcccatgtacttcttcctctccaacctctccttttcagacatctgtttcacctccaccaccgtcccaaagatgctgctgaacatccagacgcagagcaaagtgatcacctatgaaggctgtctcagccagatgtactttttcatggtttttgcaggattagacaccttcctcttgacagtgatggcctatgaccggtttgtggccatctgtcggccactgcactacatggtcatcatgaaccccaagttctgtggcatcctgctcctggtatgctggttattgagtatttttaactctctattacatgacttgctgattttgcaactctctttttgcacagatctggaaatctatcactttttctgtgaagttaagcaggtgatccaacttgcttgctctgataccttcctcaatgacctaggaacatatctggcgagtggatttctgggtggttttccactcactgtcatcctctcctcctactctagaattgtcacttccattttgagaatttcatcagtgaggggcaagtataaagcattttccacgtgtgggtctcatctctcagtggtctctttgttctatggtacaagccttggggtgtatctgagttctgctgctgcacaaaactccagggaaagtaccatagcctcagtcatgtacacagtggtgacgcccatgttgaaccccttcatctatggtctgaggaacagagacatcaagcaaggtctgagaaagctctttagc

SEQ ID NO: 2358 - protein, 306 aa, Felis catus
MEGRNQTHVTEFILLGLSNQGEQQSLLFWVFLSMYLVTFTGNLLMILTIITDPRLHTPMYFFLSNLSFSDICFTSTTVPKMLLNIQTQSKVITYEGCLSQMYFFMVFAGLDTFLLTVMAYDRFVAICRPLHYMVIMNPKFCGILLLVCWLLSIFNSLLHDLLILQLSFCTDLEIYHFFCEVKQVIQLACSDTFLNDLGTYLASGFLGGFPLTVILSSYSRIVTSILRISSVRGKYKAFSTCGSHLSVVSLFYGTSLGVYLSSAAAQNSRESTIASVMYTVVTPMLNPFIYGLRNRDIKQGLRKLFS

SEQ ID NO: 2359 - DNA, 892 bp, Felis catus
gttacataatttatcctcctcggactctcagatgagggggggctgcagtcacttctcttttggccattcctgtccatgtacctggtcaccttcactgggaacctgatcatgatcctggccattatcacggactcccgcctccacacgcccatgtacttcttcctctccaacctgtccttttcagacatctgtttcacctccaccaccgtcccaaagatgctgctgaacatccagacgcagagcaaagtgatcacctatgaaggctgcctcagtcagatgtactttttcatgctttttggagtattagaccacttcctcttgacagtgatggcctatgaccggtttgtggccatctgtcacccactgcaccacatggtcatcatgaaccccaagttctgtggcatcctgctcctgggatcctggatactgagtgttcttgactctctattacatgacttactgattttgcgactctccttttgcacagagctggaaatccttcactttttctgtgaatttaatcaggtgatccaacttgcttgctctgatacgttcctcagtgacccgatgatctatctcgcagatggacctctgtgtgttgttccactcactggtatcctgctctctttctccaagattgtaacctccattttgacaatttcatcagccagcggcaatatacagcatttttccatgtgtgggtctcatctctcagtggtctccttgttctgtaatataggacttggggtatcttggtattgatgcttcacaaaactccagcgcatctgccatagcctctggcatgtacacgatcatgacacccatgcctaaccccttcatctgtggtctgaggagcagagacatcaagcaaggcctgagaaagctctttagc

SEQ ID NO: 2360 - protein, 77 aa, Felis catus
MFSSIFGTVVEVKQMSEKDRLERKKYMGVWRRESVIMARIMIRFPVKVTRYMDRNGQKRSDCSPPSSESPRRINYVT

SEQ ID NO: 2361 - DNA, 918 bp, Felis catus
atggaaggaagaaatcaaactcatgttacagaatttatcctcctgggactctcagaccagggggaacagcagtctctgctcttttggccgttcctgtccatgtacctggtcaccttcactgggaacctactcatgatcctggccattatcacggactctcgcctccacatgcccatgtacttcttcctctccaacctgtccttttcagacatctgtttcacctctgccaccatcccaaagatgctgctgaacatccagacacagagcagagcgatctcctacgaagggtgcctcagtcagatgtactttttcatgctttttggaggattagaccactttctcttgacagtgatggcctatgaccggttcgtggccatctgtcacccattgcactacatggtcatcatgaaccccaagttctgtggcatcctgctcctgggatcctggatactgagtgttcttgcctctctattacttgacttactgattttgcgactctctttttgcacaaagctggaaatccttcactttttctgtgaacttaagcaggtgatccaacttgcttgctccgataggttcctcaatgacctggcagtgtatttggtaagtggacttctgggtgttgttccactcactggcatcctgttctcttactctagaattgtcacttccattttgagaatttcatcagtgaggggcaagtataaagcattttccacgtgtgggtctcacctctcagtggtctctttgttctatgctacaggccttggggtgcatctgagttctgctgctgcacaaaactccagggcaagtgccatagcctcagtcatgtacacggtggtgacgcccatgttgaaccccttcatctatggtctgaggaacagagacatcaagcaagccctgggaaaactctttagc

SEQ ID NO: 2362 - protein, 306 aa, Felis catus
MEGRNQTHVTEFILLGLSDQGEQQSLLFWPFLSMYLVTFTGNLLMILAIITDSRLHMPMYFFLSNLSFSDICFTSATIPKMLLNIQTQSRAISYEGCLSQMYFFMLFGGLDHFLLTVMAYDRFVAICHPLHYMVIMNPKFCGILLLGSWILSVLASLLLDLLILRLSFCTKLEILHFFCELKQVIQLACSDRFLNDLAVYLVSGLLGVVPLTGILFSYSRIVTSILRISSVRGKYKAFSTCGSHLSVVSLFYATGLGVHLSSAAAQNSRASAIASVMYTVVTPMLNPFIYGLRNRDIKQALGKLFS

SEQ ID NO: 2363 - DNA, 918 bp, Felis catus
atggaagaaagaaatcaaacctgtgtcacacaatttattctcctgggactctcagatgagggggggctgcagtcacttctcttttgggtgttcctgtacatgtacctggtcaccttcactgggaacctgctcatgatcctggccattatcacggactcccgcctccacacgcccatgtacttcttcctctccaacctgtccttttcagacatctgtttcacctccaccaccgtcccaaagatgctgctgaacatccagacgcagagcaaagtgatcacctatgaaggctgcctcagccagatgtactttttcatgctttttggagtattagataacatactcttgacagtgatggcctatgaccggtttgtggccatctgtcagccactgcactacatggtcatcatgaaccccaagttctgtggcatcctgctcctggtatgctggttattgggtgttttttactctctattacttgacttactgattttgcgactctccttttgcacagagctggaaatccttcactttttctgtgaacttaagcaggtgatccaacttgcttactctgatacgttcctcaatgatctggtgatgtatttgtcaagtggacttctgggtgttgttccactcactggcatcctgttctcttactctagaattgtcacttccattttgagaatttcatcagtgaggggcaagtataaagcattttccacgtgtgggtctcacctctcagtggtctctttgttctatggcacatgccttggggtgtatctgagttctgctgctgcacaaaactccagggcaagtgccatagcctcagtcatgtacacggtggtgacgcccatgttgaaccccttcatctatggtctgaggaacagagacatcaagcaagccctgagaaatctctttagc

SEQ ID NO: 2364 - protein, 306 aa, Felis catus
MEERNQTCVTQFILLGLSDEGGLQSLLFWVFLYMYLVTFTGNLLMILAIITDSRLHTPMYFFLSNLSFSDICFTSTTVPKMLLNIQTQSKVITYEGCLSQMYFFMLFGVLDNILLTVMAYDRFVAICQPLHYMVIMNPKFCGILLLVCWLLGVFYSLLLDLLILRLSFCTELEILHFFCELKQVIQLAYSDTFLNDLVMYLSSGLLGVVPLTGILFSYSRIVTSILRISSVRGKYKAFSTCGSHLSVVSLFYGTCLGVYLSSAAAQNSRASAIASVMYTVVTPMLNPFIYGLRNRDIKQALRNLFS

SEQ ID NO: 2365 - DNA, 918 bp, Felis catus
atggaaggaagaaatcaaacccgtgttacagaatttatcctcttggggctctcagacgagggggggctgcagtccctgctcttttggctgttcctgtccatgtacctggtcaccttcactgggaacctgctcatgatcctggccattatcacggactcccgcctccacacgcccatgtacttcttcctctccaacctgtccttttcagacatctgtttcacctccaccaccatcccaaagatgctgctgaacatccagacacagagcaaagtgatcacctatgaaggctgtctcagccagatgtactttttcatgctttttgtaggattagacaacttcctcttgacagtgatggcctatgaccggttcgtggccatctgtcacccattgcactacatggtcatcatgaatcccaaattctgcagcattctgcttctggttccctggatattgagtgttcttacctctctattacatgacttgatgattttgcgactctctttttgcacagatctggaaatccttcactttttctgtgaacttattcaggtgatccaacttgcttgctctgataccttcctcaatgacctgatgatctatctcacaagtggacttctgggtgttgttccactcactggtatcctgttctcttactatagaattgtaacttccattttgagaatttcatcagcaatgggcaagtataaagcattttccacatgtgggtctcatcttgcagtggtctctttgttctacggtacaagccttggggtttatcttagttttgctgcttcacaaaactccagagcaagtgccatagcctcagtgatgttcacagtggtgacgcccatgctgaacccctttatctatggtctgaggaacagagacatcaagcaagccctgagaaatctctttagc

SEQ ID NO: 2366 - protein, 306 aa, Felis catus
MEGRNQTRVTEFILLGLSDEGGLQSLLFWLFLSMYLVTFTGNLLMILAIITDSRLHTPMYFFLSNLSFSDICFTSTTIPKMLLNIQTQSKVITYEGCLSQMYFFMLFVGLDNFLLTVMAYDRFVAICHPLHYMVIMNPKFCSILLLVPWILSVLTSLLHDLMILRLSFCTDLEILHFFCELIQVIQLACSDTFLNDLMIYLTSGLLGVVPLTGILFSYYRIVTSILRISSAMGKYKAFSTCGSHLAVVSLFYGTSLGVYLSFAASQNSRASAIASVMFTVVTPMLNPFIYGLRNRDIKQALRNLFS

SEQ ID NO: 2367 - DNA, 900 bp, Felis catus
atggaaggaagaaatcaaacccgtgttacagaatttatcctcttgggactctcagatgagggggagctgcagtccctgctcttttggccgttcctgtccatgtacctggtcaccttcactgggaacctgctcatgatcctggccattatcacagactcccgcctccacacgcccatgtacttcttcctctccaacctgtgcttttcagacatctgtttcacctccaccaccattccaaagatgctgctgaacatccagatgcagagcaaagtgatctcctacaaaggttgtctcagccagatgtactttttcatgctttttggagtattagacaccttcctcttgaccgtgatggcctatgaccggtttgtggccatctgtcacccactgcactacatggtcatcatgaaccccaagttctgtggcatcctgctcctggtatgctggttattgagtatttttaactctctattacatgacttactgattttgcgactctctttttgcacagatctggaaatccttcactttttctgtgaacttaatcagctgatccaacttgcttgctctgataccttcctcaatgacctgatgatctatctcacaagtggatttctgggtgttgttccactcactggtatcctgttctcttactctagaattgtcacttccattttgagaatttcatcagtgaggggcaagtataaagcattttccacgtgtgggtctcacctctcagtggtctctttgttctatggtacaagccttggggtgtatctgagttctgctgctgcacaaaactccaggacaagtgccatagcctcagtcatgtacacagtggtggcacccatgctgaaccccttcatctatggcctgaagaacagagacatcaagcaagcc

SEQ ID NO: 2368 - protein, 300 aa, Felis catus
MEGRNQTRVTEFILLGLSDEGELQSLLFWPFLSMYLVTFTGNLLMILAIITDSRLHTPMYFFLSNLCFSDICFTSTTIPKMLLNIQMQSKVISYKGCLSQMYFFMLFGVLDTFLLTVMAYDRFVAICHPLHYMVIMNPKFCGILLLVCWLLSIFNSLLHDLLILRLSFCTDLEILHFFCELNQLIQLACSDTFLNDLMIYLTSGFLGVVPLTGILFSYSRIVTSILRISSVRGKYKAFSTCGSHLSVVSLFYGTSLGVYLSSAAAQNSRTSAIASVMYTVVAPMLNPFIYGLKNRDIKQA

SEQ ID NO: 2369 - DNA, 919 bp, Felis catus
atggaatcagaaaatcaaacatgtgtttcagaatttatcctcctgggtgtctcagaagatgtattactccagcccctcctctttggactgtttttgtccatgtatctggtcacatccattgggaacctgctcatcatcgtggccgttatcatggactcccacctccacacgcccatgtacttctttctctccaatctctctttggcagacatctgtttcatctccaccaccatccctaagatgctactgaacatccagacacagagcaaagtcattacctatgcaggatgcatcacccagttgtactttttcatgctttttggagttctggacaacttcctcctgactgtgatggcctatgaccggtttgtggccatctgtcaccccctccactacacgatcatcatgaacccccgcctctgtgggctcctgcttctggcatcctggatcatgactgccctgcactcattgttacagagcttaatggttttgcgactctctttttgtgaagagttggaaatccctcattttttctgtgaacttaatcagctaatccatcttgcttgttctgatacttttctcaacgatttggtgatgtattttgctactggccttgtagctattgttccactcacagggatcctcttctcttactctaagattgtaacctccatttccagaatttcatcagctggaggcaagtacaaagcattttctacatgtgggtctcacctctcagttgtctccttgttctatggcacaagccttggggtgtatctgagttctgctgctgcacaaaactccagggccagtgccatagcctcagtcatgtacacagtggtcacccccatgctgaacccttttatctatagtctaaaacaacaaggacataaagcaagcccttaaaaagctcttcagc

SEQ ID NO: 2370 - protein, 301 aa, Felis catus
MESENQTCVSEFILLGVSEDVLLQPLLFGLFLSMYLVTSIGNLLIIVAVIMDSHLHTPMYFFLSNLSLADICFISTTIPKMLLNIQTQSKVITYAGCITQLYFFMLFGVLDNFLLTVMAYDRFVAICHPLHYTIIMNPRLCGLLLLASWIMTALHSLLQSLMVLRLSFCEELEIPHFFCELNQLIHLACSDTFLNDLVMYFATGLVAIVPLTGILFSYSKIVTSISRISSAGGKYKAFSTCGSHLSVVSLFYGTSLGVYLSSAAAQNSRASAIASVMYTVVTPMLNPFIYSLKQQGHKASP

SEQ ID NO: 2371 - DNA, 969 bp, Felis catus
tcatgggaaattcttcaaccgcaggacaattggaccttttctaactgccattgcagagaatctcctcagagccccctttaggtctttgttcctcaggctgtagatgaaggggttcagcatgggcgtgaccaccgtgtacatcaccgaggctgtggcacttgagtgggagctctgggtggcagcagagctgaggtacacacctaggctcgtacaaaaaaataaggagacaactaaaaggtgagatgcgcaggtggaaaatgctttatacttgccctgagctgaggagatcccacgtatggaggaaactatcttggagtaagagtaaagtatcccaacgaggggaccaccagccagcaacacagctgcaagatacatcaccaagttattaagaaaggtgtcagaacaggcaagttggatcaactgattgagttcacataaaaagtgggggatttctacttctgtacagaaggacagccgcaacaccattgaagtttgcaacaaggaatgcaggacactcgtgatccaggacaccaggaccagcagcccacagagccgggggttcatgatgaccgtgtattgcagggggtgacagatggccacaaatctgtcataggccatcacagccaggagatagatgtccaacactgaaaagattaagaaaaagttcatctgggtgatgcagtcctcataggttatgattttgctctgtgtctggatgttcaagagcatcttcgggacggtggtggaggtgaagcagatgtctacaaaggacaggttggccaggaagaagtacatgggggtgtggaggtgggagtcagagctgacaaccaggatgatgagcaggttcccaaacacagtgatcaggtacatggaaaggaaaagcccaaatatgaggggctgcagttctggaccgtctgaaaatcccagaagcagaaattctaatagtcgtgtatcgtttcctggttccat

SEQ ID NO: 2372 - protein, 322 aa, Felis catus
MEPGNDTRLLEFLLLGFSDGPELQPLIFGLFLSMYLITVFGNLLIILVVSSDSHLHTPMYFFLANLSFVDICFTSTTVPKMLLNIQTQSKIITYEDCITQMNFFLIFSVLDIYLLAVMAYDRFVAICHPLQYTVIMNPRLCGLLVLVSWITSVLHSLLQTSMVLRLSFCTEVEIPHFLCELNQLIQLACSDTFLNNLVMYLAAVLLAGGPLVGILYSYSKIVSSIRGISSAQGKYKAFSTCASHLLVVSLFFCTSLGVYLSSAATQSSHSSATASVMYTVVTPMLNPFIYSLRNKDLKGALRRFSAMAVRKGPIVLRLKNFP

SEQ ID NO: 2373 - DNA, 928 bp, Felis catus
ggaactaggcaacaatacacgaagttcagaatttcttcttctgggactttcagaggaaccagagttgcaacccttcctctttgggctgttcctgtccatgtacttggtcaccatacatgggaatctgctcatcatcctggctgtaaactctgactcccacctccacacgcccatgtacttcttcctcgccaacctgtcctttgtagacatctgtgtcacttccaccacagtccccaagatgctggtgaatatacaaacacagagaaaggtcataacttatgaaagctgtatcacgcaggtatactttttcatactctttgtagttttggacaatttcctcctgactgtgatggcatatgaccgctttgtagccatctgtcaccccctgtgctacacagtcatcatgaaccccaagttctgtgggctgctggttctggtgtcttggatcgtgagtgtcctgaattccttgttacaaaccttaatggtgttgcagctgtccttctgtacagacatggaaatcccccactttttctgtgaactcaatcagatgatccaacttgcctattctgacacctttcttaatgacatggtaacttgttttacaactgtgctgttgggtggtgctcccctggctggggtcctttactcttattctaagatagtttcctccatatgtgggatctcatcagctcagggcaagtataaagcattttccacctgtgcatctcacctctcggttgtctccttattttattgtaccagcctaggtgtgtactttagctctgctgcttcccagagctcccactcaagtgccacggcctcggtgatgtacacggtggtcacacccatgctgaaccccttcatctacagcctgaggaacagagacataaaggaggctctaaatgtatttttcagagggaagccataa

SEQ ID NO: 2374 - protein, 308 aa, Felis catus
ELGNNTRSSEFLLLGLSEEPELQPFLFGLFLSMYLVTIHGNLLIILAVNSDSHLHTPMYFFLANLSFVDICVTSTTVPKMLVNIQTQRKVITYESCITQVYFFILFVVLDNFLLTVMAYDRFVAICHPLCYTVIMNPKFCGLLVLVSWIVSVLNSLLQTLMVLQLSFCTDMEIPHFFCELNQMIQLAYSDTFLNDMVTCFTTVLLGGAPLAGVLYSYSKIVSSICGISSAQGKYKAFSTCASHLSVVSLFYCTSLGVYFSSAASQSSHSSATASVMYTVVTPMLNPFIYSLRNRDIKEALNVFFRGKP

SEQ ID NO: 2375 - DNA, 863 bp, Felis catus
tcatgggtacttttcagcacaagacaattggcccttttatagctgccataccagagaatctcatcagaggaactaatgtctttgttcctcaggctatagatgagggggttcagtatgggtgtgaccaccatgtacatcaccgagcctgttgcacttgagtgggagctctgggtagcagcagagctgaggtacactcctaggcttgtacagtaaaataaagagaccactgaaaggtgagacacacaggtggaaaatgctttatactttccctgagctgatgaaatcccacgtatgaaggaaattatcttatagtaagagtaaaggatcccaaaaaagggaccaccagccagcagaatagctccaaaatacaccaccatgttattgagaaaggtgtcaggacagacaagttggatcatcggattgagctcacagaaaaagtgggggatttcccagactgtacagaaggacagctgcaacaccattaagctttctaacaaggaatgcagagcactccaggaccaggagtccacagagccaggagctcataatgaccatgtagtttaccgggtggcagatggccacaaacctgtcgtaggccatcacactcaggagaaagtcgtccatccctgcaaaggttatgaaaaagttcatttgtgtgatacagtcctcataggttatgactttgctctgggtctggatgttccagagcatcttcaggacggtggtggaggtgaagcagatgtctacaaaggacaggttggccaggaagaagtacatgggggtgtggaggtgggagtcagagctgacggccaggaggatgagcaggttcccaaacacagtgatcaggtacatggaaaggaaaa

SEQ ID NO: 2376 - protein, 163 aa, Felis catus
  MOD_RES (163)..(163): Any amino acid
MLLRKVSGQTSWIIGLSSQKKWGISQTVQKDSCNTIKLSNKECRALQDQESTEPGAHNDHVVYRVADGHKPVVGHHTQEKVVHPCKGYEKVHLCDTVLIGYDFALGLDVPEHLQDGGGGEADVYKGQVGQEEVHGGVEVGVRADGQEDEQVPKHSDQVHGKEX

SEQ ID NO: 2377 - DNA, 894 bp, Felis catus
ttttatgtctctgttcctcaggctgtagatgaaggggttcagcatgggcgtgaccaccgtgtacatcaccgaggctgtggcacttgagtgggagctctgggtggcagcagagctgaggtacactcccaggccagtacaataaaatagagagacaaccaagaggtgagatgcacaggtggaaaatgctctgtacttgccttgagctgatgagatcccacatatggaggagactatcttagaataagagtaaaggaccccagccaggggagcaccacccagcagcacagttgcaaaatacatcatcatgtcattaagaaaggtgtcagaacaggcaagttggatcatctgattgagttcacagaaaaagtgggggatttccatgtctgtacagaaggacagctgcaacaccattaaggtttgtaacaaggaatttgtaacactgatgatccaggacaccagaacaagcaatccacagagctgggggttcatgatgacggtgtagtgcagggggtgacagatggccacaaaccggtcataggccattgcagataggagaaagtcatccagttctgcacagagtaagaaaaaatacatctggctaatgcagcctgcatagttaatgaccttgctctgagtctgggtgttcagaagcatcttcgggacagtggtggacgtgtagcagatgtccgaaaaggacaggttggccaggaagaagtacatgggggtgtggaggtgggagtcagagctgatggccaggatgatgagcaggtttccaaacacagtgatcaggtacatggagaggaaaagcccaaatatgaggggccgtaatgctggttcctctgaaaatcccagaagaagaaactttgaaatgtgtgtatcattgcctagttccat

SEQ ID NO: 2378 - protein, 298 aa, Felis catus
MELGNDTHISKFLLLGFSEEPALRPLIFGLFLSMYLITVFGNLLIILAISSDSHLHTPMYFFLANLSFSDICYTSTTVPKMLLNTQTQSKVINYAGCISQMYFFLLCAELDDFLLSAMAYDRFVAICHPLHYTVIMNPQLCGLLVLVSWIISVTNSLLQTLMVLQLSFCTDMEIPHFFCELNQMIQLACSDTFLNDMMMYFATVLLGGAPLAGVLYSYSKIVSSICGISSAQGKYRAFSTCASHLLVVSLFYCTGLGVYLSSAATQSSHSSATASVMYTVVTPMLNPFIYSLRNRDIK

SEQ ID NO: 2379 - DNA, 933 bp, Felis catus
caagcaatgaaacaaaattttcaaagtttcttcttctgggattttcagaggaaccagaactgcagcccctcatatttgggcttttcctctccatgtacctgatcactgtgtttggaaacctgctcatcatcttggccatcagcacagaccccaacctccacacgcccatgtacttcttcctggccaacctgtcctttgtagacatctgcttcacctccaccaccgtgccgaagatgctggtgaacatccagactcagagcaaagtcataacctatgcaggctgtatcacacagatttattttctcatactctttgctgtgatggacgtcttcctcctgagtgtgatggcctatgaccggtttgtggccatccgtcaccccctgcactacacgatcattgtgaacccccggctctgtgggctgctggttcttgtgtcctggatcatgtgtgtcctgcattccctgttacaaagtttaatgatgttgcggctgtccttctgtacacacttgcatatcccccactttttttgtgaacttaatcagatgctccaactggcctgttctgatacctttcttaataacgtggtgatgtatcttgcagctgtcttgttggctggtggtcccttcattgggatcctttactcttactctaagatagtttcctccatatgtcggatctcatcagctcagggaaagtgtaaagcattttctacctgtgcatctcatctatcggttgtctccttattttattgtacgatgctcggcgtgtaccttagctctgctgctacccacagctcacggtcaagtgccacagcctcggtgatgtacacggtggtcacgcccatgctgaaccccttcatctacagcttgaggaacaaagacatgaaaagggctctgaaagcattctttgggaaagagacccttacaggccaat

SEQ ID NO: 2380 - protein, 311 aa, Felis catus
  MOD_RES (311)..(311): Any amino acid
SNETKFSKFLLLGFSEEPELQPLIFGLFLSMYLITVFGNLLIILAISTDPNLHTPMYFFLANLSFVDICFTSTTVPKMLVNIQTQSKVITYAGCITQIYFLILFAVMDVFLLSVMAYDRFVAIRHPLHYTIIVNPRLCGLLVLVSWIMCVLHSLLQSLMMLRLSFCTHLHIPHFFCELNQMLQLACSDTFLNNVVMYLAAVLLAGGPFIGILYSYSKIVSSICRISSAQGKCKAFSTCASHLSVVSLFYCTMLGVYLSSAATHSSRSSATASVMYTVVTPMLNPFIYSLRNKDMKRALKAFFGKETLTGQX

SEQ ID NO: 2381 - DNA, 969 bp, Felis catus
atggaaccaggaaatattacacggatatcaaaatttcttctcctgggattttcagtgagaccagaactgcagcccctcatatttggacttttcctctccatgtacctgatcactgtgtttggcaacctgctcatcatcctggccgtcagctctgactcccgcctccacacccccatgtacttcttcctggccaacctgtcctttgtagacatctgcttcacctccaccacagtcccgaagatgctggtgaacatccagacccagagcaacatcataacccatgaggactgcatcacacaaatgaacttcttcataatcttttcagggttggacatctatctcctggctgtgatggcctatgaccggtttgtggccatctgtcaccccctgcactataaggtcatcatgaacccccggctctgtgggctgctggtcctggtgtcctggatcacaagtatcctgcattccttgttacaaacttcaatggtgttgcagctgtccttctgtacagaggtagaaatcccccactttttctgtgaactcaatcagttgatccaacttgcctgttctgacacctttcttaataacttggtgatgtaccttgcagctatgctgctggctggaggtccccttgctgggatcctttactcttattctaagatagtttccaccataattggaatctcatcagctcagggaaagtataaagcgttttccacctgtgtatctcatcttttagttgtatctttatttttttgtacgagcctaggtgtgtacctcagctctgctgccacccagagctcccactcaagtgccacagcctcggtgatgtacacggtggtcacgcccatgctgaaccccttcatctacagcctgaggaacaaagacctaaaggtggttcttaaaagaatcattgggatttcattgacgtgagggccaatcatattagggctgaagacgtgcccatga

SEQ ID NO: 2382 - protein, 310 aa, Felis catus
MEPGNITRISKFLLLGFSVRPELQPLIFGLFLSMYLITVFGNLLIILAVSSDSRLHTPMYFFLANLSFVDICFTSTTVPKMLVNIQTQSNIITHEDCITQMNFFIIFSGLDIYLLAVMAYDRFVAICHPLHYKVIMNPRLCGLLVLVSWITSILHSLLQTSMVLQLSFCTEVEIPHFFCELNQLIQLACSDTFLNNLVMYLAAMLLAGGPLAGILYSYSKIVSTIIGISSAQGKYKAFSTCVSHLLVVSLFFCTSLGVYLSSAATQSSHSSATASVMYTVVTPMLNPFIYSLRNKDLKVVLKRIIGISLT

SEQ ID NO: 2383 - DNA, 969 bp, Felis catus
atggaaccaggaaatgatacacgactattagaatttctgcttctgggattttcagagggaccagaacttcagcccctcatatttgggcttttcctctccatgtacctgatcactgtgtttgggaacctgctcatcctcctggccgtcagctctgactcccacctccacacccccatgtacttcttcctggccaacctgtcctttgtagacatctgcatcacctccacaatcatcccgaagatgctggtgaacatccagactcagagtaaagttataacctatgacgactgcatcacacagatggactttttcttaatcttttcagtgttggacatgtatctcctgaccatgatggcctatgacaggtttgtggccatctgtcaccccctgcactacacagtcatcatgagccctcggctctgtgcactgctggtcctggtgtcctggatcatgagtgtcctgcattccttgttacaaaccttaatggtgttgcagctgtccttctgtacagaggtagaaatcccccactttttttgtgaactcaatcagatgacccaactggcttgttctgacaccttttttaataacttggtgatgtatcttgcagctatgctgctaggtggtggtcccttcattgggatcctttactcttactccaagatagctttctgcatacagagaatctcatcagctcaggggaagtataaagcattttccacctgtgcaactcacctctccgttgtctctctattttattgtactggcctgggagtgtacctcagctctgctgctacccagggctcccactcgagtgccacagcctcggtgatgtacacggtggtcacgcccatgctgaaccccttcatctacagcctgaggaacagagacataaaggaggctctgaggagattctctgggatggtagctataaaagttccaattgtcctggggttgaagaatttcccatga

SEQ ID NO: 2384 - protein, 322 aa, Felis catus
MEPGNDTRLLEFLLLGFSEGPELQPLIFGLFLSMYLITVFGNLLILLAVSSDSHLHTPMYFFLANLSFVDICITSTIIPKMLVNIQTQSKVITYDDCITQMDFFLIFSVLDMYLLTMMAYDRFVAICHPLHYTVIMSPRLCALLVLVSWIMSVLHSLLQTLMVLQLSFCTEVEIPHFFCELNQMTQLACSDTFFNNLVMYLAAMLLGGGPFIGILYSYSKIAFCIQRISSAQGKYKAFSTCATHLSVVSLFYCTGLGVYLSSAATQGSHSSATASVMYTVVTPMLNPFIYSLRNRDIKEALRRFSGMVAIKVPIVLGLKNFP

SEQ ID NO: 2385 - DNA, 959 bp, Felis catus
atggaaccaggaaatgatacacggacatcagaatttctgcttctgggattttcagacagtccagaacagcaacccctcatatttgggcttttcctctccatgtacctgatcactgtgtttgggaacctgctcatcatcctggccgtcagctatgactcccgcctccacacgcccatgtacttcttcctggccaacctgtcctttgtagacatctgcatcacctccaccaccatcccgaagatgctctggaacatccagacccagagcaaagtcataacctatgaggactgcatcacccagatgaactttttcataatcttttcaggattggacatctgcctcctggccattatggcctatgacaggtttgtggccatctgtcaccccctgcaatacacggtcatcatgagcccccggctctgtgcactgctggtcctggtgtcctggatcacgagtgtcctgcattccttgttgcaaacttcaatggtgttgcggctgtccttctgtacagtcgtggaaatcccccatttttcctgtgaactcaatcagatgacccaagttgcctgttctgacacctttcttaataacttggtgatgtattttgcagctatcctagtgggtggcggtcctttctttgggatcctttactcttactccaagatagtttcctccatacgtgggatctcatcagctcagggcaagtataaagcattttccacctgtgcatctcacctctcggttgtctccttattttattgtacgggcctcggagtgtaccttagctctgctgctacccagagctcccactcaagtgccacagcctcggtgatgtacacggtggtcacgcccatgctgaatcccttcatctacagcctgaggaacaaagacataaagaaggctctgaggagattctctgcgatggcagttagaaaaggtccaattgtcctgtggttgaagaa

SEQ ID NO: 2386 - protein, 320 aa, Felis catus
  MOD_RES (320)..(320): Any amino acid
MEPGNDTRTSEFLLLGFSDSPEQQPLIFGLFLSMYLITVFGNLLIILAVSYDSRLHTPMYFFLANLSFVDICITSTTIPKMLWNIQTQSKVITYEDCITQMNFFIIFSGLDICLLAIMAYDRFVAICHPLQYTVIMSPRLCALLVLVSWITSVLHSLLQTSMVLRLSFCTVVEIPHFSCELNQMTQVACSDTFLNNLVMYFAAILVGGGPFFGILYSYSKIVSSIRGISSAQGKYKAFSTCASHLSVVSLFYCTGLGVYLSSAATQSSHSSATASVMYTVVTPMLNPFIYSLRNKDIKKALRRFSAMAVRKGPIVLWLKX

SEQ ID NO: 2387 - DNA, 933 bp, Felis catus
ttacatcacttgaacgcaaaaaattcttttcagagcactctttatgtctttgttcctcaggctgtagatgaaggggttcagcatgggcgtgaccaccgtgtacatcactgaggctgtagcacttgactgtgagctctgggtagcagcagagctcaggtacacgccgagcatcgtacagtaaaataaacacacgaccgacaggtgagacgcacaggtggaaaatgttttatacttgcccttagctgatgcaatcccacgtatagaggacactatcttggaataagagtaaaggatcccagcaaaaggaccaccacccagcaggacagctgcaagatacatcaccacgttattaagaaaggtgtcagaacaggcaagctggagcatctcattgagttcacaaaaaaagtgggggatgtgcaagtgtgtacagaaggacagccgcaacatcattaaactttgtaacagggaattcaggacacacatgatccaggacacaagaaccagcagcccacagagccgggggttcatgatgaccgtgtagtgcagggggtgacagatggccacaaaccggtcataggccatcacactcaggaggaagacgtccagtacagcaaagagaatgagaaaataaatctgtgtgatgcagtcctcataagttatgactttgctctgagtctggatgttcaccagcatctttggaatcgtggtggaggtgaagcaaatatctacgaaggacaggttggcgaggaagaagtacatgggagtgtggaggttggggtctgtgctgatggccaaaattatgagcaggttgccaaacacagtgatcaggtacatggagaggaaaagcccaaatatgaggggctgcagttctggtctctctgaaaatcccagaagaagaaattctgaaattcgtgttttgttgctcagttccat

SEQ ID NO: 2388 - protein, 310 aa, Felis catus
MELSNKTRISEFLLLGFSERPELQPLIFGLFLSMYLITVFGNLLIILAISTDPNLHTPMYFFLANLSFVDICFTSTTIPKMLVNIQTQSKVITYEDCITQIYFLILFAVLDVFLLSVMAYDRFVAICHPLHYTVIMNPRLCGLLVLVSWIMCVLNSLLQSLMMLRLSFCTHLHIPHFFCELNEMLQLACSDTFLNNVVMYLAAVLLGGGPFAGILYSYSKIVSSIRGIASAKGKYKTFSTCASHLSVVCLFYCTMLGVYLSSAATQSSQSSATASVMYTVVTPMLNPFIYSLRNKDIKSALKRIFCVQVM

SEQ ID NO: 2389 - DNA, 969 bp, Felis catus
tcatgggtatgtctccagccccaggactattggcccttacattgctggaaccccaatgattctcttcagagccctctttatgtctctgttcctcaggctgtagatgaaggggttcagcatgggcgtgaccaccgtgtacatcaccgaggctgtgacacttgagagtgagctctgggtagcagcagagctgaggtacactcctaggcttgtacaaaaaaataaggagacaacggagaggtgagacgcacaggtggaaaatgctttatacttgccctgagctgatgagatcctacgtatggaggaaactatcttagaataagagtaaaggatcccagccaggggagcaccacccagcagcacagctgcaagatccatcaccacgtcattaagaaaggtgtcagaacaggcaagctggagcatctcattgagttcacaaaaaaagtgggggacatgcaagtgtgtacagaaggacagccacaacatcattaaactttgcaacaaggaattcaggacacacatgacccaggacaccagaacaagcagcccacagagccgggggttcatgatgaccgtgtagtgtagggggtgacagatggccacgaagcggtcataggccatcacggtcaagagaaagacttctaatcctgcaaagtgtatgaaaaaatacatctgtgtgatgcagcctgcataggttatgactttgctctgagtccggatgttccagagcatcttcgggacagtggtggagatgaagcagatgtccgaaaaggacaggttggccaggaagaagtacatgggggtgtggaggtgggagtcagagctgacggccaggaggatgagcaggttcccaaacacagtgatcaggtacatggagaggaaaagcccaaatatgaggggctgtaatgccggttcctctgaaaatcccagaagaaaaaattctgaaatttgtgtatcatttcctggttccat

SEQ ID NO: 2390 - protein, 310 aa, Felis catus
MEPGNDTQISEFFLLGFSEEPALQPLIFGLFLSMYLITVFGNLLILLAVSSDSHLHTPMYFFLANLSFSDICFISTTVPKMLWNIRTQSKVITYAGCITQMYFFIHFAGLEVFLLTVMAYDRFVAICHPLHYTVIMNPRLCGLLVLVSWVMCVLNSLLQSLMMLWLSFCTHLHVPHFFCELNEMLQLACSDTFLNDVVMDLAAVLLGGAPLAGILYSYSKIVSSIRRISSAQGKYKAFSTCASHLSVVSLFFCTSLGVYLSSAATQSSLSSVTASVMYTVVTPMLNPFIYSLRNRDIKRALKRIIGVPAM

SEQ ID NO: 2391 - DNA, 914 bp, Felis catus
ttttttctttggggattttcagaggaaccagaactgcagcccctcatatttgggcttttcctctccatgtacctgatcactgtgtttggcaacctgctcatcctcctggccgtcagctctgactcccacctccacacccccatgtacttcttcctggccaacctgtcctttgtagacatctgcttcacctccaccaccatcccgaagatgctctggaacatccagacccagagtaacgtcataacctatgaggacttcatcacccagatgtattttttcctactcttcacgggactggacaactacatcctgaccgtgatggcctatgaccgatttttggccatctgtcaccccctctgcactacacgggcatcatgaacccccggctctgtgggctgctggctctggtgtcctggatcatgagtgtcctgcattccttatcaccaagtttaatggtgctgcagctgtacttctgcacacactcactttttctgtcatttaatcagatgatccaacctgcctgctctgacacctttcttaatgacacagtgatgtattttttaaccgtgttggtggctggtggtccccttgctgggatcctttactcttattctaagattatttcctccatacatagaatcccatcagctcagggtaagtataaagcattttccacctgtgcgtctcacctcttggttgtctccttactttattgtgcggtcctcggagtatactttagctctgctgctacccagagttcacgctcaagtgcaacagcctcagtgatcatgcctatgctgaaccctgtcatctacagcatgaggaacaaagacataaaggaggctctgatgagatccttcgggacggcaggtgtaaaagggaccattgtcctgctagtgaagaagtgcccttga

SEQ ID NO: 2392 - protein, 179 aa, Felis catus
MNPRLCGLLALVSWIMSVLHSLSPSLMVLQLYFCTHSLFLSFNQMIQPACSDTFLNDTVMYFLTVLVAGGPLAGILYSYSKIISSIHRIPSAQGKYKAFSTCASHLLVVSLLYCAVLGVYFSSAATQSSRSSATASVIMPMLNPVIYSMRNKDIKEALMRSFGTAGVKGTIVLLVKKCP

SEQ ID NO: 2393 - DNA, 968 bp, Felis catus
atggacccaggaaatgataccggaatttcagaatttcttcttatgggattttcagaagaaccagaactgcagcccctcatatttgggcttttcctctccatgtacctgatcactgtgtttggcaacctgctcatcctcctggccgtcagctctgactcccacctccacacgcccatgtacttcttcctggccaacctgtcctttgtagacatctgcttcacctccaccaccatcccgaagatgctctggaacatccagacccagagcaaagtcataacctatgcaggctgcatcacacagatatactttttcataacctttgcagggatggatgactttctcctgagtgtgatggcctacgacaggtttgtggccatctgccaccccctgcaatacacggtcatcatgaacccccggctctgtggactcctggttctggtgtcctggatcatgagtgttctgtattccttgttacaaaccttaatggtgttgcggctatccttctgtacagaggtggaaatcccccactttttctgtgaactcaatcagatgatccaacttgcctgtcgagacacctttcccaataacatggtgttgtattttggagctatgttgctggctggtggtcccttcattggaatactttactcttactctaaaatagtttcctccatatgtggaatctcatcagctcgaggcaaatacaaagcattttccacctgcgcgtctcacctctcggttgtctccttattttattgcacaagcctaggagtgtacctcagctctgctgctacccagagctcacactcaagtgccacagcctcggtgatatacacggtggtcacgcccatgctgaaccccttcatctacagcctgaggaacagagacataaaggaggctctgatgagattctctgggatggtagctacaaaagggacaattgtcctgggctgaagaagttcccgtga

SEQ ID NO: 2394 - protein, 317 aa, Felis catus
MDPGNDTGISEFLLMGFSEEPELQPLIFGLFLSMYLITVFGNLLILLAVSSDSHLHTPMYFFLANLSFVDICFTSTTIPKMLWNIQTQSKVITYAGCITQIYFFITFAGMDDFLLSVMAYDRFVAICHPLQYTVIMNPRLCGLLVLVSWIMSVLYSLLQTLMVLRLSFCTEVEIPHFFCELNQMIQLACRDTFPNNMVLYFGAMLLAGGPFIGILYSYSKIVSSICGISSARGKYKAFSTCASHLSVVSLFYCTSLGVYLSSAATQSSHSSATASVIYTVVTPMLNPFIYSLRNRDIKEALMRFSGMVATKGTIVLG

SEQ ID NO: 2395 - DNA, 934 bp, Felis catus
ggaaaatggcccttttatggcttccctctgaaaaatacatttagagcctcctttctgtctctgttcctcaggctgtagatgaaggggttcagcatgggcatgaccactgtgtacatcacttaggatattgcacttgagtgggagctctgggtagcagcagagctgaggtacactcccaggccagcacaataaaatagagagacaacggagaggtgagacgcacaggtggaaaatgccttatacttgcccagagctgatgagatcccacgtatggaggaaactatcttagaataagagtacaggaccccagccaggggagcaccacccaacagcacagctgcaagatatatcaccgtgtcatgaagaaaggtgtcagagcaggcaagttggatcatctgattgagctcacagaaaaagcgggggatttgcatgcctgtccagaaggacagctgcaacaccattaaggtttgtatcaaggaatgcaggatgttcatgatccaggacaacagaaccagcagcccacagagccgggggttcatggtgactgggtagtgtagcgggtgacagatgaccacaaagctgtcataagtcgtcagtcaggaggaagttgtctaaacctacaaagagtatgaaaaagtacatctgcatgacacagctttcataagttatgacttttacgacttttctgtgtttgtacattcccatctgggggaccgtggtgaaggagacatagatgtttacgaaggacaggtggtcgaggaagaagtacgtgggtgtgtggaggtgggagtcagactttacagccaggatgatgagcaaattcccaagtatggtgaccaggtacatggacaggaacagcccaaagaggaagggttgcaattctggttcctccgaagatcccagaagaagaaattttgaacttcgtgtatcattg

SEQ ID NO: 2396 - protein, 116 aa, Felis catus
NDTRSSKFLLLGSSEEPELQPFLFGLFLSMYLVTILGNLLIILAVKSDSHLHTPTYFFLDHLSFVNIYVSFTTVPQMGMYKHRKVVKVITYESCVMQMYFFILFVGLDNFLLTDDL

SEQ ID NO: 2397 - DNA, 963 bp, Felis catus
tcatgggcacatcttcagccccaggacaattggcccttacgtccctggaaccccaacgattcttttcagagccctctttatgtctctattcctcaggctgtagatgaaggggttcagcatgggtgtgaccaccgtgtacatcaccgaggctgtggcacttgaccgtgagctctgggtggcagcagagccgaggtacactcctaggactatacagtaaaatagggagacaaccgagaggtgagatgcacaggtggaaaatgctttatacttgccctgagctgatgagatcccacgtatggaggaaactatcttagaataagagtaaaggatccctgctagggaagcaccacccaacaatccagctgcaaaatgcatcaccatgtcattaagaaaggtgtcagaacaggcaagttggaccacttgattgatttcacaaaaaaagtgggggatttctacttgtgtgcagaaggacagccacaacatcattaaggtttgtaataacgaattcagggtgctcaccgtccaggacaccagaacaagcagtccacagaagatgggtttcatgatgatcgtgtagtgcaaagggtgacagatggccacaaatcggtcataagccatcacagccagtagaaagttgtccaatccagcaaagagtaggaaaaagtacatctgtgtgatgcagcctgcataagttatgacttttctctgagtctggatgttcaccagcatctttgggacagtagtggaggtgaagcagatgtctacaaaggataggttggccaggaagaagtacatgggggtgtggagatgggagtcagagctgacggccaggatgatgagcaggttcccaaacacagtgatcaggtacatggagaggaaaaggccaaatatgaggggctgcagttctggaccctctgaaaatcccagaagaaaaaattctgaaatttgtgtatcatttcctgg

SEQ ID NO: 2398 - protein, 308 aa, Felis catus
PGNDTQISEFFLLGFSEGPELQPLIFGLFLSMYLITVFGNLLIILAVSSDSHLHTPMYFFLANLSFVDICFTSTTVPKMLVNIQTQRKVITYAGCITQMYFFLLFAGLDNFLLAVMAYDRFVAICHPLHYTIIMKPIFCGLLVLVSWTVSTLNSLLQTLMMLWLSFCTQVEIPHFFCEINQVVQLACSDTFLNDMVMHFAAGLLGGASLAGILYSYSKIVSSIRGISSAQGKYKAFSTCASHLSVVSLFYCIVLGVYLGSAATQSSRSSATASVMYTVVTPMLNPFIYSLRNRDIKRALKRIVGVPGT

SEQ ID NO: 2399 - DNA, 942 bp, Felis catus
cccactgctgagaggcaccaccctgctgaggaatctccttagagcccccttcatgtccctattcctcagactgtagatgaaggggttcagcatgggcgtgacaattgtgtacatcactgaggccaccagacttgtcctagaggatgaagtcactgcagaactgaggtagaccccaagacctgtgccatagaacaaggagaccaccgagaggtgagacccacacgtggaaaaggctttgtacttgccagtagctgaggaaatgttgagtatggaggaaacaatatgaaagtaggacaaaagtattccgttgaaaggaatcacggccagaaggccagttgcagaatacaccaccatggtattgacgaaggtgtcagaacaggcaagcttcaggacttcgggaagatcacaaaagaagtgtgggatttccatgtttgtgcagaaggacagcctcaaaagggtcaaggtctcgagcagggaacccatgatactgaggcaccaggatcccaatgccaacagcccacagaactggccgttcatgatgattgagtagtgcagggggtgacagatggccacaaagcggtcataggccatcgcggtcaggagtaagttgtccaggcatccaaacacaatgaaaaaaaaaatctggctgaggcagcctttatatgttatgattgtgctctgagtctggatgttccagagcatcttcgggacagtagtggaggtaaaacagatgtcagccaaggacaggttggaaaggaagaagtacatgggggtgtggaggagggagtcagagcagatggccaggatgatgagcagattcccagtgaccgtgaccaagtacatggacaggaacagcccaaagagcacaaattgaatatctgactttgctgaaaatcccaagaggagaaattccgaagcacgcgtttgatttcctgattccat

SEQ ID NO: 2400 - protein, 314 aa, Felis catus
MESGNQTRASEFLLLGFSAKSDIQFVLFGLFLSMYLVTVTGNLLIILAICSDSLLHTPMYFFLSNLSLADICFTSTTVPKMLWNIQTQSTIITYKGCLSQIFFFIVFGCLDNLLLTAMAYDRFVAICHPLHYSIIMNGQFCGLLALGSWCLSIMGSLLETLTLLRLSFCTNMEIPHFFCDLPEVLKLACSDTFVNTMVVYSATGLLAVIPFNGILLSYFHIVSSILNISSATGKYKAFSTCGSHLSVVSLFYGTGLGVYLSSAVTSSSRTSLVASVMYTIVTPMLNPFIYSLRNRDMKGALRRFLSRVVPLSSG

SEQ ID NO: 2401 - DNA, 969 bp, Felis catus
atggaactaagcaatgatacacaaatttcagagtttcttcttctgggattttcagaggaaccagaactgcagcccctcatatttgggcttttcctctccatgtacctgatcactgtgtttggaaacctgctcatcatcctggccatcaggtctgactcccacctccacacccccatgtacttcttcctggccaacctgtcctttgtagacttctgcttcacctccaccaccgtcccgaagatgcttctgaacatccagactcagagcaaggtcataacctatgcaggctgcatcagccagatgtattttttcatactctgtgcagagttggatgaccttatcctgtctgcaatggcctatgaccgatttgtggccatctgtcaccccctgcaatacaccatcatcatgagcccccagctctgtggattgcttgttctggtatcctggatcatcagtgttctgaactcactgttacaaaccttaatggtgctgccactgtccttctgcacaggcatggaagtcccccattttttttgtgaactcaatcaggtcctcaggcttgcctgttctgagacctttcttaatgacacggtgatgtattttgcaactgtgctcctcggtggtgctcccttggctgggatcctttactcttactctaagatagtctcctccatacgtgggatctcatcagctcagggcaagtataaggcattttccacctgtgcatctcacctctcagttgtctccttattttgttgtacaggcctcggagtgtaccttagctctgttgctacccagagttcccactcaagtacaacagcctcggtgatgtacacggtggtcacgcccatgctgaaccctttcatctacagcctgaggaacagagacataaagagggctctgaaaagaatcgttgggattccagtgatgtaaggaccaatcttcctggggctacagatgtgcccatga

SEQ ID NO: 2402 - protein, 310 aa, Felis catus
MELSNDTQISEFLLLGFSEEPELQPLIFGLFLSMYLITVFGNLLIILAIRSDSHLHTPMYFFLANLSFVDFCFTSTTVPKMLLNIQTQSKVITYAGCISQMYFFILCAELDDLILSAMAYDRFVAICHPLQYTIIMSPQLCGLLVLVSWIISVLNSLLQTLMVLPLSFCTGMEVPHFFCELNQVLRLACSETFLNDTVMYFATVLLGGAPLAGILYSYSKIVSSIRGISSAQGKYKAFSTCASHLSVVSLFCCTGLGVYLSSVATQSSHSSTTASVMYTVVTPMLNPFIYSLRNRDIKRALKRIVGIPVM

SEQ ID NO: 2403 - DNA, 967 bp, Felis catus
ggaccaagcaatgatacccaaatttcagatttttttcttctgggattatcaaatgaaccagaattacagcccctcatatttgggcttttcttctccatgtacttgatcagtgtctttggaaacctgctcatcatcctggctgtcagctctgcctcccacctccacacgcccatgtatttctttctctccatcctgtcctttgtggacatttgtatcacttctaccatcatcccaaagatgttggtaaatatacagacacagactaaaattataacctatacaggatgcatcagccagatctatttttccacactctttgcaggctgggacaactttctcctggccgtgatggcctatgaccgcttcgtggccatctgtcaacccctgcactacacggtcatcatgaacccccggcctctgtggactgctggctctggtgtcctggatcacgagtgtccttaattccttgttacaaagcttaatggtgctgcgattgtccttctgtacaaactcagaaatccctcactttttctgtgaactcaatcagatgacccagcttgcctgttctgatacctttctgaacgacacagtgatgcatatttcaactgtgttgctggccggtggtccccttgctgggatcctttactcttactctaagattatttcctctctacgtagaatcccatcagctcagggcaagtataaagcattttccacctgtgcgtctcacctctcagttgtctccttattttattgcacggtcctggaagggtaccttatctcctctgctacccagaactcccactcaagtgcaacagcctcggtgatgtacatggtggtcacgcccatgctgaaccccttcatctacagcctgaggaacaaagacataaagggggctctgaggagattctttgggatggcagggacaaaagggaccatcgtcctgctggtgaagaagtgcccttga

SEQ ID NO: 2404 - protein, 161 aa, Felis catus
MVLRLSFCTNSEIPHFFCELNQMTQLACSDTFLNDTVMHISTVLLAGGPLAGILYSYSKIISSLRRIPSAQGKYKAFSTCASHLSVVSLFYCTVLEGYLISSATQNSHSSATASVMYMVVTPMLNPFIYSLRNKDIKGALRRFFGMAGTKGTIVLLVKKCP

SEQ ID NO: 2405 - DNA, 933 bp, Felis catus
atggacccaggaaatgatacaggaacttcacaatttcttcttatgggattttcagaagaaccaggactgcagcccctcatatttggccttttcctctccatgtacctgatcactgtgtttgggaacctgctcatcatcctggccgtcagctctgactcccgcctccacacacccatgtacttcttcctggccaacctgtcctttgtagacatctgcttcacctccaccaccatcccaaagatgctggtgaacatccagactgagaacaaagtcataacctatgaggactgcatcacacagatttattttttcatactctttgctgtgatggacgtcttcctcctgagtgtgatggcctatgacaggtttgtggccatctgccaccccctccactacacgatcatcatgaacccccagctttgtgggctgttggttctggtgtcctggatcatgtgtgtcctgaattccttgttacagagtttaatgatgttgcggctgtcgttctgtacccaggtagaaattccccactttttctgtgaactcaatgagatgctccagcttgcctgttctgacacctttcttaataacgtggtgatgtatcttgcagctgtcctgctgggtggtggtccttttgccgggatcctttactcttattccaagatagtttcctctatacgtgggattgcatcagctaagggcaagttcaaaacgttttccacctgtgcatctcacctgtcggttgtgtgtttattttactgtacgatgcttggcgtgtaccttagctctgctgctacccagagctcccactcaagtgccacagcctcggtgatgtacacggtggtcacgcccatgctgaaccccttcatctacagcctgaggaacagagacataaagagtgctctgaaaagaattgttggggttcaagtgatgtaa

SEQ ID NO: 2406 - protein, 310 aa, Felis catus
MDPGNDTGTSQFLLMGFSEEPGLQPLIFGLFLSMYLITVFGNLLIILAVSSDSRLHTPMYFFLANLSFVDICFTSTTIPKMLVNIQTENKVITYEDCITQIYFFILFAVMDVFLLSVMAYDRFVAICHPLHYTIIMNPQLCGLLVLVSWIMCVLNSLLQSLMMLRLSFCTQVEIPHFFCELNEMLQLACSDTFLNNVVMYLAAVLLGGGPFAGILYSYSKIVSSIRGIASAKGKFKTFSTCASHLSVVCLFYCTMLGVYLSSAATQSSHSSATASVMYTVVTPMLNPFIYSLRNRDIKSALKRIVGVQVM

SEQ ID NO: 2407 - DNA, 950 bp, Felis catus
acacaaatttcagaattttttcttctgggactttcagaggaaccagcattccagcccctcatatttgggcttttcctctccatgtatctgatcactgtgtttgggaacctgctcatcatcctggccgtcagctctgactcccacctccacacgcccatgtacttcttcctggccaacctgtcctttgtagacatttgcttcacctccaccaccgtcccaaagatgctctggaacatccagacccagagcaaagtcataacctatgaggactgcatcgcacagatgaacttcttcatactcttttcagtgttggatgactttctcctgagtgtgatggcctatgaccggtttgtggccatctgtcaccccctgcactacacaatcatcatgaacccccagctctgtggactcctggttctggtgtcctggatcatgagtgttctgtattccttgttacaaaccttaatggtgttgcggctgtccttctgtacagaggtggaaatcccccactttttctgtgaactcaatcagatgatccaacttgcctgttctgacacctttcttaatgacatgatgatgtattttgcaactgtgctgctgggtggtgctcccctggctggggtcctttactcttattctaagatagtttcctccatacgtagcatctcatcagctctgggcaagtataaggcattttccatctgtgcatctcacctctcggttgtctctctattttattgtactggcctgggagtgtacctcagctctgctgctacccagagctcacactcaagtgccacagcctcggtgatgtacacagtggtcacgcccatgctgaaccccttcatctacagcctgaggaacagagacataaagggcgctctgaggagattctctgcaatggcagctataaaagggctaactgtcttgggctgaagaatttcccatga

SEQ ID NO: 2408 - protein, 311 aa, Felis catus
TQISEFFLLGLSEEPAFQPLIFGLFLSMYLITVFGNLLIILAVSSDSHLHTPMYFFLANLSFVDICFTSTTVPKMLWNIQTQSKVITYEDCIAQMNFFILFSVLDDFLLSVMAYDRFVAICHPLHYTIIMNPQLCGLLVLVSWIMSVLYSLLQTLMVLRLSFCTEVEIPHFFCELNQMIQLACSDTFLNDMMMYFATVLLGGAPLAGVLYSYSKIVSSIRSISSALGKYKAFSICASHLSVVSLFYCTGLGVYLSSAATQSSHSSATASVMYTVVTPMLNPFIYSLRNRDIKGALRRFSAMAAIKGLTVLG

SEQ ID NO: 2409 - DNA, 906 bp, Felis catus
atggcaccaggcaatgatacccaaatttcagaatttcttcttctgggattatcagatgaaccagaattacagcccctcatatttgggcttttcctctccatgtacctgatcgttgtgtttggaaacctgctcattgtcctagctgtcagctctgactcccacctccacacacccatgtacttcttcctggccaacctgtcctttgtggacatctgcttcacctctactgtcatcccaaagatgctctggaacatccagactcagagcaaagtcataacctatgcaggctgcatcacacagatgtactttttcctactctttgtagaattagacatctttctcctgactgtgatggcttacgaccgctttgtggccatctgtcaccccctgaactacatggtcatcatgaacccccggctctgtggagtgcttgttctggtgtcctggattatgtgtgccctgaattccttgttagaaagcttaatggtattgcggctgtccttctgtacagtcttggaaatcccccactttttctgtgaactcaatcagatgatccaacttgcctgttctgacacttttctcaacaacatggtgatgtattctggaattatgctgctggctggtggtccctttgttgggatactttactcgtactctaagatagtttcctccatacgtgggatctcatcatctcagggcaagtataaagcattttccacctgtgcgtctcacctctcggttgtctctctattttattgtactggcctgggagtgtacctcagctctgctgctacccagagctcccactcaagtgccacagcctcagtggtgtatacagtggtcatacccatgctgaaccccttcatctacagcctgaggaacaaagacatgaagggggctctgatg

SEQ ID NO: 2410 - protein, 302 aa, Felis catus
MAPGNDTQISEFLLLGLSDEPELQPLIFGLFLSMYLIVVFGNLLIVLAVSSDSHLHTPMYFFLANLSFVDICFTSTVIPKMLWNIQTQSKVITYAGCITQMYFFLLFVELDIFLLTVMAYDRFVAICHPLNYMVIMNPRLCGVLVLVSWIMCALNSLLESLMVLRLSFCTVLEIPHFFCELNQMIQLACSDTFLNNMVMYSGIMLLAGGPFVGILYSYSKIVSSIRGISSSQGKYKAFSTCASHLSVVSLFYCTGLGVYLSSAATQSSHSSATASVVYTVVIPMLNPFIYSLRNKDMKGALM

SEQ ID NO: 2411 - DNA, 967 bp, Felis catus
atggacccaggaaacgatacaggaatttcagaatttcttcttctgggattttcagaggaaccagaactgcagcccctcatatttgggctgttcctctccatgtacctgatcactgtgtttgggaacctgctcatcctcctggccgtcagctctgactcccacctccacacccccatgtacttcttcctggccaacctgtcctttgtagacatctgcttcacctccaccaccgtcccgaagatgcttctgaacatccagacccacagcaaggtcataacctatgcaggctgcatcacacagatgtattttttcacactctttgcaggattagacatctttctcttgactatgatggcttatgaccgctttgtggccatctgttgtcccctgaactacatggtcatcatgaacccccggctctgtgggctgctggttctggtgtcctggatcacgagtgtcctgcattccttgttacaaacttcaatggtgttgcaactgtccttctgtacagaggtggaaatcccccactttttctgtgaactcaatcagatgatccaatttgcctgttctgacacctttctcaataacatggtgatgtattttggagctatgctgctgggtggtggtcccttcattgggatcctttactcgtactataagatagtttcctccatacgtgggatctcatcagctcagggcaagtataaagcattttccacctgtgcgtctcatctctcggttgtctccttatttttttgtacgagcctaggagtgtacctcagctctgctgctacccagagctcccactcaagtgccacagcctcagtgatgtacacggtggtcacacccatgctgaaccccttcatctacagcctgaggaacagagacataaaggaggctctgatgagattctctgggatggcagctacaaaagggccaattgtcctgggctgaagaagtgacatga

SEQ ID NO: 2412 - protein, 317 aa, Felis catus
MDPGNDTGISEFLLLGFSEEPELQPLIFGLFLSMYLITVFGNLLILLAVSSDSHLHTPMYFFLANLSFVDICFTSTTVPKMLLNIQTHSKVITYAGCITQMYFFTLFAGLDIFLLTMMAYDRFVAICCPLNYMVIMNPRLCGLLVLVSWITSVLHSLLQTSMVLQLSFCTEVEIPHFFCELNQMIQFACSDTFLNNMVMYFGAMLLGGGPFIGILYSYYKIVSSIRGISSAQGKYKAFSTCASHLSVVSLFFCTSLGVYLSSAATQSSHSSATASVMYTVVTPMLNPFIYSLRNRDIKEALMRFSGMAATKGPIVLG

SEQ ID NO: 2413 - DNA, 930 bp, Felis catus
ttatgacttccctctgaaaagtaaatttagagcctcctttatgtctctgttcctcaggctgtagatgaaggggttcagcatgggcgtgaccaccgcgtacatcaccgaggctgtggcacttgagagtgagctctgggtaacagtagagctgaggtgcactcctaggctggtacaataaaataaggagacaaccgagaggtgagatgtacaggtggaaaatgccttatacctgcccagagctgatgagatcccacgtatggaggaaactatcttagaataagagtacaggatcccagccaggggagcaccacccaacagcacaactgcaaaatataccaccaagttattaagaaaggtgtcagaacaggcaagttggatcatctgattgacttcacagaaaaagtgggggatatacacgtgtgtacagaaggacagctgcaacaccattaaggtttctaacaaggaatgcaggatgttcatgatccaggacaccagagccagcagtccacagagccgggggttcatgatgaccgtgtagtgcagggggtgacagatggccacaaagcggtcataagccatcacagtcaagaggaagttgtctaaacctacaaagagtatgaaaaagtacatctgcatgatgcagctttcgtaagttatgacttttctctgtgtgtgtatattcaccagcatcttcgggactgtggtggaagtgacacagatgtctacaaaggacaggttggcaaggaagaagtacatgggcgtgtggaggtgggagtcagagtttacagccaggatgatgagcagattcccaagtatggtgaccaagtacatggacaggaacagcccaaagaggaagggttgcaactctggttcctctgaaagtcccagaagaagaaattctgaatttcgtgtatcattgcctagttccat

SEQ ID NO: 2414 - protein, 309 aa, Felis catus
MELGNDTRNSEFLLLGLSEEPELQPFLFGLFLSMYLVTILGNLLIILAVNSDSHLHTPMYFFLANLSFVDICVTSTTVPKMLVNIHTQRKVITYESCIMQMYFFILFVGLDNFLLTVMAYDRFVAICHPLHYTVIMNPRLCGLLALVSWIMNILHSLLETLMVLQLSFCTHVYIPHFFCEVNQMIQLACSDTFLNNLVVYFAVVLLGGAPLAGILYSYSKIVSSIRGISSALGRYKAFSTCTSHLSVVSLFYCTSLGVHLSSTVTQSSLSSATASVMYAVVTPMLNPFIYSLRNRDIKEALNLLFRGKS

SEQ ID NO: 2415 - DNA, 926 bp, Felis catus
agaaaccactcaaggcttccagtgtttctcctcttgggactttctgagaagccagagattcagtctgttctctttgggctgttcctgtctttgtacctggtcactgtctttggcaacctgctcatcatcctggccatcatctcacactcccacctccacacgcccatgtacttcttcctggccaacctgtccttctcggacatctgcttcacctccaccaccgtcccgaagatgctgctgaacatccagacgcagagcaaagtgattacctacgcaggctgcatcgcgcagatgtatttcttcacggtttttggacttttggacaatttactcctgactgcaatggcctatgaccgctttgtggccgtctgtcaccccctgcactacacggtcatcatgaaccctcggctttgtgcccagttactcgccctgacctggctcatcagcactttgggggcccttcctgagagtttaaccacgctgcggctctctttctgcgcagtaattgaaatcccgcactatttctgtgaactccctgaggtcctgcagctcgcctgctctgacaccttcatcaataatgttgtattatatattgtgacaggcatgatgggctttgttcctctcactgggatccttttctcttattcccgaattgtctcttctgtgctgaggatctcaacagcggggggaaagtataaagctttctccacctgcgggtctcacctctcagtggtgtccttgttctatggcacatgcctgggggtctacctcagttccacctggacacgtgcctcccagacaggggcgttcgcctcagtcctgtacaccgtggtcactcccatgatgaaccccttcatctacagcctgaggaacagggacatgaagagggccctgagaaagcttctctgtagcatgtcgtcccccca

SEQ ID NO: 2416 - protein, 309 aa, Felis catus
  MOD_RES (309)..(309): Any amino acid
RNHSRLPVFLLLGLSEKPEIQSVLFGLFLSLYLVTVFGNLLIILAIISHSHLHTPMYFFLANLSFSDICFTSTTVPKMLLNIQTQSKVITYAGCIAQMYFFTVFGLLDNLLLTAMAYDRFVAVCHPLHYTVIMNPRLCAQLLALTWLISTLGALPESLTTLRLSFCAVIEIPHYFCELPEVLQLACSDTFINNVVLYIVTGMMGFVPLTGILFSYSRIVSSVLRISTAGGKYKAFSTCGSHLSVVSLFYGTCLGVYLSSTWTRASQTGAFASVLYTVVTPMMNPFIYSLRNRDMKRALRKLLCSMSSPX

SEQ ID NO: 2417 - DNA, 930 bp, Felis catus
atggaaagaggaaaccaaacaggagctggacactttctcctcctgggattcacagagaagcctttcttctttgggctgtttctgtccatgtacctggtcacgttcactgggaacctgctcctcatcctggccgtcagctctgactcccacctccacacccccatgtacttcttcctggccaacctgtcctttgtagacatctgcttcacctccaccaccgtcccgaagatgctctggaacatccagacgcagagaaaacttatcacctgtgcaggctgcctcagccagatattttttttcatcgtgtttggatgcctggacaatttactcctgaccgcgatggcctatgaccgctttgtggccatctgtcaccccctgcactacatggtcatcatgaacccccagctctgtaggctgctggccgtggggtcctggtgcatcagtgtcatgggctccctgctcgagaccttgacccttttgaggctgtccttctgcacaaacatgaaaatcccacactttttttgtgatcttcccgaagtcctgaagcttgcctgttctgacaccttcgtcaataccatggtggtgtattttgtgactattgtcctaggtgtttttcctctctctgggatcctcttttcttattctaagattttctcctccatcctgaaaatttcatcagccaggggcaagtacaaagccttttccacgtgtgggtctcacctctcggtggtctccttgttctatggcacgggcctcggggtctacctcagttctgcagcgacttcatcctctaggacaagtctggtggcctcagtgatgtacacgattgtcacccccatgctgaatcccttcatctacagtctgaggaacagggacatgaagggggccctggggagactcctcagcagggcagtgcctctcagtgttggg

SEQ ID NO: 2418 - protein, 310 aa, Felis catus
MERGNQTGAGHFLLLGFTEKPFFFGLFLSMYLVTFTGNLLLILAVSSDSHLHTPMYFFLANLSFVDICFTSTTVPKMLWNIQTQRKLITCAGCLSQIFFFIVFGCLDNLLLTAMAYDRFVAICHPLHYMVIMNPQLCRLLAVGSWCISVMGSLLETLTLLRLSFCTNMKIPHFFCDLPEVLKLACSDTFVNTMVVYFVTIVLGVFPLSGILFSYSKIFSSILKISSARGKYKAFSTCGSHLSVVSLFYGTGLGVYLSSAATSSSRTSLVASVMYTIVTPMLNPFIYSLRNRDMKGALGRLLSRAVPLSVG

SEQ ID NO: 2419 - DNA, 936 bp, Felis catus
atggaaccaaaacaccaaaaaaatgaaacagcagtctcagaatttcttctttggggactctcagaaaggccagagcatcagatgctcctctttgggtgttcctctccatgtacctgatcactgtgggaacctcctcatcatcttggccatcatcacagactcccacttccacgcgcccatgtacttcttcctctccaacctgtcccttgtcgatatttcttctcttccaccactgtcccaagatgctggtgaaccttcgcacccagagccgggccatctcctttgtgggcggccttgctcagatgtatgccttccacctgttcaggaccatggacagcttcctcctggccttgatggccattgaccactttgtggcaattgtccaccctctacactattcagtcatcatgagcccttgtgtctgtgggttgctggttgggggaggccatggctgatcaccagtctccagtcactcatgcacacctccctcatggttcaactgaccttctgttctggctccgaaatcccccacttcttctgtgatctcatgcccctgctgaagctctcctgctctgacatgcacaacagtgagctggtggtttttgcttttggcatcatcatgggcatcagtcccctctcctgcatccacctgctttttctgggcagtcttcaagatcccttctgctcagggcaagtggaaagccttctccacttgtggctcacacctcaccacagtgtcactgttctatggcaccgtctgggccatgtactttgcagcccacatctgccgcttcctcccagaaggacaaggcagctgccctgatgtgtggggtgctcatccccatgctgagcccctttatatacagtctaaggaacaaggacatgaaggcagccctgaggaggttcatcagcaaagcagtctcctgtcagtgctag

SEQ ID NO: 2420 - protein, 120 aa, Felis catus
WNQNTKKMKQQSQNFFFGDSQKGQSIRCSSLGVPLHVPDHCGNLLIILAIITDSHFHAPMYFFLSNLSLVDISSLPPLSQDAGEPSHPEPGHLLCGRPCSDVCLPPVQDHGQLPPGLDGH

SEQ ID NO: 2421 - DNA, 936 bp, Felis catus
atggagaatcagacgtgagtcttcgaattcatcctcctcggcctctccgagcagcccctacagcagcaggtgctcattggtgtgtcctgcagcctgtatctgatcggatgcatggggaatctgctcaccatcctggccatcctcttggaccctcacctccacagccccatgtacttcttcctcagcaacttgtctcttctggacatctgttttacctccaccaccgtccccaagatgctggtgaactatctgtgcagacacagcaccatctccccccaggcttgcctggcacagatgtatttcttcattgcctttggggcagcggaaagcatccttctctcagtcatggcttatgaccgctacctggccatctgctgcccgctgcgctacatgacgatcatgaacgtccttcgttgtgccttgctagtgaccgtgccctggacctcggcaaacctcatctccatggtccataccatcctgatgacccgcttgtccttttgcaccaataggaccccacactttttctgtgacattaatgccttgatcaagctttcctgctccaacgcgcaagtcaacgagatgttgatgctggtccttgggggttcggtggttctgatgtcttttgtgtgtatcacggcctcttatacacctattgctgtggctgtgtggaaggtgccctcagcccaggggaagtggaaagctttctctacctgtagctgtcacctttgtgtcatctctctcttctatgggactattattggggtctacttcaaccctgcatccacacacaccacccagagggacatggtagccacagtgatgtatgccatggtcacccccatgctgaaccccttcatctacagccttcggaaccgcgatctgaagggtgccctcaggaaacttcttaaaggaaacctcttggctaagcctctttga

SEQ ID NO: 2422 - protein, 117 aa, Felis catus
GESDVSLRIHPPRPLRAAPTAAGAHWCVLQPVSDRMHGESAHHPGHPLGPSPPQPHVLLPQQLVSSGHLFYLHHRPQDAGELSVQTQHHLPPGLPGTDVFLHCLWGSGKHPSLSHGL

SEQ ID NO: 2423 - DNA, 950 bp, Felis catus
atggccgccacgctgggccgaaaccacagctccgtgtctgaattcatcctcgtgggcttctccaccttcccaaggcatctcctgcccgccttcttcctgctgttcctgctcatgtacctgttcacgctgctggggaacctgctcatcatgaccacagtctggagtgagcgcagcctgcacacgcccatgtacctcttcctgtgcgccctgtccacctctgagatcctctacaccttggccatcaccccgcgcctgctggccgacctgctctccacccgccgcaccatcacctgggcggcctgtgccagccagatgtttttctccttcacgttcggcttcacccactccttcctgctcaccgtcatgggctatgaccgctacgtggccatctgccaccccctgcgctacaatgtgctcatgagcccccgcggctgcgcctgcctggtggcctggtcctgggtaggtggctcggtcatggggctgttggtgaccacggccgttttccacctcaccttctgtggacccaatgagatccaccattttttctgccacgtgcctcctgtggtgaagctggcctgtggaactgatgtaccagtagtggccaagggcgtggggctggtgtgcatcatggccctgctgggctgctgtctcctcatcctcctctcctatgccttcattgtggccgccatcttgaggatcccctcagctgagggccggcacaaggccttctccacctgtgcatcccacctcactgtggtcattgtgcactacggctttgcctctgtcatctatctgaagcccaagggtccccagtctctggaaggagacaccctgatgggcatcacctacacagtcctcacccccttcctcagccccatcatcttcagtctcaggaacaaggagctgaagactgccatgaccaagaccttcctcaacaaactctacccaga

SEQ ID NO: 2424 - protein, 317 aa, Felis catus
  MOD_RES (317)..(317): Any amino acid
MAATLGRNHSSVSEFILVGFSTFPRHLLPAFFLLFLLMYLFTLLGNLLIMTTVWSERSLHTPMYLFLCALSTSEILYTLAITPRLLADLLSTRRTITWAACASQMFFSFTFGFTHSFLLTVMGYDRYVAICHPLRYNVLMSPRGCACLVAWSWVGGSVMGLLVTTAVFHLTFCGPNEIHHFFCHVPPVVKLACGTDVPVVAKGVGLVCIMALLGCCLLILLSYAFIVAAILRIPSAEGRHKAFSTCASHLTVVIVHYGFASVIYLKPKGPQSLEGDTLMGITYTVLTPFLSPIIFSLRNKELKTAMTKTFLNKLYPX

SEQ ID NO: 2425 - DNA, 1021 bp, Felis catus
tcaggagcttagaggaatgagttttctctggatgcttttctttatagcattcttgagctccttattcctgagactgaaaatgatcggactgagaaagggagtgaagactgtataggtggtggccatcagggtattactgtccatagaatgggggcctttgggcttgaggtagataatggaggcaaagccatagtgcacaatgaccacagtgaggtgggacacacatgtggagaaagtcttgtgcctgccttcagcagaggggatccgcaatatggcggccacgatgaagacataggagaggacgatgaggaataaacagcccatcagagctgagacacacaccaggatcacacccaaggtgacggaggaattctcattcccacaggccaactttagaagggaaaacacatggcagaaaaaatggcggatcatgttagatccacagaaggtgaggtgaaaaactatcagggtcaccatcatccccatgactgagccaccagcccaggtccaggacacaaggcgggcacagccacggttgctcatgagcacatggtagcgcagggggtggcagatggccacgtagcggtcgtagcccatgatcatgagcaggaaggagtgtgtgaagccaaacgtgaaggagaaaaacatctggctggcacaggccgcccaggtgatggtgcggtgggtgaagagcatgtcaaccagcatgcgaggggtgatggcaacggtgaacagaatctcggaggtggacagggcgcacaggaagaggtacatgggtgtgtgcaggctgcgctcgctccagactgtggtcatgatgagcaggttccccagcagcgtgaacaggtacatgagcaggtacagcaggaagaaggcgggcaggagatgctgtgggaaggtggagaagcccacgaggatgaactcagtcatcatgctatagttctgaccagccatgggtgctgcatctggtgagatcagaaagggaatgaaggttcgtaatttatcccatgaataacaaggttga

SEQ ID NO: 2426 - protein, 316 aa, Felis catus
MAGQNYSMMTEFILVGFSTFPQHLLPAFFLLYLLMYLFTLLGNLLIMTTVWSERSLHTPMYLFLCALSTSEILFTVAITPRMLVDMLFTHRTITWAACASQMFFSFTFGFTHSFLLMIMGYDRYVAICHPLRYHVLMSNRGCARLVSWTWAGGSVMGMMVTLIVFHLTFCGSNMIRHFFCHVFSLLKLACGNENSSVTLGVILVCVSALMGCLFLIVLSYVFIVAAILRIPSAEGRHKTFSTCVSHLTVVIVHYGFASIIYLKPKGPHSMDSNTLMATTYTVFTPFLSPIIFSLRNKELKNAIKKSIQRKLIPLSS

SEQ ID NO: 2427 - DNA, 679 bp, Felis catus
tggaagcttctcattatggcattcttgagctccttattcctgaggctgaaatgatcaggctgagaaaggggtgaagactatataggtggtggccatcagggtgttactgtccatagaatgggggcccttggacttgaggtagataatggaggcaaagccgtagtgcacaatgaccacagtgaggtgggacacacacgtggagaaagtcttgtgcctgccttcagcagaagggatccgcaatatggcggccacgatgaagacataggagaggatgatgaggaataaacagcccatcagagctgagacacacaccaggatcacagccaaggtgacggaggctgtttctttcccacaggccaatttcaaaagggaaaacacatggcatagaaaatggtggatcacattagacccacagaaggtgaggtgaaaaactatcagggtcaccatcatccccatgatcgagccaccagcccaggaccaggacacgaggcgggcacagccacgggggctcatgagcacattgtagcgcagggggtggcagatggccacgtagcggtcatagcccatgatcacgagcaggaaggagtgggtgaagccaaacgtgaaggagaaaaacatctggctggcacaggccgtccaagtgatggtgcggtgggtggagagcaggtcggccagcatg

SEQ ID NO: 2428 - protein, 207 aa, Felis catus
MLADLLSTHRTITWTACASQMFFSFTFGFTHSFLLVIMGYDRYVAICHPLRYNVLMSPRGCARLVSWSWAGGSIMGMMVTLIVFHLTFCGSNVIHHFLCHVFSLLKLACGKETASVTLAVILVCVSALMGCLFLIILSYVFIVAAILRIPSAEGRHKTFSTCVSHLTVVIVHYGFASIIYLKSKGPHSMDSNTLMATTYIVFTPFSA

SEQ ID NO: 2429 - DNA, 1031 bp, Felis catus
tcaggagcttaagggactgaattttctctggaagcttttctttatggcattcttgagctccttattcctgaggctgaaaatgatcggactgagaaagggggtgaagactatataggtggtagccatcagggtgttactgtccatagaatgggggcccttgggcttgaggtagataatggaggcaaagccatagtgcacaatgaccacagtgaggtgggacacacacgtggagaaggtcttgtgcctgccctcagcagaggggatccgcaatatggcggccacgatgaagacataggagaggacaatgaggaataagcagcccatcagagctgagacacatactaggatcacacccaaggtgacagaggatgtctccttcccacaggtcaactttagaagggaaagcacgtggcaggcaaaatggtggatcacattagacccacagaaggtgaggtgaaaaactatcagcgtcaacattatccccatgactgagccaccaacccagaaccaagacacaaggcgggcacagccacggttgctcatgagcacattgtagcgcagggggtggcagatggccacgtagcggtcgtagcccatgatcatgagcaggaaggagtgtgtgaagccaaacgtgaaggagaaaaacatctggctggcacaggccatccaggtgatggtgcggtgggtggagagcatgtcaaccagcatgcgaggggtgacggcaacggtgaacagaatctcggaggtagacagggcgcaaaggaagaggtacatgggcgtgtgcaggctgcgctcgctccagaccgtggccatgatgagcaggttccccagcagcgtgaacaggtacatgagcaggtacagcaggaagaaagcaggcaggagatgccgtgggaagttagagaatcccacaaggatgaactcagtcaccacgctgtagttctgaccaggcacgggtgctgcatctggtgagatcagaaagggaatgaaggtgcgtaatttatcccatgaataacaaagatgattcagtgtca

SEQ ID NO: 2430 - protein, 342 aa, Felis catus
TLNHLCYSWDKLRTFIPFLISPDAAPVPGQNYSVVTEFILVGFSNFPRHLLPAFFLLYLLMYLFTLLGNLLIMATVWSERSLHTPMYLFLCALSTSEILFTVAVTPRMLVDMLSTHRTITWMACASQMFFSFTFGFTHSFLLMIMGYDRYVAICHPLRYNVLMSNRGCARLVSWFWVGGSVMGIMLTLIVFHLTFCGSNVIHHFACHVLSLLKLTCGKETSSVTLGVILVCVSALMGCLFLIVLSYVFIVAAILRIPSAEGRHKTFSTCVSHLTVVIVHYGFASIIYLKPKGPHSMDSNTLMATTYIVFTPFLSPIIFSLRNKELKNAIKKSFQRKFSPLSS

SEQ ID NO: 2431 - DNA, 988 bp, Felis catus
cttcattccccttctgatctcaccagatgcagcacccatggctggtcagaactacagcatggtgactgagttcatcctcgtgggattctctaacttcccacggcatcttctgcccgccttcttcctgctgtacctgctcatgtacctgttcacgctgctggggaacctgctcatcatggccacagtctggagcgagcgcagcctgcacacgcccatgtacctcttcctgtgcgccctgtccacctccgaaattctgttcaccgttgccatcacccctcgcatgctggttgacatgctctccacccaccacaccatcacctgggcggcctgtgccagccagatgtttttctccttcacgtttggcttcacacactccttcctgctcatgatcatgggctacgaccgctatgtggccatctgccaccccctgcgctacaatgtgctcatgagcccccgtggctgtgcccgccttgtgtcctggtcctgggccggtggctcagtaatagggatgatgtcgaccctgatagtttttcacctcaccttctgtgggtgtaatgtgatccaccattttctatgccatgtgttttccctcttgaaattggcctgtgggaaagaaacagcctccgtcaccttggctgtgatcctggtgtgtgtctcagctctgatgggctgcttattcctcatcgtcctctcctatgtcttcattgtggccgccatattgcggatcccctctgctgagggcaggcacaagaccttctccacatgtgtgtcccacctcacggtggtcattgtgcactacagttttgcctccattatctacctcaagcccaagggcccccattctatggacagtaacaccctgatggccaccacctatatagtcttcaccccctttctcagcccaatcattttcagcctcagaaataaggaactcaagaatgccataaagaaaagcttccagagaaaattcagtctcctaagctcctga

SEQ ID NO: 2432 - protein, 316 aa, Felis catus
MAGQNYSMVTEFILVGFSNFPRHLLPAFFLLYLLMYLFTLLGNLLIMATVWSERSLHTPMYLFLCALSTSEILFTVAITPRMLVDMLSTHHTITWAACASQMFFSFTFGFTHSFLLMIMGYDRYVAICHPLRYNVLMSPRGCARLVSWSWAGGSVIGMMSTLIVFHLTFCGCNVIHHFLCHVFSLLKLACGKETASVTLAVILVCVSALMGCLFLIVLSYVFIVAAILRIPSAEGRHKTFSTCVSHLTVVIVHYSFASIIYLKPKGPHSMDSNTLMATTYIVFTPFLSPIIFSLRNKELKNAIKKSFQRKFSLLSS

SEQ ID NO: 2433 - DNA, 960 bp, Felis catus
ttagatgctggagggatgaagttttctgaggaaggtcttggtcatggctgtcttcagctccttgttcctgagactgaagatgatggggctgaggaagggggtgaggaccgtgtaggtgatggccatcagggtgtctctttccagatactggggacccttgggcttgaggtagacgacagaggcaaagccatagtgcacaatgaccacagtgaggtgggacgcacaggtggagaaggccttgtgccggccctcagctgaggggatcctcaagatggtggccacaatgaaggcataggagaggaggatgaggagacagcagcccagcagggccatgatgcacaccagccccacgcccttggccactgctggtacatcagttccacaggccagcttcaagagagggggcacatgacataaaaaatggtggatctcattgggtccacagaaggtgaggtggaaaacggccgtggtcaccaccagccccgtgaccgagccacctacccaggaccaggccaccaggcaggcgcagccgcgggggctcatgagcacattgtagcgcagggggtggcagatggccacgtagcggtcgtagcccatgacggtgagcaggaaggagtgggtgaagccgaacgtgaaggagaaaaacatctggctggcacaggccgcccaggtgatggtgtggcgggtggagagcaggtcggccagcaggcgcggggtgatggccaaggtgtagaggatctcggaggtggacagggcacacaggaagaggtacatgggcgtgtgcaggctgcgctcactccagactgtggtcatgatgagcaggttccccagcagcgtgaacaggtacatgagcaggaacagcaggaagaaggcgggcaggagatgccttgggaaggtggagaagcccacgaggatgaattcggacacggagctgtggtttcggcccagcgtggcagccat

SEQ ID NO: 2434 - protein, 319 aa, Felis catus
MAATLGRNHSSVSEFILVGFSTFPRHLLPAFFLLFLLMYLFTLLGNLLIMTTVWSERSLHTPMYLFLCALSTSEILYTLAITPRLLADLLSTRHTITWAACASQMFFSFTFGFTHSFLLTVMGYDRYVAICHPLRYNVLMSPRGCACLVAWSWVGGSVTGLVVTTAVFHLTFCGPNEIHHFLCHVPPLLKLACGTDVPAVAKGVGLVCIMALLGCCLLILLSYAFIVATILRIPSAEGRHKAFSTCASHLTVVIVHYGFASVVYLKPKGPQYLERDTLMAITYTVLTPFLSPIIFSLRNKELKTAMTKTFLRKLHPSSI

SEQ ID NO: 2435 - DNA, 988 bp, Felis catus
tcaggagcttaaaggactgaattttctctggaagcttttctttatggcgttcttgagctccttattcctgagactgaaaatgatcgggctgagaaagggggtgaagactgtataggtggtggccatcagggtgttactgtccatagaatgggggcccttgggcttgaggtagataatggaggcaaagccgtagtgcacaatgaccactgtgaggtgggacacacacgtggagaaggtcttgtgcctgccctcagcagaggggatccgcaatatggcagccacaatgaagacataggagaggacgatgaggaataaacagcccatcagagctgagacacacaccaggatcacacccaaggtgacagaggaattctcattcccacaggccaactttagaagggaaagcacgtggcagacaaaatggtggatcacattagacccacagaaggtgaggtgaaaaactatcagggtcaacatcattcccatgactgagccaccggcccaggacaaggacacaaagcgggcacagccacgggggctcatgagcacattgtagcgcagggggtggcagatggccacgtagcggtcatagcccatgatcatgagcaggaaggagtgtgtgaagccaaacgtgaaggagaaaaacatctggctggcacaggccgtccaggtgatggtgcggtgggtggagagcatgtcaaccagcatgcgaggggtgacagcaacggtgaacagaatctcggaggtggacagggcgcacaggaagaggtacatgggcgtgtgcaggctgcgttcgctccagactgtggtcatgatgagcaggttccccagcagcgtgaacaggtacatgagcaggtacagcaagaagaaggtgggcagaagatgccttgggaagttagagaatcccacaaggatgaactcagtcaccatgctatagttctgaccagccatgggtgctacatctggtgagatcagaaggggaatgaag

SEQ ID NO: 2436 - protein, 316 aa, Felis catus
MAGQNYSMVTEFILVGFSNFPRHLLPTFFLLYLLMYLFTLLGNLLIMTTVWSERSLHTPMYLFLCALSTSEILFTVAVTPRMLVDMLSTHRTITWTACASQMFFSFTFGFTHSFLLMIMGYDRYVAICHPLRYNVLMSPRGCARFVSLSWAGGSVMGMMLTLIVFHLTFCGSNVIHHFVCHVLSLLKLACGNENSSVTLGVILVCVSALMGCLFLIVLSYVFIVAAILRIPSAEGRHKTFSTCVSHLTVVIVHYGFASIIYLKPKGPHSMDSNTLMATTYTVFTPFLSPIIFSLRNKELKNAIKKSFQRKFSPLSS

SEQ ID NO: 2437 - DNA, 914 bp, Felis catus
aatcagtcagtgacctcagacttcactctcatggggctcttgagccactcggggccacatctggtcctattctcccttgtggctgtcatattcactatgggccttctgggaaacatcatcctgctcttcctgatccacacagactccaggctccacacacccatgtacttcctgctcagtcaactctccttattggatgttggctttctactggtcaccatccccaagatggcagccaacttcctgcagggagagggttccatctcctttgggggttgtgcagctcagatgttcttcctgatgctgatgggtgtctctgagggtgtcctgctatccctcatgtcttacgaccgctatgttgctgtgtgccaccccctgcattatcctgtactcatgagacgtcaggtctgcctgctcatggtgggcacctcctggttgtcaggtgtgctcgtggcctccatccagacctccatcaccctgcacttcccctactgtgcctcacacactgtggatcacttcttctgtgagctaccggctctgctgaagctctcttgtgcagacacctctgcttatgagttgtcgctgtccatctcaggagtgctgatcttgcttcttcccctgtcactcatcaccacctcctacagccatgtgttgagggccgttctctgcatgcactcagcagagacccgacacaaggccttcaccacctgttcctctcacatcactgttgtggggctcttttatggggcagccatgttcatgtacatggttccaggcacctaccacagcccacagcaagacaatgtggtctccctcttctatagccttgtcacccccacactcaaccccctcatctatagcctgagaaacagagaggttcaaatggctttggtcaaggttcttggcagaactgg

SEQ ID NO: 2438 - protein, 305 aa, Felis catus
NQSVTSDFTLMGLLSHSGPHLVLFSLVAVIFTMGLLGNIILLFLIHTDSRLHTPMYFLLSQLSLLDVGFLLVTIPKMAANFLQGEGSISFGGCAAQMFFLMLMGVSEGVLLSLMSYDRYVAVCHPLHYPVLMRRQVCLLMVGTSWLSGVLVASIQTSITLHFPYCASHTVDHFFCELPALLKLSCADTSAYELSLSISGVLILLLPLSLITTSYSHVLRAVLCMHSAETRHKAFTTCSSHITVVGLFYGAAMFMYMVPGTYHSPQQDNVVSLFYSLVTPTLNPLIYSLRNREVQMALVKVLGRTG

SEQ ID NO: 2439 - DNA, 919 bp, Felis catus
gtctctgagttcctgctcctgggcctctcggggaactgaaagcaacagcagctgctcctcatactcttcctgagcatgtccctggtcacaggactggggaacctgttcatcgtcctggccatcgccaccgactcccaactccacacgcccatgtacttcttcctggctaagctggcctttgtggacatttgcttcacctccaccaccattcccaagatgctggccaacctcgtgttaggacacaaagggatcccttaatgcaggctgcctgacccagatcttcttcttcatctggtttgctggcatcgatagcttccttctgatggccatggcctatgaccgctatgcggccatctgtcaccctctgcactacgctgtgtctgtgatgccacacctctgtggcctcctggtggctgcatcctggactgcagccttcgggaacgccctgacccacacagtattactgactcgcctcttgttctgcacccacaaccaggttccccatctcttttgtgacctcagccctctgctgaagctggcctgctctggcacctttctcaataatgcaatgttgtacaccgggggcaccctacccatcatcaccccctttgtgggtatcttggtctcctacacacgcatctttgcctccgtgctgaggatcccatccacgagaggcaagcagaaggctttctccacctgtggctctcacctctctgtggtgtccctgtcctatgggacactcatcagggtttatttcagccctatgtcctcccacacagcccagaaggacacggccgctgcagtgatgtacgtggtggtcactcccatgctgaaccccttcatgtacagcctacgcaacagtgacaggatgggtgctttgggggccctcatcggtaggaagccagtgtttattcagtga

SEQ ID NO: 2440 - protein, 198 aa, Felis catus
MAMAYDRYAAICHPLHYAVSVMPHLCGLLVAASWTAAFGNALTHTVLLTRLLFCTHNQVPHLFCDLSPLLKLACSGTFLNNAMLYTGGTLPIITPFVGILVSYTRIFASVLRIPSTRGKQKAFSTCGSHLSVVSLSYGTLIRVYFSPMSSHTAQKDTAAAVMYVVVTPMLNPFMYSLRNSDRMGALGALIGRKPVFIQ

SEQ ID NO: 2441 - DNA, 924 bp, Felis catus
atgttggagagtcactctagtgccactgacttctatctcataggcttccctggatccccagaattatgccatattctatttgctaccttcttcttcttctgtttggtgactcatggggaacatgttcatccttgtgattgtctgtgttgataaatgtttgcagtccctcatgtatttcttccttggccacctctctgtcctagaaatcttgctcatatctactgctgttcccttggtgctctgcaggttgctgcttcctgggatgcagacaatatctttgacaacatgtggtgcacaattatatttgtacctttctttgggcacgtcggaattcatattaatgggagtgatggctgtagaccgttatgtggctgtctgtaaccctttgaggtacaacatcattatggacagccacacctgcatctggatggttattgtgtcatgggtgttttggtttctatttcaaatctggccagtctatgccatgtttcagcttaccttctgcaaatcaaatgtgatagaccatttttttatgtgaccgagggcaattgtttgaactatcctgtgatgacagccatttcacacagtttattcttttttaaatggctgttttcattatcattggtgctttgatcctacagtcatctcctacacctacatcatctccaccatcctcaagatcccctcagcctcgggccggagcaaagccttccctacgtgtgcctctcacttcacatttgttgtgatcggctgtggcacctgcttgttcctctatgtgaaacccaagcaaatgcaggcagcttgagtacaacagggtagcgtcactgatggttttagtggtgacccctttcctgaacccattcatcttcaccctccggaatgacaaattcatagaggcctttcgagatgtcatgaaacgctgct

SEQ ID NO: 2442 - protein, 78 aa, Felis catus
QRFMTSRKASMNLSFRRVKMNGFRKGVTTKTISDATLLYSSCLHLLGFHIEEQAGATADHNKCEVRGTRREGFAPARG

SEQ ID NO: 2443 - DNA, 945 bp, Felis catus
atgttgaagaattattctagcgccactgaattttatctacttggcttccatggctccaaagaactacacgatattctttttgccactttcttctttctctactcagtgacagtcatggggaacatggtcatcattgtgattgtctgtgttgataaacgtctgcagtcccccatgtatttcttccttggccacctctcagtcctagagatcctgatcacatcggttgctgtccccttaatgctctgggggctgctgcttccagggatgcaggcaatgtctttgacagcctgtagtgcacaattatatttgtacctctctttgggtacgtcggagttagtattaattggagcaatggctgtggaccgttatgtggctgtctgtaaccctctgaggtacaacatcattatggacagccacacctgcatctgggtggtcattgtgtcatgggtgtttgggttcctatttcaaatctggccagtctatgccacatttcagcttaccttctgcaaatcaaatgtgatagaccattttttatgtgaccgagggcaactgctcaaactatcctgtgatgatagccttttcacagagtttatccttttcttaatggctgtattcattattgttggttctatgatccctacaatcatctcctacacctacatcatctctaccatcctcaagatcccctcagccttgggccggaggaaagctttctctacttgtgcctctcacttcacctttgttgtgattggctatggtacctgcttgttcctctatgtgaaacccaagcaaacgcaggcagctgagtacaacagggtagcgtcactgatggttttagtggtgacccctttcctgaacccattcatcttcacccttcggaatgacaaattcatagaggcctttcgagatgtcatgaaacgctgctatcaactcctcaaggattag

SEQ ID NO: 2444 - protein, 314 aa, Felis catus
MLKNYSSATEFYLLGFHGSKELHDILFATFFFLYSVTVMGNMVIIVIVCVDKRLQSPMYFFLGHLSVLEILITSVAVPLMLWGLLLPGMQAMSLTACSAQLYLYLSLGTSELVLIGAMAVDRYVAVCNPLRYNIIMDSHTCIWVVIVSWVFGFLFQIWPVYATFQLTFCKSNVIDHFLCDRGQLLKLSCDDSLFTEFILFLMAVFIIVGSMIPTIISYTYIISTILKIPSALGRRKAFSTCASHFTFVVIGYGTCLFLYVKPKQTQAAEYNRVASLMVLVVTPFLNPFIFTLRNDKFIEAFRDVMKRCYQLLKD

SEQ ID NO: 2445 - DNA, 945 bp, Felis catus
atgttggggaatcactctagtgccactgaattttatctccttggcttccctggctcccgagaactacatcatattctctttgctatcttcttcttcttctactcagtgacattaatgggaaacatggtcatcattgtgattgtctgtgtggacagacgtctgcagtcccccatgtatttcttccttggtcatctctctgccttggagatcttggttactactaatatcgtgcccatgatgctttgggggctgctgctccctgggatgcagacaatatctctggctgcatgtgtcacccagctcttcctgtacctttctttggggaccacagagtttgcattactgggagcgatggctgtggaccgttacgtggctgtctgtaaccctctgaggtacgacatcattatgaacagccgcacctgcatctgggtggtcattatgtcatgggtgtttgggttcctttctgaaatctggccaatttatgccacatttcagcttaccttctgcaaatcaaatgtggtgaacaatttcttctgtgaccgagggcaattgctcaatctatcctgcaataatacccttttcatagagtttgtcctattcttaatggctgtttttattctttttggttctcttatccctacaatcatctcctacacctatatcatctccactatcatcaagattccctcagtctctggccggaggaaagccttctctacttgtgcatcccacttcacttgtgttgtgatcggctatgggacctgcttgttcctctatgtgaaacccaagcaaacgcaggcagctgagtacaacagggtagcgtcactgatggttttagtggtgaccccttttctaaacccatttatcttcaccctacggaatgaaaaattcatagaggtctttcgagatgtcatgaaacgctgctctcaactcctcaagggttag

SEQ ID NO: 2446 - protein, 314 aa, Felis catus
MLGNHSSATEFYLLGFPGSRELHHILFAIFFFFYSVTLMGNMVIIVIVCVDRRLQSPMYFFLGHLSALEILVTTNIVPMMLWGLLLPGMQTISLAACVTQLFLYLSLGTTEFALLGAMAVDRYVAVCNPLRYDIIMNSRTCIWVVIMSWVFGFLSEIWPIYATFQLTFCKSNVVNNFFCDRGQLLNLSCNNTLFIEFVLFLMAVFILFGSLIPTIISYTYIISTIIKIPSVSGRRKAFSTCASHFTCVVIGYGTCLFLYVKPKQTQAAEYNRVASLMVLVVTPFLNPFIFTLRNEKFIEVFRDVMKRCSQLLKG

SEQ ID NO: 2447 - DNA, 945 bp, Felis catus
atgttggggaatcactctagtgccactgaattttatctccttggcttccctggctcccgagaactacatcatattctctttgctatcttcttcttcttctactcagtgacattaatgggaaacatggtcatcattgtgattgtctgtgtggacagacgtctgcagtcccccatgtatttcttccttggtcatctctctgccttggagatcttggttacaactattatcgtgcccatgatgctttgggggctgctgctccctgggatgcagacaatatctctggctgcatgtgtcacccagctcttcctgtacctttctttggggaccacagagtttgcattactgggagcgatggctgtggaccgttacgtggctgtctgtaaccctctgaggtacgacatcattatgaacagccgcacctgcatctgggtggtcattatgtcatgggtgtttgggttcctttttcaaatctggccagtttatgccacatttcagcttaccttctgcaaatcaaatgtggtgaacaatttcttctgtgaccgagggcaattgctcaaactgtcctgcaacaataccctttttattgagttcatcctgttcttaatggctgtttttgttctttttggttctcttatccctacagtcatctcgtacagctatatcatctccacaatcctcaggatcccctcagcctctggccggaggaaagccttttctacatgtgcctctcacttcacatgtgtcgtgattgggtacggcagttgcttgttcctctatgtgaaacccaagcaaactcaagcagctgattacaatagggtggtgtccttgatggtttcagtagttactcctttcctcaatcccttcatcttcaccctccgaaatgacaaagtcatagaagcccttcgggacggagcaaagcactggtgtcaactattcaggaattag

SEQ ID NO: 2448 - protein, 314 aa, Felis catus
MLGNHSSATEFYLLGFPGSRELHHILFAIFFFFYSVTLMGNMVIIVIVCVDRRLQSPMYFFLGHLSALEILVTTIIVPMMLWGLLLPGMQTISLAACVTQLFLYLSLGTTEFALLGAMAVDRYVAVCNPLRYDIIMNSRTCIWVVIMSWVFGFLFQIWPVYATFQLTFCKSNVVNNFFCDRGQLLKLSCNNTLFIEFILFLMAVFVLFGSLIPTVISYSYIISTILRIPSASGRRKAFSTCASHFTCVVIGYGSCLFLYVKPKQTQAADYNRVVSLMVSVVTPFLNPFIFTLRNDKVIEALRDGAKHWCQLFRN

SEQ ID NO: 2449 - DNA, 917 bp, Felis catus
agtcgacagcagcgtttcataccatcccgaagggcctctttgactttgtcattccgcagggtgaagatgaaagggttcaggaaaggggttaccacagaaataaacagggaaactatcttgttgtactcagcagcctgtgtttgcttaggttttacaaacaggaacaagcagcttccatagccaatcacaacaaagataaagtgagaggcacacgtagagaaggctttcctccggcccgaggctgtggggatcttgaggatggtagagatgatgtaggtgtaggagactattgttggggccagcgaaccaatgataatgacaacagccattaagaagagaacaaactctgtgaaaagagtgtcaccacaggatagtttgagcagttgccctcggtcacagaaaaaatggtctaacagatttgacttgcagaaggtaaactgaaatgtggcatagactggccatatttcagagaggaacccaaacacccatgacacaatgaccacccagatgcaggtgtggctgttcataatgatgttgtacctcaaagggttacagacagccacgtaacgatccacagccatcgctcccagtaatgcgaactctgtggtccccacagcaaggtacaggaagagctgggtgacacatgcagccagagatattgtctgcatcccagggagcatcaatccccaaagcatcacaggcacaataatagttgtaaccaatatctccaaggcagagagatgaccaaggaagaaatacataggggaccgcagacgtttatccacacagacaatcacgatgatgactgtgtttcccattaacgttgctgagtagaagaaaaagaatatggcaaaaagagtgtggtgtagttcttgggacccgggaaagcctagaaggcagaactcagtggcaccaga

SEQ ID NO: 2450 - protein, 306 aa, Felis catus
SGATEFCLLGFPGSQELHHTLFAIFFFFYSATLMGNTVIIVIVCVDKRLRSPMYFFLGHLSALEILVTTIIVPVMLWGLMLPGMQTISLAACVTQLFLYLAVGTTEFALLGAMAVDRYVAVCNPLRYNIIMNSHTCIWVVIVSWVFGFLSEIWPVYATFQFTFCKSNLLDHFFCDRGQLLKLSCGDTLFTEFVLFLMAVVIIIGSLAPTIVSYTYIISTILKIPTASGRRKAFSTCASHFIFVVIGYGSCLFLFVKPKQTQAAEYNKIVSLFISVVTPFLNPFIFTLRNDKVKEALRDGMKRCCRL

SEQ ID NO: 2451 - DNA, 925 bp, Felis catus
agcagcgtttcataccatcccgaagggcctctttgactttgtcattccgcagggtgaagatgaaagggttcaggaaaggggttaccacagaaataaacagggaaactatcttgttgtactcagcagcctgtgtttgcttaggtttcacatagaggaacaagcaactgccatagccgatcacaacaaaggtgaagtgagaagcacacgtagagaaggctttcctccggcccgaggctgtggggatcttgaggatggtagagatgatgtaggtgtaggagactattgttggggtcagtgaaccaatgataatgacaacagccattaagaagagaacaaactctgtgaaaagagtgtcaccacaggatagtttgagcagttgcccgcgttcacaaaaatagtggtctaacagatttgacttgcagaaggtaaactgaaatgtggcatagactggccatatttcacagaggaacccaaacacccatgacacaatgaccacccagatgcaggtgtggctgttcataatgatgttgtacctcaaagggttacagacagccacgtaacggtccacagccatcgctcccagtaacacaaactctgtggtccccacagcaaggtacaggaagagctgggtgacacatgcagccagagatattgtctgcatcccaggaagcagcaatccccaaagcagcatgggcacagtaatagttgtgatcaggatctccaaggcagacaaatgaccaaggaagaaatacatgggagactgcagacgtttatccacacagacaatcacaatgatgactgtgtttcccattaatgtcactgagtagaagaaaaagaatatggcaaaaagaatgtggtgtagttcttgggacccaggaaagcctagaaggcagaactcagtggcactagagaaattgttcatcat

SEQ ID NO: 2452 - protein, 309 aa, Felis catus
  MOD_RES (309)..(309): Any amino acid
MMNNFSSATEFCLLGFPGSQELHHILFAIFFFFYSVTLMGNTVIIVIVCVDKRLQSPMYFFLGHLSALEILITTITVPMLLWGLLLPGMQTISLAACVTQLFLYLAVGTTEFVLLGAMAVDRYVAVCNPLRYNIIMNSHTCIWVVIVSWVFGFLCEIWPVYATFQFTFCKSNLLDHYFCERGQLLKLSCGDTLFTEFVLFLMAVVIIIGSLTPTIVSYTYIISTILKIPTASGRRKAFSTCASHFTFVVIGYGSCLFLYVKPKQTQAAEYNKIVSLFISVVTPFLNPFIFTLRNDKVKEALRDGMKRCX

SEQ ID NO: 2453 - DNA, 966 bp, Felis catus
caggcacccagctcctggatcatgacaaatctgagccacctatctgaatttgtgctcttgggcttctcctcttttggtgagctgcaagttctgctgtgtgggcctttcctcatgctttatcttcttgccttcctgggaaacactgtcatcatagtcacagtcatagccaacaccaacctacatactcccatgtacttcttcccgggtaacttttcactgctggagaccttggtgaccataactacagtgcctaggatgctttcagacctgctggtaccctgcaaagtcatttccttcaatggctgcatggcccagttctacttctacttttccctgggttccacctccttcctcatcctgtcagacatggctcttgaccgctttgtggccatctgccatccactgcgctgtggaactttgatgagctgggatgtgtgtatccagttggtagggacttcctgggcagctcctttcttagccatggtgcccactgtcttctcccaggcttatctcagttattgccatgacaacatcattaaccacttcttctgtgacaatgcacttctgctgcaactgtcctgctcagacaccagcctgcaggaattctgggactttgtgatggccttagcctttgtcctcagttccttcctggtgaccctcatctcctatggctatattgtgaccactgtgctgaggatcccctctgctagcggccatcagaaggctttctcaacctgtggatcccacctcaccctggtcttcattggctacaggtctggcaccatcttccttcatgtcaggtctggcaaagaacattctatggaagtcaacaagaccgtagccttggtgacatcagtcctcaccccctttctcaatatctttatccttaccctctgcaataagacagtcaaggcagtgctacgggggcagatgcagaggcttaaaggcctccacaaggctctatga

SEQ ID NO: 2454 - protein, 314 aa, Felis catus
MTNLSHLSEFVLLGFSSFGELQVLLCGPFLMLYLLAFLGNTVIIVTVIANTNLHTPMYFFPGNFSLLETLVTITTVPRMLSDLLVPCKVISFNGCMAQFYFYFSLGSTSFLILSDMALDRFVAICHPLRCGTLMSWDVCIQLVGTSWAAPFLAMVPTVFSQAYLSYCHDNIINHFFCDNALLLQLSCSDTSLQEFWDFVMALAFVLSSFLVTLISYGYIVTTVLRIPSASGHQKAFSTCGSHLTLVFIGYRSGTIFLHVRSGKEHSMEVNKTVALVTSVLTPFLNIFILTLCNKTVKAVLRGQMQRLKGLHKAL

SEQ ID NO: 2455 - DNA, 934 bp, Felis catus
gctgctgggtctctgaggaggagacttttggtcatatctccaatgacctccttgaccttctcattccggaaggtgaagatgaagggattcaggaaaggggtcaccactacagtcatcagagccaccactttgttgaagtgtgtgaagtagcccttgcctggcctcacatagatgaagatgtcactaccatagcccagaaccaccacagtgaggtgggagacacaggtggagatggctttctggtgcccagagaaagaggggatgtgcagcactgcagccacaatgaggatataggacactatgatcagcagcatggtggccagcacgaagagcaaggacaggaagaaatccatgcactcaacgtggcaggcgtcagagcaggaaagcttgagaagtggggcagagtcacaaaagtggtggttgatgacattagggccaccgaaccagagccgtgttttctgcaggatcggggagatgatagagacaaagccaaccacccaacagactgccaccagcttcatacacactgggccattcatgatggttgggtagtgcggagggcggcagatggccatacagtgatcaaaggccgtgactgtgagaatcacaaagttggtggaacccaaggagaagtaaaagagagactggatcaggcactcagccagggaaatggtcttctgagggacagcaggtctgccagcatcctaggaaccacagtggaggtgaccagcatctccatgagggagaagttacagaggaagaagtacatgggtgagtggaggcaggagtcaaggcatgtgagggtaataatggccaggttctccagcactgtcagcacacatatcaaaaggatgaatgcaaacagtaggacctggaactcatggaggtgtgacaatcccagcagtacaaatcccctaaccacgctgaagttact

SEQ ID NO: 2456 - protein, 311 aa, Felis catus
CWVSEEETFGHISNDLLDLLIPEGEDEGIQERGHHYSHQSHHFVEVCEVALAWPHIDEDVTTIAQNHHSEVGDTGGDGFLVPRERGDVQHCSHNEDIGHYDQQHGGQHEEQGQEEIHALNVAGVRAGKLEKWGRVTKVVVDDIRATEPEPCFLQDRGDDRDKANHPTDCHQLHTHWAIHDGWVVRRAADGHTVIKGRDCENHKVGGTQGEVKERLDQALSQGNGLLRDSRSASILGTTVEVTSISMREKLQRKKYMGEWRQESRHVRVIMARFSSTVSTHIKRMNANSRTWNSWRCDNPSSTNPLTTLKLL

SEQ ID NO: 2457 - DNA, 942 bp, Felis catus
ctaaagttttgattcagaactcctcatcagaactcgactcagagcagctttcatctcgttgttccgtagactgtagatgagcggattcaacatgggggtcatcacagcataaaagagcgtcaccaccttgtcctgcttggctgaagctgtggagtggggctgcatgtaggtgaccagggccatcccgtaagacatggagaccacggtgaggtgggaggcacaggtcccgaaggccttgcggcgtcccccagtggagcggatccgcaggatggctgccacgatgtaggtataggacagtgagacgaggcagcatggcaccagcagcaccaccacgctggaggccagtatgaccacctggttgagggtgatgtccacgcaggccaggcggacgagtgccagcgtctcacaggccacatggttcagcacatggtgcccacaggtaggcagacgcatggtgaccaccgtctccactgtagaattcaccaggcctacaagccaagagacagctgccaggcctgtgcagcacctcgggctcatcactgccacgtagcgcagggggtcacagacagccacgtagcggtcataggccatagcggccagcagcaggaactcggtaccccccagggccagtgagaagaagagctgagtcccacatcgggtgaaggagatggtcttcttctccaggaggaagtgcaccagcatctgggggaccccactagaggtgtagcagatgtccaccactgagaggttgcagaggaagaagtacatgggcaggtgcagccgtgcatccagcccgatcaggaggataatgagcccgttgcccagcagggtcagcagataggcggccgcaaacaggacaaagagtccagcctgggtctgcctgtcgctggagagccccaggaggacaaactcactttcccaggtcaggttgtccctcctcat

SEQ ID NO: 2458 - protein, 313 aa, Felis catus
MRRDNLTWESEFVLLGLSSDRQTQAGLFVLFAAAYLLTLLGNGLIILLIGLDARLHLPMYFFLCNLSVVDICYTSSGVPQMLVHFLLEKKTISFTRCGTQLFFSLALGGTEFLLLAAMAYDRYVAVCDPLRYVAVMSPRCCTGLAAVSWLVGLVNSTVETVVTMRLPTCGHHVLNHVACETLALVRLACVDITLNQVVILASSVVVLLVPCCLVSLSYTYIVAAILRIRSTGGRRKAFGTCASHLTVVSMSYGMALVTYMQPHSTASAKQDKVVTLFYAVMTPMLNPLIYSLRNNEMKAALSRVLMRSSESKL

SEQ ID NO: 2459 - DNA, 966 bp, Felis catus
tcagggctcacacagaccttgtccctgccgcccctgccccagcacccggcggatggcggtggtgatctcgcggttgcgcaggctgtagatgagcgggtacagcagcggcgtgatgttggtgtagatgagtgccagcgtgcggtcccgccgtggggagtagctggccttgggccgcacatacatgaaggtggcacagccatagtgcaggaaagtgacggccaggtgcgaggcgcaggtggaggcagccttgtaccggcccctgggggagtgcaggcgacgcagggtggcggcgatggctccgtaggaggacaggatgagcagtgagggcagcagcagcagcacgaggcaggtgcccagcaggggaagctcatcggcgtagctccgtgtgcaagccaggtccagcagcgccgtgatgtcgcagaagaaatgcaccagtagacgggagccgcagaaaggcaggtgaaagatggccactgtgagccccacggacactgccagtcccccgagacagcaggccagggccagccttgcgcacagccctggggtcaccactgcggtgtagcgcagcgggtggcagatggccacgtaacggtcataggccatggtggccagcaggaagcactcggccccacccagcgccacgaacatctgcatctgaactgcgcagcccaggaaggagatggggctgcccccgccaaggcctggcgtggccaggtcagccagggagcggggcaccaccaccagagtgtaacagagctcgatggctgacagctggcacaggaagagcagcatgggtggtgggctgggcactgaggccacggccaccaggatgagcaggttcccgcccagggtggccaggtgcacagctagcagcaacaagaagagcaccggccttaggtgcgggaactcagagaagccctgaaggagaaagccacagggcatggtggcattgctggggctgtccat

SEQ ID NO: 2460 - protein, 321 aa, Felis catus
MDSPSNATMPCGFLLQGFSEFPHLRPVLFLLLLAVHLATLGGNLLILVAVASVPSPPPMLLFLCQLSAIELCYTLVVVPRSLADLATPGLGGGSPISFLGCAVQMQMFVALGGAECFLLATMAYDRYVAICHPLRYTAVVTPGLCARLALACCLGGLAVSVGLTVAIFHLPFCGSRLLVHFFCDITALLDLACTRSYADELPLLGTCLVLLLLPSLLILSSYGAIAATLRRLHSPRGRYKAASTCASHLAVTFLHYGCATFMYVRPKASYSPRRDRTLALIYTNITPLLYPLIYSLRNREITTAIRRVLGQGRQGQGLCEP

SEQ ID NO: 2461 - DNA, 954 bp, Felis catus
atggacacagataaccagacgtgggtgaaagagttcattctccttggtctgtccagtgactgggaaacacaggtctcactctttgtcctcttcttgatcatgtacttggtgacagtgctggggaacttcctcattgtccttctgatcagactggacagccgactccacactcccatgtacttctttctcaccaacctctcccttgttgatgtctcttatgccacaagtattgttcctcagatgctggcacatcttcttgcagaacataaagcaatcccatttgtgagctgtgcagcccagttatttttctccttgggcttgggtgggattgagtttgttctactggcagtgatggcctacgaccgctatgtggctgtgtgcgaccccctgcgatactcggtcatcatgcatggagggctctgtactaggttggccatcatatcgtgggtcagtggttctctcaactctctcatgcagaccatcatcacctttcagctgcccatgtgcacaaacaagtatattgatcacatatcctgtgaaatcctagctgtggtcagactggcctgtgtggacacctcctccaatgagatcgcgatcatggtttctagcattgtcttgctgatgacacccttctgcctggtcctcttgtcttacactcagatcatctccaccatcctgaagatccagtccacagagggaagaaagaaagccttccacacctgtgcgtctcacctcacagtggtcgtcttgtgctatggcatgaccattttcacctacatccagccccactccagcccttctatccttcaggagaagttgatttctgtcttctatgccattctgatgcccgtgctgaaccccatgatttatagcataaggaataaggaggtgaagggtgcctggcagaaactactagggcagttatctggattaacatcaaaactggcaacttga

SEQ ID NO: 2462 - protein, 317 aa, Felis catus
MDTDNQTWVKEFILLGLSSDWETQVSLFVLFLIMYLVTVLGNFLIVLLIRLDSRLHTPMYFFLTNLSLVDVSYATSIVPQMLAHLLAEHKAIPFVSCAAQLFFSLGLGGIEFVLLAVMAYDRYVAVCDPLRYSVIMHGGLCTRLAIISWVSGSLNSLMQTIITFQLPMCTNKYIDHISCEILAVVRLACVDTSSNEIAIMVSSIVLLMTPFCLVLLSYTQIISTILKIQSTEGRKKAFHTCASHLTVVVLCYGMTIFTYIQPHSSPSILQEKLISVFYAILMPVLNPMIYSIRNKEVKGAWQKLLGQLSGLTSKLAT

SEQ ID NO: 2463 - DNA, 954 bp, Felis catus
atgggaacgggtaaccagacttatgtgaaagagttcatactccttggcctgtccagtgactgggacacacgggtctccctctttgtcctcttcttgatcatatatatggtgacagtgctggggaactttttcattgttcttctgatcagactggacagccgactccacactcccatgtacttctttctcaccaacctctcccttgttgatgtctgttatgccacaagcatcgtcccccagatgttggtgcatcttctaatagaacataaagcaatcccatttgtgagctgtgcagcccagttatttttctccttgggcttgggtgggattgagtttgttctactggcagtgatggcctacgaccgctatgtggctgtgtgcgaccccctgcgatactcggtcatcatgcatggagggctctgtaccaggttggccatcacatcctgggtcagtggttctctcaactctctcatgcagaccatcatcacctttcagctgcccatgtgcacaaacaagtatattgatcacatatcctgtgaactcctagctgtggtcagactggcctgtgtggacatctcctccaatgagatcgcgatcatggtttctagcattgtcttgctgatgacacccttctgcctggtcctcttgtcctacatccagatcatctccaccatcctgaagatccagtccacagagggaagaaagaaagccttccacacctgtgcgtctcacctcacagtggtcgtcttgtgctatggcatggccattttcacttacatccagccccgctccagcccctctattcttcaggagaagttgatctctctcttctatgccgttttgacacccatgttgaaccctatgatttatagtgtaaggaataaggaggtgaagggggcctggcagaaactactagggcagttatctggattaacgtcaaaactggcaacttga

SEQ ID NO: 2464 - protein, 317 aa, Felis catus
MGTGNQTYVKEFILLGLSSDWDTRVSLFVLFLIIYMVTVLGNFFIVLLIRLDSRLHTPMYFFLTNLSLVDVCYATSIVPQMLVHLLIEHKAIPFVSCAAQLFFSLGLGGIEFVLLAVMAYDRYVAVCDPLRYSVIMHGGLCTRLAITSWVSGSLNSLMQTIITFQLPMCTNKYIDHISCELLAVVRLACVDISSNEIAIMVSSIVLLMTPFCLVLLSYIQIISTILKIQSTEGRKKAFHTCASHLTVVVLCYGMAIFTYIQPRSSPSILQEKLISLFYAVLTPMLNPMIYSVRNKEVKGAWQKLLGQLSGLTSKLAT

SEQ ID NO: 2465 - DNA, 954 bp, Felis catus
atggaaacagataaccagacatgggtgagagaatttattctcctcggcctgtccagtgacttgtatgtgcaggtctttctctttgttttattcttagtcatgtacttggtgacagtgctgggaaacttccttattgttgctctgatctgcctggacagcagactccacactcccatgtacttctttctcaccaacctctcccttgttgatgtctcttatgccacaagcatcattcctcagatgttagtgcatcttcttgcagaacataaagcaatcccatttgtgagctgtgcagcccagttatttttctctctaggctggggtgggattgagtttgttctactggcagtgatggcctacgaccgctatgtggctgtgtgcgaccccctgcgatactcggtcatcatgcatggagggctctgtactaggttggccatcacatcctgggtcagtggttccctcaactctctcattcatactgccatcacctttcagctgcccatgtgcgcaaacaagtatattgatcacatatcatgtgaaatcctagctgtggtcagactggcctgtgtggacacctcctccaatgagatcataatcatggtttctagcatcgttctcctgatgacacccttctgcctggtcctcttgtcctacatccagatcatctccaccatcctgaagatccagtccacagagggaagaaagaaagccttccacacctgtgcgtctcacctcacagtggtcgtcttgtgctatggcatggccattttcacttacatccagccccgctccagcccctctattcttcaggagaagttgatctctctcttctatgccgttttgacacccatgttgaaccctatgatttatagtgtaaggaataaggaggtgaagggggcctggcagaaactactagggcagttatctggattaacatcaaaactggcaacttga

SEQ ID NO: 2466 - protein, 317 aa, Felis catus
METDNQTWVREFILLGLSSDLYVQVFLFVLFLVMYLVTVLGNFLIVALICLDSRLHTPMYFFLTNLSLVDVSYATSIIPQMLVHLLAEHKAIPFVSCAAQLFFSLGWGGIEFVLLAVMAYDRYVAVCDPLRYSVIMHGGLCTRLAITSWVSGSLNSLIHTAITFQLPMCANKYIDHISCEILAVVRLACVDTSSNEIIIMVSSIVLLMTPFCLVLLSYIQIISTILKIQSTEGRKKAFHTCASHLTVVVLCYGMAIFTYIQPRSSPSILQEKLISLFYAVLTPMLNPMIYSVRNKEVKGAWQKLLGQLSGLTSKLAT

SEQ ID NO: 2467 - DNA, 934 bp, Felis catus
atgggcagggaaaaccagacctggatgagtgagttcattctgctggggctgtccagatgctggaacactcaggtctccctcttcgtccttttcctggtcatgtatctggtgactgtgctggggaacttcctcatcatcctccttatcagactggacagcaggctacacacacctatgtactttttcctcagtgtcctgtcatttgtggacatctgttataccaacagcaccgtcccacagatgcttgttcacttcctgtcagcccggaagtccatcccgttccacagctgtgtgctccagctgtttatctccctggccatgggcagctccgagtttttcctgctgggagccatggcctatgaccgctatgtggccgtgtgccacccgctgcactacacagccatcatgcatggggggctttgcctggcgctggctactggctgcttgggggctggcttcatgaattcactgatgcaggcagtgatcatcttccagctacctttgtgccataatgtcattaatcactttgcctgtgagatgttggctgtgctgaggctgacctgtgtggacatctccttcaacaaggtcatggtggccatctcaggatttttggtgatcatgcttccctgtttcctggttctgttctcctatgctcgtatagttgctgctattctgcatatccgctccgcccaaggacgctgcaaagcatttgagacctgtgcttcccacctcactgtggtttccatgtgctttggaacagccatcttcacatacttgagaccctctgctggctcctcagcagagcaagagaagatggtcgctctgttctacgctgtggtgaccccgatgctaaatcccttaatctacagcttgaggaacaaggaggtaatgagcgccctaagaagactgttgggaaaattaagtgaaaaaaggt

SEQ ID NO: 2468 - protein, 312 aa, Felis catus
  MOD_RES (312)..(312): Any amino acid
MGRENQTWMSEFILLGLSRCWNTQVSLFVLFLVMYLVTVLGNFLIILLIRLDSRLHTPMYFFLSVLSFVDICYTNSTVPQMLVHFLSARKSIPFHSCVLQLFISLAMGSSEFFLLGAMAYDRYVAVCHPLHYTAIMHGGLCLALATGCLGAGFMNSLMQAVIIFQLPLCHNVINHFACEMLAVLRLTCVDISFNKVMVAISGFLVIMLPCFLVLFSYARIVAAILHIRSAQGRCKAFETCASHLTVVSMCFGTAIFTYLRPSAGSSAEQEKMVALFYAVVTPMLNPLIYSLRNKEVMSALRRLLGKLSEKRX

SEQ ID NO: 2469 - DNA, 942 bp, Felis catus
atgggccaggaaaataaaacccagacatgggtgagggagttcattctactagggttgtccagtgactggaagatgcaagtcttcctctttgtcctggtcctgaccatgtacttggtgactctggtgggaaatattctcattcttcttctgatcagactggacagcaggcttcataaccccatgtacttcttccttagtgttttatcctttgtggacctttgttattcaaacagtattgccccacaaatgctggcccacctgctctcagcccggaagtccatcccattctacagctgtgtgctccagctctacatctccctggccctgggtgggtctgagttcttcctgctgggagccatggcctatgaccgctatgtggctgtgtgccacccactacactacacagtcatcatgcatggacagctgtgtctggggctggctgctggctgcttggtggttggttttgccaattcactgatggagacaatcattaccttctggcttcctctgtgtcacaatgttattaatcactttgcctgtgagaccttagcagtgctacggctagcctgtgtggacatctccttcaacaaggtcatggtggccatctcaggatttctggtgatcatgcttccctgtttcctggttctgttctcctatgttcgtatagttgctgccattctgaatattcgttctgctcagggacgtagcaaagcctttgggacgtgtgcctcccacctcactgtggtttgtatgtgctttggggctaccatcttcacctacctggggccacagtcagcctcctcagaggaagaggagaagacggttgctctattctatgctctggtggcacctatgctgaaccccatgatctatagcttgaggaataaggaagttatggctgctctccaaaaggttctagagaaattctgagataaagagtaa

SEQ ID NO: 2470 - protein, 309 aa, Felis catus
MGQENKTQTWVREFILLGLSSDWKMQVFLFVLVLTMYLVTLVGNILILLLIRLDSRLHNPMYFFLSVLSFVDLCYSNSIAPQMLAHLLSARKSIPFYSCVLQLYISLALGGSEFFLLGAMAYDRYVAVCHPLHYTVIMHGQLCLGLAAGCLVVGFANSLMETIITFWLPLCHNVINHFACETLAVLRLACVDISFNKVMVAISGFLVIMLPCFLVLFSYVRIVAAILNIRSAQGRSKAFGTCASHLTVVCMCFGATIFTYLGPQSASSEEEEKTVALFYALVAPMLNPMIYSLRNKEVMAALQKVLEKF

SEQ ID NO: 2471 - DNA, 924 bp, Felis catus
atggaagtggagaaccagactcaggtcaccaagttcattcttgtgggattccctgggagctgggccatgcgagtagcagtgttcctgatgttcctcatcgcctatgctctgacagtggctgaaaatatggtcatcatcttgttggtgcaacagaaccggccactgcacaagcctatgtacttcttcctggccaacctgtctttcctggagacctggtacatctccgtgacggtacctaagttgctatttagtttttggtctgtgagcaatagtatctccttcactcactgcatgatacaactgtacttcttcattgcgctcatgtgcacagaatgtgtgctccttgcggccatggcctatgaccgttatgtggccatctgccgtccactccactaccccacgattatgagccataggctctgcttccacttggctcttggctcctgggccattggctttggcatctccttggctaagatctacttcatctcccgcctcagtttctgtggccccaatgtcatcaatcacttcttctgtgacatctctccagttcttaacctctcctgcacagacatgtctgtagctgagctggtggactttgtcctggcactggtcatctttctcatccccctctctatcaccgtcctgtcctatggatgcatcctagttaccgttgtacgcatgcccaccggaaagcagaaagcattctctacctgtgcctcccacctcgtggtggtaaccatcttttattcggccactattttcatgtatgccaggccccgagccatccatgccttcaacatgaacaaagtaatttccatcttctatgccattgtcacccctgctctcaaccctttcatttattgcctaaggaacagagaggtcaaagaggctctgaagaaactggcctattgccaagctatc

SEQ ID NO: 2472 - protein, 308 aa, Felis catus
MEVENQTQVTKFILVGFPGSWAMRVAVFLMFLIAYALTVAENMVIILLVQQNRPLHKPMYFFLANLSFLETWYISVTVPKLLFSFWSVSNSISFTHCMIQLYFFIALMCTECVLLAAMAYDRYVAICRPLHYPTIMSHRLCFHLALGSWAIGFGISLAKIYFISRLSFCGPNVINHFFCDISPVLNLSCTDMSVAELVDFVLALVIFLIPLSITVLSYGCILVTVVRMPTGKQKAFSTCASHLVVVTIFYSATIFMYARPRAIHAFNMNKVISIFYAIVTPALNPFIYCLRNREVKEALKKLAYCQAI

SEQ ID NO: 2473 - DNA, 933 bp, Felis catus
atgacagaaaatcaaacatgggtcacagaattcattctcctgggattcccactcagcccactgactcaggtgttcctctttgggctcttctccctgttctatgccttcaccctgctggggaacagcaccatcctggggctcatctggctggattcccgactgcacacccccatgtacttctttctctcccacctggctgttgttgacatagcctatgcctcaaataatgtcccaaagatgctggcgaaccttctgaacaaggaaaaaacgatctcctttgtcccatgcataatgcagacctttttatacatggcttttgctcacactgagtgtctcatcttagtaatgatgtcttatgatcgatatgtggcgatttgccaccccctacgttacactgtcatcatgaactggagagtatgcacggttcaggctgtcatttcctgggcatgcggctccctgctggccctggtccatgtggttctcatcctgaggctgcccttctgcgggcctcatgaaatcaaccacttcttctgtgagatcctgtctgtcctcaagctggcctgcgctgacacctggctcaaccaagttgtcatttttgctgcttctgtgtttatcttagtcgggcccctctgcctggtgctggtgtcctacacgcgcatcctgttcgccatcctgaggatccagtccggggagggacgcagaaaggccttctccacctgctcctcccacctctgcgtggtggggctcttctttggaagcgccattgtcatgtacatggcccccaaatcccgccaccccgaggagcagcagaagatcctctccttgttttacagccttttcaaccctatgctgaacccgctgatctacagcctgaggaacaccgatgtcaagggcgccctgaggagagtgctgtggatggagagatcaatgtga

SEQ ID NO: 2474 - protein, 310 aa, Felis catus
MTENQTWVTEFILLGFPLSPLTQVFLFGLFSLFYAFTLLGNSTILGLIWLDSRLHTPMYFFLSHLAVVDIAYASNNVPKMLANLLNKEKTISFVPCIMQTFLYMAFAHTECLILVMMSYDRYVAICHPLRYTVIMNWRVCTVQAVISWACGSLLALVHVVLILRLPFCGPHEINHFFCEILSVLKLACADTWLNQVVIFAASVFILVGPLCLVLVSYTRILFAILRIQSGEGRRKAFSTCSSHLCVVGLFFGSAIVMYMAPKSRHPEEQQKILSLFYSLFNPMLNPLIYSLRNTDVKGALRRVLWMERSM

SEQ ID NO: 2475 - DNA, 933 bp, Felis catus
atggggagaaataagacctctgtcacagagttcatcctactgggatttcctctcaactcaaggattcagatgcttctctttgggctcttctccctgttctatgccttcaccctgctggggaacgggctcatcctgagactcatctggctggactccagactgcacacccccatgtacttcttcctctcccacctggccatcgttgacatagcctatgcctgcaacacggtgccccagatgctggtaaacctcgtgaattcagacaagcccatctcctttgctggctgcatgacacaaacctttcttttcttgagttttgctcatactgaatgtcttctcctggtggtgatgtcctatgatcggtatgtggccatctgccacccgctccgatattctgtcatcatgagctggagagtctgcatcaccctggcattgacttcctggattttaggagttctcctagccctagtacatctagtgttactcataccattgcccttctgtggaccccagaaagttaaccactttttttgtgaaattatagctgtcctcaaacttgcctgtgcagatacccacattaatgagactatggttttggctggggcagtatctgtgttggtaggaccattctcctccattgtgatatcttacatttatattttatgtgccatcctaaagattcaatcaggggaggggcgccagaaagccttctccacctgttcatcccacctctgtgtggttggactcttttatggcacagccattataatgtatgttgggccccataatgggaaccctaaggagcagaagaaatatctcctcctgttccacagccttttcaatcccatgctcaatcctctgatctatagtctgaggaacaaagaagtcaaagctgctctgaagaggatgcttgaaaaagagcgaacttcatga

SEQ ID NO: 2476 - protein, 310 aa, Felis catus
MGRNKTSVTEFILLGFPLNSRIQMLLFGLFSLFYAFTLLGNGLILRLIWLDSRLHTPMYFFLSHLAIVDIAYACNTVPQMLVNLVNSDKPISFAGCMTQTFLFLSFAHTECLLLVVMSYDRYVAICHPLRYSVIMSWRVCITLALTSWILGVLLALVHLVLLIPLPFCGPQKVNHFFCEIIAVLKLACADTHINETMVLAGAVSVLVGPFSSIVISYIYILCAILKIQSGEGRQKAFSTCSSHLCVVGLFYGTAIIMYVGPHNGNPKEQKKYLLLFHSLFNPMLNPLIYSLRNKEVKAALKRMLEKERTS

SEQ ID NO: 2477 - DNA, 928 bp, Felis catus
atgggaagcaatcagacatggatcacagaagtcatcctgctgggattccaggttgaccccaaacttgaacttttcctctttgggttcttcttgctattctatagcctcacgctgatgggaaatgggatggtcctggggctcatctgctgggattctacactgcacacccccatgtacttcttcctctcaaacctggccattgttgacatgtcctatgcctcaagcattgtccccaagatgctggcaaatcttacaatgcagaagaaaaccatctcctttgctccatgcctacttcagacttttttgtatttggcacttgctgtaacagagtgtacaagtttggtggtaatgtcctatgataggtatgtggccatctgtcaccccctacattacgctgtcatcatgagctggagagtgtgcactatcctggctgccacttgctggatattcagcttcctcttggctctggtccatattactctcatcctgaggttgcccttttgtgggccacaaacaatcgaccactttttctgtcaaatcatgtccgtattcagattggcctgtgctgacactacactcaaccaaactgttctctttgtgggctctgtgtttgttttagtcgggcccctctgcctggtgctggtgtcctacacgtgcatcctgttcgccatcctgaggatccagtcctcggagagccaaagaaaggccttctccacctgctcctcccacctctgcgtggtggggctcttctttggaagtgccattgtcatgtacatggcccccaaatcccgccattctcaagaacaaagaaagatactatcattgttttacagccttttcaaccctatgctaaacccactgatctacagcctgaggaatgctgaggtgaagggtgccctgaggagatttcagaggaagaagacatcag

SEQ ID NO: 2478 - protein, 310 aa, Felis catus
  MOD_RES (310)..(310): Any amino acid
MGSNQTWITEVILLGFQVDPKLELFLFGFFLLFYSLTLMGNGMVLGLICWDSTLHTPMYFFLSNLAIVDMSYASSIVPKMLANLTMQKKTISFAPCLLQTFLYLALAVTECTSLVVMSYDRYVAICHPLHYAVIMSWRVCTILAATCWIFSFLLALVHITLILRLPFCGPQTIDHFFCQIMSVFRLACADTTLNQTVLFVGSVFVLVGPLCLVLVSYTCILFAILRIQSSESQRKAFSTCSSHLCVVGLFFGSAIVMYMAPKSRHSQEQRKILSLFYSLFNPMLNPLIYSLRNAEVKGALRRFQRKKTSX

SEQ ID NO: 2479 - DNA, 933 bp, Felis catus
atgggaagcaaccagacatgggtcacagaagtcaccttgctgggattccaggtttatccagcactggagttttttctctttggacttttctgtctcttctatagcctcactcttctggggaatggggtcatcttagggcttatctgcttagactctagactgcacacccccatgtacttcttcctctcccatctggccatcgttgatatgtcctatgcttccaacaatgtacccaaaatgctggcaaatcttttgactcagagaagaaccatatcctttgttccttgcattatgcagacttttttgtatctagcttttgctcacgcagagtgcctgattttggtcgtgatgtcctatgataggcttgtggcgatctgcaatcccctacattacactgtcatcatgagctggagagtgtgcacagtcctggccatcacttcctgggtgtttagcttcctcctggccctcgtccatttaattctcatcctgaggctgcccttctgtggacctcatgaaatcaatcacttcttctgcgaaatcctatctgtcctcaagctggcctgcgctgacacctggctcaaccaagctgtcatttttgcggcctgtgtatttatcttagtcgggcccctctgcctggtgctggtgtcctacacgcgcatcctgttcgccatcctgaggatccagtccggggagggccgcagaaaggccttctccacctgctcctcccacctctgcgtggtggggctcttctttggaagcgccattgtcatgtacatggcccccaaatcccgccaccctgaggagcagcagaagatcctttccttgttttacagccttttcaaccctatgctgaacccgctgatctacagcctgaggaacacagaggtcaagggcgccctgaggagaacactgtacaaacagaggcatgtatga

SEQ ID NO: 2480 - protein, 310 aa, Felis catus
MGSNQTWVTEVTLLGFQVYPALEFFLFGLFCLFYSLTLLGNGVILGLICLDSRLHTPMYFFLSHLAIVDMSYASNNVPKMLANLLTQRRTISFVPCIMQTFLYLAFAHAECLILVVMSYDRLVAICNPLHYTVIMSWRVCTVLAITSWVFSFLLALVHLILILRLPFCGPHEINHFFCEILSVLKLACADTWLNQAVIFAACVFILVGPLCLVLVSYTRILFAILRIQSGEGRRKAFSTCSSHLCVVGLFFGSAIVMYMAPKSRHPEEQQKILSLFYSLFNPMLNPLIYSLRNTEVKGALRRTLYKQRHV

SEQ ID NO: 2481 - DNA, 930 bp, Felis catus
atgggaagcaaccagtcatgggtcacagaattcatcttggtgggattccagctccgtgcagagatggaagtgctcctcttctggatcttctccctgttctacatctttagcctgttggcaaacggcatgatcttgggactcatctgtctggactcgagactacgcacccccatgtacttcttcctctcccacctggccatcattgacatttcctatgcatccaataatgtccccaagatgttggcaaacttagtgaatcagaagagaaccatctcctttgttccatgcgtaatgcagacatttttgtatttgggttttgctgctacggagtgcctgatcttggtggcgatgtcttatgataggtttgtggcaatctgccaccccctccagtacactgtcatcatgagctggagactgtgcctggtcctggctgtcacttcctggtcatgtggatttattctggctctggtacatgcaattctccttctacggttgcccttctgtggaccccgagaagtgaatcacctcttctgtgaaatcctatctgtcctcaagttggcctgtgctgacacatggatcaaccaattggttattcttgctgcctgtatgtttgtcttagttgggcccctcagtttaatgctaatctcctacatgtgcatcctctgggccatccttaaaatccagtctggggaaggccgcagaaaggccttctccacctgttcatcccatctctgtgtggttggactcttctttggcatagccatggtcgtttatatggtcccagattccaaacaacgagaagagcaagagaaaatattatccctttttcatagtctttttaacccaatgctgaaccctctcatttacagcctgaggaacgctcaggtaaaggcttctttgtatagagcactgaagaaaaggtccatgtga

SEQ ID NO: 2482 - protein, 309 aa, Felis catus
MGSNQSWVTEFILVGFQLRAEMEVLLFWIFSLFYIFSLLANGMILGLICLDSRLRTPMYFFLSHLAIIDISYASNNVPKMLANLVNQKRTISFVPCVMQTFLYLGFAATECLILVAMSYDRFVAICHPLQYTVIMSWRLCLVLAVTSWSCGFILALVHAILLLRLPFCGPREVNHLFCEILSVLKLACADTWINQLVILAACMFVLVGPLSLMLISYMCILWAILKIQSGEGRRKAFSTCSSHLCVVGLFFGIAMVVYMVPDSKQREEQEKILSLFHSLFNPMLNPLIYSLRNAQVKASLYRALKKRSM

SEQ ID NO: 2483 - DNA, 914 bp, Felis catus
atgggagccaatatgacctctatcacagagtttaccctattgggatttccccttgctctgaggattcagatgcttctctttggtatcttctccctgttctacgcctttaccctgctggggaatgggctcatcctgggactcatctggctggactccagactgcacacccccatgtacttcttcctctcccacctggccatcgttgacatagcctatgcctgcaacacggtgccccagatgctggtaaacctcctgaagccagaccagcccatctcctttgctggctgcatgacacagacctttctctttttgacttttgctgtcacagaatgtcttctcctggtggtgatgtcctatgatcggtatgtggccatctgccacccgctccgatatcctgtcatcatgagctggagagtctgcatcatgctggtggtgacttcctggacctttggagtccttctgtctttgattcatctcatgttacttctacccttacccttctgtagatcccagaaaatcaatcactttttctgtgaaatcatggctgttctcaaacttgtctgtgcagatacacacatcaatgagattgtggtattggctggagcaatttccgtactagtgggacccttctcctcgattgtagtctcatatatgtgcatcctctgtgccatcctcaggatccagtctggggaaggtcaaagaaaagccttctctacctgctcatcccatctctgtgtggttggactcttttatggcacggccattataatgtatgttgggcccagatatgggaatcccaaggagcagaagaaatatctcctcctgtttcacagccttttcaatcccatgctcaaccccctgatctatagtcttaggaactcagaagtgaagaatgccttaaagagagtgctggg

SEQ ID NO: 2484 - protein, 305 aa, Felis catus
MGANMTSITEFTLLGFPLALRIQMLLFGIFSLFYAFTLLGNGLILGLIWLDSRLHTPMYFFLSHLAIVDIAYACNTVPQMLVNLLKPDQPISFAGCMTQTFLFLTFAVTECLLLVVMSYDRYVAICHPLRYPVIMSWRVCIMLVVTSWTFGVLLSLIHLMLLLPLPFCRSQKINHFFCEIMAVLKLVCADTHINEIVVLAGAISVLVGPFSSIVVSYMCILCAILRIQSGEGQRKAFSTCSSHLCVVGLFYGTAIIMYVGPRYGNPKEQKKYLLLFHSLFNPMLNPLIYSLRNSEVKNALKRVLG

SEQ ID NO: 2485 - DNA, 943 bp, Felis catus
atggagaaaaatcgaacaatggttacagaattcatcctactgggattttgtcttggtccaaggattcacataatccttttttgggctcttctccctgttctatgccttcaccctcctggggaacgggctcatcctggggctcatctggctggactccagactgcacacccccatgtacttcttcctctcccacctggccatcgttgacatagcctatgcctgcaacacggtgccccggatgctggtaaacctcctgaagccagaccagcccatctcctttgctggctgcatgacgcagacctttcttttcttgacttttgctctaacagaatgtcttctcctggtggtgatgtcctatgatcggtatgtggccatctgccacccgctccgatattctgtcatcatgaactggacaggctgcatcatcctgatggtgacttcctgggcatgtggctccctgctggccctggtccatgtggttctcatcctgaggctgcccttctgcgggcctcatgaaatcaaccacttcttctgtgagatcctgtctgtcctcaagctggcctgcgctgacacctggctcaaccaagttgtcatctttgttgcctgtgtgtttatcttagtcgggcccctctgcctggtgctggtgtcctacacgcgcatcctgttcgccatcctgaggatccagtccggggagggccgcagaaaggccttctccacctgctcctcccacctctgcgtggtggggctcttctttggaagcgccattgtcatgtacatggcccccaaatcccgccaccccgaggagcagcagaagatcctctccttgttttacagccttttcaaccctatgctgaacccaatgatctacagcctgagaaatgcagatgtcaggagtgccctgaaaagggcaatgtgcaaggaaagtcattcccaattagagtga

SEQ ID NO: 2486 - protein, 256 aa, Felis catus
MYFFLSHLAIVDIAYACNTVPRMLVNLLKPDQPISFAGCMTQTFLFLTFALTECLLLVVMSYDRYVAICHPLRYSVIMNWTGCIILMVTSWACGSLLALVHVVLILRLPFCGPHEINHFFCEILSVLKLACADTWLNQVVIFVACVFILVGPLCLVLVSYTRILFAILRIQSGEGRRKAFSTCSSHLCVVGLFFGSAIVMYMAPKSRHPEEQQKILSLFYSLFNPMLNPMIYSLRNADVRSALKRAMCKESHSQLE

SEQ ID NO: 2487 - DNA, 942 bp, Felis catus
atgggggaaaatcagacatcagtcacagagttcattctactgggattttgtcttgacccagggattcagatgcttctctttgggctcttctccctgttctatgccttcaccctgctggggaacgggctcatcctggggctcatctggctggactccagactgcacacccccatgtacttcttcctctcccacctggccattgttgacatagcctatgcctgcaacacggtgccccagatgctggtaaaccttgtgaagccagaccagcccatctcttttgctggctgcatgacacagacctttcttttcttgagttttgctcatactgaatgtcttctcctggtggtgatgtcctatgatcggtatgtggccatctgccacccactccgatattctgtcatcatgagctggacaggctgcatcatcctggtagtgacttcctgggcatgtggctccctgctggccctggtccatgtggttctcatcctgaggctgcccttctgcgggcctcatgaaatcaaccacttcttctgtgagatcctgtctgtcctcaagctggcctgcgctgacacctggctcaaccaagttgtcatctttgttgcctgtgtgtttatcttagttgggcccctctgcctggtgctggtgtcctacacgcgcatcctgttcgccatcctgaggatccagtccggggagggccgcagaaaggccttctccacctgctcctcccacctctgcgtggtggggctcttctttggaagcgccattatcatgtacatggcccccaaatcccgccaccctgaggagcagcagaagatccttttcctgttttacagttttttcaatcctatgctgaacccaatgatctacagtctgaggaatgcagaggtcaagggcgccctgaggagagtgctatacaaggaaagtcattcctaattggagtga

SEQ ID NO: 2488 - protein, 310 aa, Felis catus
MGENQTSVTEFILLGFCLDPGIQMLLFGLFSLFYAFTLLGNGLILGLIWLDSRLHTPMYFFLSHLAIVDIAYACNTVPQMLVNLVKPDQPISFAGCMTQTFLFLSFAHTECLLLVVMSYDRYVAICHPLRYSVIMSWTGCIILVVTSWACGSLLALVHVVLILRLPFCGPHEINHFFCEILSVLKLACADTWLNQVVIFVACVFILVGPLCLVLVSYTRILFAILRIQSGEGRRKAFSTCSSHLCVVGLFFGSAIIMYMAPKSRHPEEQQKILFLFYSFFNPMLNPMIYSLRNAEVKGALRRVLYKESHS

SEQ ID NO: 2489 - DNA, 942 bp, Felis catus
tcactttggcctgagcccagctctgctgagcattttgaccaaagccatccgcacctcccgatttctcagactgtagataagggggttgagtgtgggagtgacaaggctgtagaatagggagaccacgttgtcctggtgtgggctgtggtaggcacccggcaccatgtacatgaacacagcagcaccataaaagagtcccactaccatgatgtgcgaggagcaggtggtgaaggccttgtttctggcctcctcagaccgcatgcgtataacggcgcccaacacgtggccataggagatggcgatgagggaaaggggaaggacaaggatcagcaccccggaggtggacagcgccaactcgtaggccgaggtgtctgcacaggagagcttcagcagggctggcacctcgcagaagaagtggtccaggatgcgggaggcacagtaggggaagtgcagagtgatggaggtctggatggaggcattgagcacacctgccagccaggaggaacccaccatgagcaggcacacttgacgcctcatgagcacaggatactgtagagggtgacacacagcaacataacggtcataggccatgagggccaacaggatgccctcagccacacccaacagggtcaggaagaatatttgagctgcacaaccctcaaaggagatggaaccttctccctgcaggaagtgggatgccatcttggggatggcgaccaggggaaagccaacatcaaacacagagagctgactgagaagaaagtacatgggtgtgtggagccgggagtccatgcggatcaggaagagcagaatggtattgcccaggaggcccacggtaaacgtggcagccaccagggagaagagtagctgacgtgaacctgagtgactgaagaggcccactagaatgaagtcagaggtcactgactgattcgcatcccccat

SEQ ID NO: 2490 - protein, 313 aa, Felis catus
MGDANQSVTSDFILVGLFSHSGSRQLLFSLVAATFTVGLLGNTILLFLIRMDSRLHTPMYFLLSQLSVFDVGFPLVAIPKMASHFLQGEGSISFEGCAAQIFFLTLLGVAEGILLALMAYDRYVAVCHPLQYPVLMRRQVCLLMVGSSWLAGVLNASIQTSITLHFPYCASRILDHFFCEVPALLKLSCADTSAYELALSTSGVLILVLPLSLIAISYGHVLGAVIRMRSEEARNKAFTTCSSHIMVVGLFYGAAVFMYMVPGAYHSPHQDNVVSLFYSLVTPTLNPLIYSLRNREVRMALVKMLSRAGLRPK

SEQ ID NO: 2491 - DNA, 942 bp, Felis catus
tcaggaagatgaaatgatctttctgttggcaagcttcctcagggccccctttagatctctgttcctcaagctatagataaaggggttcagcatgggggtgactgtagtgtacatcacagcagaagctttctccttcacagctgtgcggacagaggagggacacagatagaccccaatggtggtcccataaaggagagcaaccacagagaggtgggagctgcaggtggaaaaggctttcttcctgccccctgcagaagggactttcatgatggccacaatgatgcgagcataggaggccaggatgcagataaaaggcgcggctatcaccagcccagccacaatgagcacaaagatcttgttcacagacgtgtcagtgcaagaaagcctgagaaggggagtgaggtcacagaagtagtgaggtagctcattgttcccacagaaaaccagacgagccatcaggaggatatgagtgagggagatgaagcaggaaaacacccatgggccacctgccagcaggccacagaggtgtgggctcatgatggcagtatagtgtaaggggtaacatatagccacaaacctgtcataagccatcacggcaatcaggacactgtccatgatgccaaagaaatggaaaaagtacatctgggtcaggcagcaggcataggagattgacttgctcctgatttggatgtttaccagcatcttggggactgtgttggtggccaggcagaaatcaaccaaagacaggttagctaagaagaagtacatgggggtgtggaggtgggagtctgagctgatggccaggatgatgagcaggttccccagtactgtgaccacatacatgcagaggaacagagcaaagagaagggtctcctgctctggagtttctgaaagccccaggaggatgaattctaatgcgctggttcggttccttggttccat

SEQ ID NO: 2492 - protein, 313 aa, Felis catus
MEPRNRTSALEFILLGLSETPEQETLLFALFLCMYVVTVLGNLLIILAISSDSHLHTPMYFFLANLSLVDFCLATNTVPKMLVNIQIRSKSISYACCLTQMYFFHFFGIMDSVLIAVMAYDRFVAICYPLHYTAIMSPHLCGLLAGGPWVFSCFISLTHILLMARLVFCGNNELPHYFCDLTPLLRLSCTDTSVNKIFVLIVAGLVIAAPFICILASYARIIVAIMKVPSAGGRKKAFSTCSSHLSVVALLYGTTIGVYLCPSSVRTAVKEKASAVMYTTVTPMLNPFIYSLRNRDLKGALRKLANRKIISSS

SEQ ID NO: 2493 - DNA, 939 bp, Felis catus
atggaacccagaaatcacacaggtgtttcagaatttcttctcctgggattgacagatgatccagaactgcagcccttcctattctgcctgttcttgtctatgtacctggtcactatcctgggaaatctgctcatcatcctggccatcagctctgactcacacctccacacccccatgtacttcttcctctccaacctttcctttactgacatctgtttaagcacaaccacgatcccaaagatgttggtgaacatccaggcacagaatcagagcatcacgtatagaggctgtctcacccaggttggatttgtcctggcttttggtggttttgaaaattttctccttgcagcaatggcctatgatcgctatgtggccatttgtcaccccttgaggtacaccgttatcatgaacccccaactctgtgttctgctgattctactctcactgttctttagcgttgtggttgccttgctccatagtctgatggtgctacggttatccttctgcaaggacttggaaatccctcacttcttctgtgaacttgctcaggtcatcaaactcgcatgttctgataccctcatcaataacatcctgatatattttgtagctagcctatttggtggtattcctctctccggaatcattttctcttatactcaaattgtttcctccgttttgagagtgccatcagcagggggaaagctcaaagctttttccacctgtgggtctcacttgtcagttgtttctttgttctatggaacagttgttggagtgtacattagttctgtagttactgactcttccaagaagactgcagtagcttcagtgatgtatgttgtggttcctcaaatgatgaacccctttatctatagcctgcagaacagagacatgaagggagccttgagaaaactcatcaatgggatgccttctttgctgtga

SEQ ID NO: 2494 - protein, 312 aa, Felis catus
MEPRNHTGVSEFLLLGLTDDPELQPFLFCLFLSMYLVTILGNLLIILAISSDSHLHTPMYFFLSNLSFTDICLSTTTIPKMLVNIQAQNQSITYRGCLTQVGFVLAFGGFENFLLAAMAYDRYVAICHPLRYTVIMNPQLCVLLILLSLFFSVVVALLHSLMVLRLSFCKDLEIPHFFCELAQVIKLACSDTLINNILIYFVASLFGGIPLSGIIFSYTQIVSSVLRVPSAGGKLKAFSTCGSHLSVVSLFYGTVVGVYISSVVTDSSKKTAVASVMYVVVPQMMNPFIYSLQNRDMKGALRKLINGMPSLL

SEQ ID NO: 2495 - DNA, 916 bp, Felis catus
atggaaccagaaaaccaaacaagtgtaacagaattcctcctcctgggtctctcagaaaatccagaatggcagcctcttctctttgggctattcctgaccatgtatctgaccactgtgctcgggaacctactcatcatcctgactatcagctctgactcccatctccatacacccatgtacttcttcctctcccacctggccttcactgacatctgtttcagcaccaccaccatccccaagatgcttgtgaacatccaaagacagagcaaatctatcagttacacaggctgcctcacccaggtctgcttcgtcctgttttttgcaggcttggaaaactttctccttgcagcaatggcttatgaccggtatgtggccatctgccatccactgaggtacacagtcatcatgaacccccacctctgtggcctgctgattctactctccctgagcatcagcattgcagatgccctactccacagtctgatggtgttgcgactctccttctgcgcagacctgggaattgctcatttcttctgtgaacttgctcaggtcatcaagctcgcctgttctgataccctcatcaataacatcctggtgtatttagtgactagcattttgggtggtattcctttccttgggattattttctcttatactcaaattgtctcttccattctgagaatgccatcagctggggggaaacataaagccttttccacctgtgggtctcatctctccgtggtttccttgttctatgggacagcttttggggtgtacattagttctgcagttactcattcttccaaggatactgcagtagcctccgtgatgtataccgtggtccctcaaatgttgaacccttttatctatagcctgaggaacaaggacatgaagggagccttgaggaaactgatct

SEQ ID NO: 2496 - protein, 306 aa, Felis catus
  MOD_RES (306)..(306): Any amino acid
MEPENQTSVTEFLLLGLSENPEWQPLLFGLFLTMYLTTVLGNLLIILTISSDSHLHTPMYFFLSHLAFTDICFSTTTIPKMLVNIQRQSKSISYTGCLTQVCFVLFFAGLENFLLAAMAYDRYVAICHPLRYTVIMNPHLCGLLILLSLSISIADALLHSLMVLRLSFCADLGIAHFFCELAQVIKLACSDTLINNILVYLVTSILGGIPFLGIIFSYTQIVSSILRMPSAGGKHKAFSTCGSHLSVVSLFYGTAFGVYISSAVTHSSKDTAVASVMYTVVPQMLNPFIYSLRNKDMKGALRKLIX

SEQ ID NO: 2497 - DNA, 939 bp, Felis catus
atggaacccagaaacaaaacaggagtttctgaattccttctcttgggattgacggaggatccagaactgcagcccctagtctttagtctgtttctgtccatgtacctggtcaccatcctgggaaacctgctcatcatcctggccatcagctcagactcccacctccacacccccatgtacttcttcctctccaacctgtcctttactgacatctgtttaagtacagccacgatcccaaagatgctggtgaacatccaggcacagaatcagagcatcacttatgcaggctgcctcacacagatctgctttgtcttggtttttgttggtttggaaaattttcttcttgcagcaatggcctatgaccgctatgtagccatctgccatcccctgaggtacaccgttatcatgaacctccgactctgtggtctgctgatggtgctctcactgtccattagtagtgccaatgccctgctccatagtctgatggtgctacggttttccttctgcaaggacttgggcatcccacaattcttctgtgagcttggtcaggtggtcaagcttgcttgttctgacaccctcatcaataatatcctggtatattttatggctagcttacttgggggtgttcctttctctggaatcattttctcttatactcaaattttctcctctgttttgagaatgccatcagcgggcaggaagtataaagctttttccacctgtgggtctcacctgtcagttgtgttcttgttctatgggacaagtattggagtgtacattaattctgcagttactgactcttccaggaagactaacatggcttcagtgatgtacattgtcattcctcaaatgatgaacccctttatctacagtctgaggaacagtgacatgcagggtgtcttgaagaaacttgtcagtaggataccttctcttctgtga

SEQ ID NO: 2498 - protein, 312 aa, Felis catus
MEPRNKTGVSEFLLLGLTEDPELQPLVFSLFLSMYLVTILGNLLIILAISSDSHLHTPMYFFLSNLSFTDICLSTATIPKMLVNIQAQNQSITYAGCLTQICFVLVFVGLENFLLAAMAYDRYVAICHPLRYTVIMNLRLCGLLMVLSLSISSANALLHSLMVLRFSFCKDLGIPQFFCELGQVVKLACSDTLINNILVYFMASLLGGVPFSGIIFSYTQIFSSVLRMPSAGRKYKAFSTCGSHLSVVFLFYGTSIGVYINSAVTDSSRKTNMASVMYIVIPQMMNPFIYSLRNSDMQGVLKKLVSRIPSLL

SEQ ID NO: 2499 - DNA, 939 bp, Felis catus
tcacagaggagaaggtgtcctacttacgagttttctcaaggctcccttcatatccctgttcctcaggctgtagatgaaagggttcatcatttgagggacaacagtgtacatcactgaaagcaccgcagtgtttctggaagagttagtaaaagcagaactaatgtacacccccaaacctgtcccatagaacaaagacacaactgacaggtgagacccacacgtagaaaacgctttatactttctgcccacggatggcatcctcaaaacagaggacactatctgagtgtaagagaaaatgactccacacacagggataccaccgaataggctagctgcaaaatatatcaggatgttattgacgagggtgtcagaacaggcgagcttgatgacctgaacaacttcacagaagaagagagggatttcgacgtctgtgcagaaggtcagctgcaacaccatcagactgtgcatcagggcatccacagtgctaatgcacaaggagactagaatcagcaggccacagaagtgggagttcatgatgactgtgtacctcagtgggtgacaaatggccacatagcgatcataggccattgccgcaagaagaaaactttccaaaccaccaaaagccaggacaaagtagatctgggtgaggcagcctgcataagtgatgctctgactctgtgcctggatgttcaccagcatctttgggatcgtggttgtgcttaaacagatgtcagtaaaggacaggttggagaggaagaagtacatgggggtgtggaggtgggagtccgagctgacggccaggacgataagcaggtttcccaggatggtgaccaggtatatggacagaaacagaataaagagaaagggcttcagttctggatcctctgtcacttgcataagaaggaattcggaaactgctgttttgttgctgggtcccat

SEQ ID NO: 2500 - protein, 312 aa, Felis catus
MGPSNKTAVSEFLLMQVTEDPELKPFLFILFLSIYLVTILGNLLIVLAVSSDSHLHTPMYFFLSNLSFTDICLSTTTIPKMLVNIQAQSQSITYAGCLTQIYFVLAFGGLESFLLAAMAYDRYVAICHPLRYTVIMNSHFCGLLILVSLCISTVDALMHSLMVLQLTFCTDVEIPLFFCEVVQVIKLACSDTLVNNILIYFAASLFGGIPVCGVIFSYTQIVSSVLRMPSVGRKYKAFSTCGSHLSVVSLFYGTGLGVYISSAFTNSSRNTAVLSVMYTVVPQMMNPFIYSLRNRDMKGALRKLVSRTPSPL

SEQ ID NO: 2501 - DNA, 932 bp, Felis catus
tcacagaagagaagttctacttatcagtttcctcaaggctcccttcatatccctgttcctcaggctgtagataaaagggttcatcatttgagggacaacagtgtacatcattgaaagcactgcagtgtttctggaagagttagtaaaagcagaactaatgtacacccccaaacctgtcccatagaacaaagacacgacaggtgagacccacacgtagaaaacgctttatactttctgcccacggatggcatcctcaaaacagaggacactatctgagtgtaagagaaaatgattccacataaaggaataccaccaaatacgctagttgcaaaatatatcaggatgttattgatgagggtgtcagaacaggcgagcttgatcacctgaacaacctcacagaagaagagagggatttcgacgtctgtgcagaaggtcagctgcaacaccatcagactgtgcaccagggcatccacgatgataatgaacagggggagtagaatcagcagactacagaggcagggcttcatgatgactgtgtaccttagtggatgacaaacggccacatagcggtcataggccattactgcaaggagactactttctaaacttgcaaaaactagaacaaagtagatctgggtgaggcagcctgcataagtgatgctctgactctgggcctggatgttcaccagcatctttgggatcgtggttgtgcttaagcagatgtcagtaaaggacaggttggagaggaagaagtacatgggcgtgtggaggtgggagtccgaggtgacagccaggatgatgagcaggtttcccaggatggtgaccaggtacatggacaggaacaggctgaataggagggactgcagttctggatcctctgtcactttcatgagaaggaaatctgaaacatgtgtgtcatttctaggttccat

SEQ ID NO: 2502 - protein, 274 aa, Felis catus
MEPRNDTHVSDFLLMKVTEDPELQSLLFSLFLSMYLVTILGNLLIILAVTSDSHLHTPMYFFLSNLSFTDICLSTTTIPKMLVNIQAQSQSITYAGCLTQIYFVLVFASLESSLLAVMAYDRYVAVCHPLRYTVIMKPCLCSLLILLPLFIIIVDALVHSLMVLQLTFCTDVEIPLFFCEVVQVIKLACSDTLINNILIYFATSVFGGIPLCGIIFSYTQIVSSVLRMPSVGRKYKAFSTCGSHLSCLCSMGQVWGCTLVLLLLTLPETLQCFQ

SEQ ID NO: 2503 - DNA, 931 bp, Felis catus
cacagtcacagaagagaagttctacttatcagtttcctcaaggctcccttcatgccctgttcctcaggttgtagatgaaagggttcatcatttgagggacaacagtgtacatcattgaaagcattgcagcatttctggaagagtcagcaagggcagaactgatgtagactccaaaacctgtcccatagaacaaagacaactgagaggtgagacccacacgtactttatactttccacctgctggtggcatcctcaaaacagaggacactatctgagtgtaagagaaaatgattccacacacagggataccaccgaataggctagctgcaaaatatatcaggatgttattgacgagggtgtcagaacaggcgagcttgatgacctgaacaacttcacagaagaagagagggatttcgaggtctgcgcagaaggtcagctgcaacaccaccagactgtgcgccagggcatccacgatgctaataaacagggaaagaagaatcaaaaggccacagagatgggagttcataatgacattgtacctcagtggatgacaaatggccacatagcgatcataggccatggctgaaagaatacaaccgtccaaacttgcaaaaaccaaaacaaagcagatttgggtgaggcagcctgggtaactgatggatttgctctgtgtctggatgttcacaagcatctttgggatggtagtggaggtgagacagatgtcaacaaaagacaggttggagaggaagaagtacatgggggtgtggaggtgggagtccaagttaacagccaagatgatgagcagatttcccaagatggtgaccagatacatggacaggaacaggctgaagatgagggactgcagttctggattctctgtcacttccatgagaagaaattctagaatgcttgtttcatttccgagttccat

SEQ ID NO: 2504 - protein, 293 aa, Felis catus
MELGNETSILEFLLMEVTENPELQSLIFSLFLSMYLVTILGNLLIILAVNLDSHLHTPMYFFLSNLSFVDICLTSTTIPKMLVNIQTQSKSISYPGCLTQICFVLVFASLDGCILSAMAYDRYVAICHPLRYNVIMNSHLCGLLILLSLFISIVDALAHSLVVLQLTFCADLEIPLFFCEVVQVIKLACSDTLVNNILIYFAASLFGGIPVCGIIFSYTQIVSSVLRMPPAGGKYKVRVGLTSQLSLFYGTGFGVYISSALADSSRNAAMLSMMYTVVPQMMNPFIYNLRNRA

SEQ ID NO: 2505 - DNA, 939 bp, Felis catus
atggaatcagaaaaccagacagaagtatcagaattcctcctcctgggtctctcagaggatccaaaactgcagcccctcctgtttgggctgttcctgtccatgtacctggtcagcgtgctcgggaacctgctcatcatcctggctgtcagctctgactcccacctccacacccccatgtacttcttcctctccaacctgtcctttgtcgacatctccttcacctccactatagtccccaaaatgctggtgaacatccaaacacagagcaaatctatcacttatggaggctgtctcattcaagtatactttttcatggtttttatatgtatggacaatttactcctaactacgatggcttatgaccgctatgtggccatctgccaccctctgcattacagggtcatcatgaaccctcgcctctgtggcctgctgattcttctctccttgttcattagcattatgaatgccctgctccacagtctgatgctggtgcacctgtccttctgcacagacttgaaaatcccccatttcttctgtgggcttgctcaaatccttgaacttgcctgttctgatactcttatcaataatgtcctggtgtatttagtgactagcctgttgggtgttggtcctctctcagggataattttctcttacacccgaattgtctcttccatcttgagaatcccatcaactggtggaaagttcaaagctttttccacctgtgggtctcacctgtctgttgtttgcttattctatgggacttgtgttggagtctaccttagttctgcatcttctctctctcccgggaagagggcagtggcctcagtgatgtacacggtagtcactcccatgatgaacccctttatctacagcctgaggaacagggacatcaagggagccttgaggaaactcatctctggaatgtcttcgttttcatga

SEQ ID NO: 2506 - protein, 312 aa, Felis catus
MESENQTEVSEFLLLGLSEDPKLQPLLFGLFLSMYLVSVLGNLLIILAVSSDSHLHTPMYFFLSNLSFVDISFTSTIVPKMLVNIQTQSKSITYGGCLIQVYFFMVFICMDNLLLTTMAYDRYVAICHPLHYRVIMNPRLCGLLILLSLFISIMNALLHSLMLVHLSFCTDLKIPHFFCGLAQILELACSDTLINNVLVYLVTSLLGVGPLSGIIFSYTRIVSSILRIPSTGGKFKAFSTCGSHLSVVCLFYGTCVGVYLSSASSLSPGKRAVASVMYTVVTPMMNPFIYSLRNRDIKGALRKLISGMSSFS

SEQ ID NO: 2507 - DNA, 939 bp, Felis catus
tcactggaagtaagctcctctcctgaaaagcttcctcagagcccctttcatgtccctgttcctcaggctgtagatgaaggggttcagcgtgggggtgaccactgtgtacatcactgaggctattgaaccctttctggacggatgggctgttccagaagtgaggtagaccccaaggcctgcaccatagaacaaggagaccaccaagaggtgggacccacaggtggaaaaggctttgtacttccccacagcagaagaaatgcccattatgcaggagataattctagaataagagaaaaggatcccagtcaggggaataacacccaacaggccagttacaaaatacagtaggatgtcattgacaagggtgtcagaacaggcaagcttgaggatctgagcaagttcacagaagaagtgggggatttctgtctctttgcagaaggccaccctcaaaaccatcagactttgcaacaaagaatatgtcaggcagattaaccaagaaagcagaagcaggagaccacagaggctagggttcatgatgaccaggtagtgcagggggtgacagacggccacaaaccgatcataggccatcacggtcagtagcaaattatctaatccagcaaaaatcatgaaaaaacacatttgggtaaggcagccttcatacgtgatggcgttgctccgtgtctggatgttcactaacatcttgaggacagtggtggaggtgaaacagatatcagtgagggacaggttggcgaggaagaagtacatgggggtgtggaggtgggggtcagagctgatggccagaacgatgagcaggttccctaaaacacagaccaggtacatatagagaaacagcccaaaaaggaggggctgcaggtttatatcttctgaaagccccagaaggatgaattttgaaatagctgtttggttccctgcttccat

SEQ ID NO: 2508 - protein, 312 aa, Felis catus
MEAGNQTAISKFILLGLSEDINLQPLLFGLFLYMYLVCVLGNLLIVLAISSDPHLHTPMYFFLANLSLTDICFTSTTVLKMLVNIQTRSNAITYEGCLTQMCFFMIFAGLDNLLLTVMAYDRFVAVCHPLHYLVIMNPSLCGLLLLLSWLICLTYSLLQSLMVLRVAFCKETEIPHFFCELAQILKLACSDTLVNDILLYFVTGLLGVIPLTGILFSYSRIISCIMGISSAVGKYKAFSTCGSHLLVVSLFYGAGLGVYLTSGTAHPSRKGSIASVMYTVVTPTLNPFIYSLRNRDMKGALRKLFRRGAYFQ

SEQ ID NO: 2509 - DNA, 939 bp, Felis catus
atggaagcaggaaaccaaacaggaattttagagttcatcctccttgggttctctgaggatccagaactgcagcccttcatatctgggctgttcctgtccatgttcctgatcactgtgctcgggaacctgctcatcatcctggccatctgctctgacccccacctccacacacccatgtacttcttcctctccaacttgtccttggtcgacatcagtttcagctccaccatcgtgcccaggatgctggtgagcatccacacagagaacaaagccatctcttatatggactgcctcactcaggtctatttttccatgttttttcctatcctggacactctcctcctgaccgtgatggcctatgaccggtttgtggccatctgccaccccctgcactacatggtcatcatgaacccacccctctgtggcctgctggtttttgttacctggtttattggtgtcatgacctcccttcttcatatctttctgatgatgcatctgagattctgtggagatctcaaaattccacatttcttctgtgaactgacacagatcctcaagttggcctgctctgacaccttcctgaacagcacattgatatactttatgactggtgtgctaggtgtttttccccttgtcgggatccttttctcctactcacgaattgcttcatccataaggaagatgtcttcagctgggggaaggcaaaaagcattctccacctgtgggtctcacctctcagtggtttctttattttatgggacaggtgttggagtttacttcacttctgcagtgactcactcccccaagaaagtctcagtggcctcggtgatgtacaccgtggtcactcctatgctgaaccccttcatctacagcctgaggaacaaggatgtgaagggggcgctgagaaggcttttcagtagagtggcttcttgtctgtga

SEQ ID NO: 2510 - protein, 312 aa, Felis catus
MEAGNQTGILEFILLGFSEDPELQPFISGLFLSMFLITVLGNLLIILAICSDPHLHTPMYFFLSNLSLVDISFSSTIVPRMLVSIHTENKAISYMDCLTQVYFSMFFPILDTLLLTVMAYDRFVAICHPLHYMVIMNPPLCGLLVFVTWFIGVMTSLLHIFLMMHLRFCGDLKIPHFFCELTQILKLACSDTFLNSTLIYFMTGVLGVFPLVGILFSYSRIASSIRKMSSAGGRQKAFSTCGSHLSVVSLFYGTGVGVYFTSAVTHSPKKVSVASVMYTVVTPMLNPFIYSLRNKDVKGALRRLFSRVASCL

SEQ ID NO: 2511 - DNA, 939 bp, Felis catus
atggaagcagaaaaccagacagaagtatcagtattcctcctccggggtctctcagatgatccagaactgcagcctctcctctttggcatgttcctatccatgtatctggtcactgtgcttggcaacctgctcatcatcctggctctcagctctgactctcacctccacacccccatgtacttcttcctctccaacctgtcctttgttgacatttgtttcatctccaccactgtcccaaagatgctggtgaacatccaggaatgcagcaaaggcatttcctatctagaatgcctcattcaagtgtatttttttatgatttttgctggaatggacgatttcctcctgactgtgatggcctatgaccggtttgtggccatctgccaccccctacactacacagtcatcatgaacccacgactctgtgtcctcctggttctgggttgttggctcacccttttctgggtctccttgattcatattctactggtgaggcggctggccttctgtacaggcactgaaattccacatttcttctgtgaactggctcagattctccaggtagcctgctctgacactcgtatcaataacatctgcttgtatgttgccactgcactgctgtgtgtgtttcctctcactgggatcctcttctcatactctcagattgtctcctccttaatgaggatgtcgtccagtgagggcaagtataaagcattttccacctgtgggtctcacctctctgtggtcagtctgttctatgggacaagcctgggggtctacctcacttctgctgtgacccattcttcccagagaagttcgattgcctcagtgatgtacactgtggtgacccccatgttgaaccccttcatctacagcttgaggaacaaggatgtgaagggggccctgcaaagattcctcagcagagcaacctcatggccatga

SEQ ID NO: 2512 - protein, 312 aa, Felis catus
MEAENQTEVSVFLLRGLSDDPELQPLLFGMFLSMYLVTVLGNLLIILALSSDSHLHTPMYFFLSNLSFVDICFISTTVPKMLVNIQECSKGISYLECLIQVYFFMIFAGMDDFLLTVMAYDRFVAICHPLHYTVIMNPRLCVLLVLGCWLTLFWVSLIHILLVRRLAFCTGTEIPHFFCELAQILQVACSDTRINNICLYVATALLCVFPLTGILFSYSQIVSSLMRMSSSEGKYKAFSTCGSHLSVVSLFYGTSLGVYLTSAVTHSSQRSSIASVMYTVVTPMLNPFIYSLRNKDVKGALQRFLSRATSWP

SEQ ID NO: 2513 - DNA, 996 bp, Felis catus
gcactcttgatgtccctgttcctcaagctgtaaatgaaggggttcagcatgggggtgactacggtgtacacaactgaggccaccatatccttcctgggagaaggcaacagtgctgatccaaggtatactccaatagccgttccataaaataagcaaacaactgacaggtgagagccacaggtggagaaggctttgtacttcccacctgttgatgggattctcagaatggaagaaacaattttatagtaagagaaaaagatccctgagatagggagaaagccagagatgacaccaacaaaatacatgactacgttattggtgaaagtgtcagagcaggcaaggttgaggagttgagaagggtcacagaagaaattagaaatttccacatccttgaaacaggtaagttgcaacacgattaaattgtgcaactgggagtccaaaaggctcacacaaaaggacaccaaaactaagaagccacagagatgtgggttcatgatgactgagtagtgtagaggatgacagatggccacaaatcggtcatatgccattgcagtcagaaacataccatccatacatccaaaaaggatcaaaaaagacatctgagtcaggcagcccacataggagatgactctgctctgagtttggatgtccacaatcatcttagggacagtggtggagatgaatccgatgtcagccaaggacaggttggagaggaagaagtacatgggggtgtggaggtgagagtcagaactgacaaccagaatgatgagcaggtttccaagcacactgaccaggtacatggacaggaagagcccaaagaggaggggctgcagtcctggattatctgagagtcccgtgaggaagaattcggagacacttgttagattttgttctatgtagctttgacacctttagaaaacaaaaagagggttggagaaaggaaacaagtaaatgggcatccagcactgtgtccatgttgtatattcaagcgattca

SEQ ID NO: 2514 - protein, 267 aa, Felis catus
MYLVSVLGNLLIILVVSSDSHLHTPMYFFLSNLSLADIGFISTTVPKMIVDIQTQSRVISYVGCLTQMSFLILFGCMDGMFLTAMAYDRFVAICHPLHYSVIMNPHLCGFLVLVSFCVSLLDSQLHNLIVLQLTCFKDVEISNFFCDPSQLLNLACSDTFTNNVVMYFVGVISGFLPISGIFFSYYKIVSSILRIPSTGGKYKAFSTCGSHLSVVCLFYGTAIGVYLGSALLPSPRKDMVASVVYTVVTPMLNPFIYSLRNRDIKSA

SEQ ID NO: 2515 - DNA, 1022 bp, Felis catus
ttttgctgaggagcctctgcatggccctttggatgtccctgttcctcaggctgtagatgaaagggttcaacatgggggtgaccacagtatacaccaccgaggccactgcacccttcctgggggaagttgacacggctgaactgagatacaccccgagtcctgttccataaaataagcaaacaactgacaggtgagagccacaggtggagaaggctttgtacttcccacctgttgatgggattctcagaatggaagaaacaattttatagtaagagaaaaagatccctgagatagggagaaagccagagatggcaccaacaaaatacatgactacgtcattggtgaaagtgtcagaacaggcaaggttgaggagttgagaaggatcacagaagaaatgagaaatttccacatccttgaagtaggtaagttgtaacacgatcgaattgtgcatctgggagaccaaaacgctgatgaaaagtgatgccaaaaccaacaagccacagaggcgagggttcatgatgaccaagtagcgcagggggtgacagattgccacaaaccggtcatatgccatcgcagccaggaggagactatccaaacatccaaaaagcataaaaaaagacatctgagtcaggcagcccacatacgagatgactctgctctgagtttggatgtccacaatcatcttggggatggtagtagaggtgaaaccgatgtcagccaatgacaggttggagaggaaaaagtacatgggggtgtgaaggtgcgggtcagagctgacggccaggatgatgagcaggttcccgagcacactgaccaggtacatagacaggaacagcccaaagaggaggggctgcagttctagatcatctgagagtcccgtgaggaagaattctgaaacccttgttagattttgtggttctatgtaccttggacaccttttgaaaaagaaaagaaggttggagaaagtaaacaagtcaatgggcattcagcactgtgtccatattgtgtattcaagcagttca

SEQ ID NO: 2516 - protein, 329 aa, Felis catus
  MOD_RES (329)..(329): Any amino acid
MPIDLFTFSNLLFFFKRCPRYIEPQNLTRVSEFFLTGLSDDLELQPLLFGLFLSMYLVSVLGNLLIILAVSSDPHLHTPMYFFLSNLSLADIGFTSTTIPKMIVDIQTQSRVISYVGCLTQMSFFMLFGCLDSLLLAAMAYDRFVAICHPLRYLVIMNPRLCGLLVLASLFISVLVSQMHNSIVLQLTYFKDVEISHFFCDPSQLLNLACSDTFTNDVVMYFVGAISGFLPISGIFFSYYKIVSSILRIPSTGGKYKAFSTCGSHLSVVCLFYGTGLGVYLSSAVSTSPRKGAVASVVYTVVTPMLNPFIYSLRNRDIQRAMQRLLSKX

SEQ ID NO: 2517 - DNA, 863 bp, Felis catus
ttctgaggtacctctctgtggccctcttgatggccctgtacctcagactagatgaaggggagtgagcatgggggtgaccacagtatacaccaccaaggccacctcacccttcctgggaaaatatgagacagctaaactgaggtacactccaagacctgttgcagaaaataagccagtaactaacaggtgacagccacaggtagaaaaggctttgttacttcccacctgtggatgggactctcggaatggaggcaacaatttgagtataagagaaaaggatccctgagagtggaacaccaccaaaaacggcaccagtaaaataaattcatgggttattggtggggatttccaaggaggaaagtttgaatagctgagaagggccatgaaagaaatgaggtatacttccacatctgtgaagaaggttaagttgtgacaccatcagactgtgcaactggtgaaaagctgatgaaaaaagacaccaaaaccagcaggacacagaggtgggtagtgcaagggatgacagatggccacaaaccgatcataggccattgcggtcagtagattgtcttaacatccaaaaagaataaaaatagacatctgagactacataagagatgattcttctgtgagtatggatgtccgcaatcatgttggggacagtagtagaagtgaaacgatgtcagccaaggacaggttggagaggaagaagtacatgggggtgtggaggtgggggtcagggctgacggccaggatgatcagcaggttcctgagcacagtgaccaggtacatggacaggaacatcccaaagaggagaggctgtcattctggatcctccaagaggctcaggaagaagaattctgaga

SEQ ID NO: 2518 - protein, 78 aa, Felis catus
  MOD_RES (78)..(78): Any amino acid
MDVRNHVGDSSRSETMSAKDRLERKKYMGVWRWGSGLTARMISRFLSTVTRYMDRNIPKRRGCHSGSSKRLRKKNSEX

SEQ ID NO: 2519 - DNA, 933 bp, Felis catus
acaaagggctccacgactatggagtcttctcagggcccccttcacatccttgttcctgaggctgtagatgaaggggttcagcatgggggtgaccacagtatacatcactgaggcaattgggattctctgggaagaatgaatcccagcaggactgagatagagccccaagcttgccccatagtacaaggagaccacagagagatgtgagccacaggttgaaaatgctttatattttcctgctgcagaggacattctcattaaagaggagacgatcagagagtaggaaaagaagatcccagtcagaggaaacacacccagtatggcagtcgacacatacaagaagatattattgatacgagtgtcagagcaggctacctggagaatctgaaccacttcacagaagaaatgtggaatttccgcacctgtacagaaggtcagccgcctcaccagtaggacatgaatcagggagacccagaaaatgatgagccaacacaccagaaccagcaggccacagagtcgtgggttcatgatgactgtgtagtgcagggggtggcagatggccacaaaccggtcataggccatcacggtcaggaggaaaccatccattccagcaaaaatcataaaaaagtacagctgagtgaggcatccagggtaggagatgtctttgctctgtgcctggatgtttaccagcatcttcgggacagtggtggaaatgaaacagatgtcaacagaggacaggttagagaggaagaagtacatgggggtgtggaggttggaatcagagaggatggccaggatgatgagcaggtttcctagcacagtgactaggtacgtgaacagaaacaagccaaagaggaggggctgcagttctgggtcatctgagaggccccgaaggaagaattctgatactctggtatggtttcctgcttccat

SEQ ID NO: 2520 - protein, 311 aa, Felis catus
MEAGNHTRVSEFFLRGLSDDPELQPLLFGLFLFTYLVTVLGNLLIILAILSDSNLHTPMYFFLSNLSSVDICFISTTVPKMLVNIQAQSKDISYPGCLTQLYFFMIFAGMDGFLLTVMAYDRFVAICHPLHYTVIMNPRLCGLLVLVCWLIIFWVSLIHVLLVRRLTFCTGAEIPHFFCEVVQILQVACSDTRINNIFLYVSTAILGVFPLTGIFFSYSLIVSSLMRMSSAAGKYKAFSTCGSHLSVVSLYYGASLGLYLSPAGIHSSQRIPIASVMYTVVTPMLNPFIYSLRNKDVKGALRRLHSRGALC

SEQ ID NO: 2521 - DNA, 754 bp, Felis catus
atctgagtttatatttctgggactcactcattcatgggagatccagcttctcctcctggtgttctcctctgtgctctatatggcaagcatgaccggaaacatcctcattgtgttttatgcgaccattgatcctcacttacattcacctaagtacttcttactggctcgtctctttttcattgacgtaggagcctgctctgccaagatgcttcacccaagatgatttatgaccttttcagaaagcgcaaagccatctcctttggaggctgcattgtccaaatcttcatccacgtcattggtggtgtggagatggtgcttctcgtcactatggcctttgacagatatgttgccatttgtaagcctctccactacttgaccatcatgagcccacgaatgtgcattttgtttctggctgctgcctgggctcttggtgtcagtcactcactgttccaactagcatttattgttattttacccttctgtggtccaaatgtattggacagcttttactgtgaccttccttggctcctcagactggtctgtacagatacccacagattgcagttcatggtcactgttaacagtgggtttatctgtgttggttccttctttatactcttcatctcctacatcttcatcctttttactctttggaaacattccttaggtggttcatccaaagccgtttccaccctgtcagctcacaccactgtggtccttttgttcttcggtccaaccatgtttgtctctacat

SEQ ID NO: 2522 - protein, 179 aa, Felis catus
  MOD_RES (179)..(179): Any amino acid
MIYDLFRKRKAISFGGCIVQIFIHVIGGVEMVLLVTMAFDRYVAICKPLHYLTIMSPRMCILFLAAAWALGVSHSLFQLAFIVILPFCGPNVLDSFYCDLPWLLRLVCTDTHRLQFMVTVNSGFICVGSFFILFISYIFILFTLWKHSLGGSSKAVSTLSAHTTVVLLFFGPTMFVSTX

SEQ ID NO: 2523 - DNA, 945 bp, Felis catus
atgaacacaaacaatggaagtgccacagcagacttcatcttgctggggttttctgatcagccccaggtagaacacatcatctctggggttgtcttcatcttctatattgtgactttggtaggaaacacagccatcatccttgtatctaacctagacagccagctccatactcccatgtatttcttcctatccaatttgtcttttctggacctctgttatgcaactagcattatcccacagatgctggtaaatctatggagtccaacaaagtctattacctatggagggtgtgtgttccaattcttctttgcccttgactttggagccacagaatgtcttctcctagctgtgatggcctatgatcgctatgctgctgtctgtcaacctctttactacacaatagtaatgcaccctcagctttgccagaagatggttctcactgcctggttaggtggtcttggaagtgccttaattctttgctccttgactttgaagttgccaagatgtgggcatcgggaggttgataattttatttgtgagatgccagcattgctcaagttggcttgtgtctactcaaaagtaattgaggtcatcgtctatgctcttggggtgatatttcttctagtacctctatcactaattctcatctcatatgcaattatcactcaagctgtcatgaggatcaagtcaacagcaaggtggcataaggtccttaatacctgtggttcccacctcacagtagtaactctgttttacggaacaatcatttatatgtacatgaagccacagaatagcacatctgaagatgaggggaagttccttacactcttttacacaattgtcacacccacccttaaccctctgatctacacattaagaaacaaagatgtgaagaatgcagtaaagagaatactgtatgtgagaaaatgttcagcaaagtcatga

SEQ ID NO: 2524 - protein, 314 aa, Felis catus
MNTNNGSATADFILLGFSDQPQVEHIISGVVFIFYIVTLVGNTAIILVSNLDSQLHTPMYFFLSNLSFLDLCYATSIIPQMLVNLWSPTKSITYGGCVFQFFFALDFGATECLLLAVMAYDRYAAVCQPLYYTIVMHPQLCQKMVLTAWLGGLGSALILCSLTLKLPRCGHREVDNFICEMPALLKLACVYSKVIEVIVYALGVIFLLVPLSLILISYAIITQAVMRIKSTARWHKVLNTCGSHLTVVTLFYGTIIYMYMKPQNSTSEDEGKFLTLFYTIVTPTLNPLIYTLRNKDVKNAVKRILYVRKCSAKS

SEQ ID NO: 2525 - DNA, 945 bp, Felis catus
atggacacaaataatgaaagttccactacagacttcatcctgctggggttttctgatctgccccaattagaacacatcatctctggggttgtcttcgtcttctatattatgactctagtaggaaacacagccatcatccttgtatctaacctagacagccagctccatactcccatgtatttcttcctatccaatttgtcttttctggacctctgttatgcaactagcattatcccacagatgctggtaaatctttggggtccaacaaagtctattacctatggagggtgtgtgctccaattcttttttgcccttgacttgggagccacagaatgtcttctcttggctgtgatggcctatgatcgctatgctgctgtctgtcaacctcttcactacacagtattaatgcaccctcagctttgccagaagatggtgctcactgcctggttaggtggtcttggcagtgccttaatcgtttgttccttgactttgaagttgccaagatgtgggcaccgggaggtggataattttttctgtgagatgccagccttgctcaagatggcttgtgtctactcaaaagtaattgagattgttgtctttgctcttggagtgatatttcttctagcacctctatcaataattttcatctcatatgcaattatcactcaagctgtcatgaggatcaagtcaacagcaaggtggcataaggtccttaatacatgtggttcccacctcacagtagtaactctgttttatggaacaatcatttatatgtacatgaagccacagaatagcacatctgaagatgaagggaagttccttacactattttacacaatcgtcacacccacccttaaccctctgatctacactttaagaaacaaagatgtgaagagtgcagtaaagagaatactgtgtgaacgaaaatggtcagcaaagtcatga

SEQ ID NO: 2526 - protein, 314 aa, Felis catus
MDTNNESSTTDFILLGFSDLPQLEHIISGVVFVFYIMTLVGNTAIILVSNLDSQLHTPMYFFLSNLSFLDLCYATSIIPQMLVNLWGPTKSITYGGCVLQFFFALDLGATECLLLAVMAYDRYAAVCQPLHYTVLMHPQLCQKMVLTAWLGGLGSALIVCSLTLKLPRCGHREVDNFFCEMPALLKMACVYSKVIEIVVFALGVIFLLAPLSIIFISYAIITQAVMRIKSTARWHKVLNTCGSHLTVVTLFYGTIIYMYMKPQNSTSEDEGKFLTLFYTIVTPTLNPLIYTLRNKDVKSAVKRILCERKWSAKS

SEQ ID NO: 2527 - DNA, 933 bp, Felis catus
atgaattgggctaatgagagctccgcaagagagtttatactacttggcttctcagacaggccctggctacagatgcccctgtttgtgcttctattaatatcatatacattcaccatctttggcaatgtgtccatcatgatggtgtgcattctggatcctaaacttcatacacccatgtatttcttcctcactaatctctccatcttagatctgtgctataccacaagcacagtccctcatatgttgacaaatatttgtcgcaacaaaaagaccatcagctacggtggctgtgtagcacagctcatcatcttcctggccctgggagctactgagtgtctcctcctggctgtcatgtcctttgacagatatgtggcagtctgcaaacccctgcactatgtagttattatgaatcattggttctgcttaagggtggtagccttctcgtggttcactggctttggtaattcagtgttgcagtcttccttgacccttaacatgccacgttgtggtcgccaggaagtggaccactttttctgtgaggtgcctgcccttctcaagttgtcgtgtgctgacacaaagcctattgagtctgagctctttttctttagtgtattaattctgctaattccagtgacattaatcctcatttcttatggctttatagctcaagcagtgttgagaatcaggtcagcagaaggacgacgaaaagcttttgggacatgtgggtcccacatggttgtggtcgctctcttttttggtacagccatctacatgtatctacaaccaccttcatccacctctaaggactggggaaagatggtttccctcttctatgggatcattacacccatgttgaacccccttatctacagccttagaaataaagatatgaaggaggccttcaagagggtgatgaaaaaaatcttttttctg

SEQ ID NO: 2528 - protein, 311 aa, Felis catus
MNWANESSAREFILLGFSDRPWLQMPLFVLLLISYTFTIFGNVSIMMVCILDPKLHTPMYFFLTNLSILDLCYTTSTVPHMLTNICRNKKTISYGGCVAQLIIFLALGATECLLLAVMSFDRYVAVCKPLHYVVIMNHWFCLRVVAFSWFTGFGNSVLQSSLTLNMPRCGRQEVDHFFCEVPALLKLSCADTKPIESELFFFSVLILLIPVTLILISYGFIAQAVLRIRSAEGRRKAFGTCGSHMVVVALFFGTAIYMYLQPPSSTSKDWGKMVSLFYGIITPMLNPLIYSLRNKDMKEAFKRVMKKIFFL

SEQ ID NO: 2529 - DNA, 945 bp, Felis catus
atggacacaaacaacggaagttcaataacagatttcatcctgctggggttttctgattggccccaattagaacacatcatctctgggattgtcttcatcttctatattgtgactctggtaggaaacacaaccatcattcttgtatctaacctagacagccagctccatactcccatgtatttcttcctatccaatttgtcttttctggatctctgttatgcaactagcatcatcccacagatgttggttaatctatggggtccaacaaagtctattacctatggaggatgtgtgctccaattcttctttgcccttgacttgggagccacagaatgtcttctcttggctgtgatggcctatgaccgctatgctgctgtttgtcaacctctttactacacaataataatgcaccctcagctttgccagaagatggtgctaaccgcctggttaggtggtcttggtagtgccttcattctttgctccctgactttgaagttgccaagatgtgggcaccgggaggtcgataattttttctgtgagatgccagccttgctcaagatggcttgtgtctactcaaaagtaattgagattgtagtctttgctcttggagtgatatttcttctagtacctctgtcactaattctcatctcatatgcaattatcactcaagctgttgtgaggatcaagtcaacagcaaggtggcataaggtccttaatacatgcggttcccacctcacagtagtaactctcttttatggaacagtcatttatatgtacatgaagccacagaatagcacaacccaagatgaggggaagtttcttactctcttttacacaatcgtcacacccacccttaaccctctaatctacactttaagaaacaaagatgtaaagagagcaataaaaagaatactgtatgtagaaaaatggtaaacaaaggcatga

SEQ ID NO: 2530 - protein, 310 aa, Felis catus
MDTNNGSSITDFILLGFSDWPQLEHIISGIVFIFYIVTLVGNTTIILVSNLDSQLHTPMYFFLSNLSFLDLCYATSIIPQMLVNLWGPTKSITYGGCVLQFFFALDLGATECLLLAVMAYDRYAAVCQPLYYTIIMHPQLCQKMVLTAWLGGLGSAFILCSLTLKLPRCGHREVDNFFCEMPALLKMACVYSKVIEIVVFALGVIFLLVPLSLILISYAIITQAVVRIKSTARWHKVLNTCGSHLTVVTLFYGTVIYMYMKPQNSTTQDEGKFLTLFYTIVTPTLNPLIYTLRNKDVKRAIKRILYVEKW

SEQ ID NO: 2531 - DNA, 942 bp, Felis catus
atgggccaaaacaattacacttctctgcacggttttattctgcttggtttctcagaccatccccaaactggagatggtcctatccaggagttgtcactctcttctacttcattatgtgggtgggtaacacagccatcatccttgcatctttcctggattcccatctccacacaccgatgtattttttcctcaggaacttatctttcctggatctatgtttcacaaccagcatcatccctcagatgctcgttaatttgtggggacctgacaagaccatcagctatgtgggctgtgtcactcaactctacgtttatatgtggttgggttccactgagtgtctcctcctcgctgttatgtcctatgatcgtttcacagctatttgtaagcccctgcattatttggtaattatgaatccacatctctgtctcaagatgataatcacagtctggagcattagtttggctgtttctgtattattatgtacactcaccctgaatttgcctcgatgtggaaacaaccttctggaccatttcttgtgtgagttgccagctatgatcaagatagcttgtatagacaccacgacagttgaaatgtctgtttttgctttgggcattgtcattgtccttacaccactcggccttattcttatatcctatggctacatcgccaaagctgtgctgagaataaagtcaaaagaaggccaacaaaaagcaattaatacctgtggatctcatctcactgtcgtgtccatcttctatggaactattatctacatgtaccttcaaccaggtaacagtgcctccaaagaccagggaaagttcctcaccctcttttacacgatcatcactccaagtcttaacccactcatttataccctgcggaacaaggacatgaagaacgcattgaggaagctggtgagagtcgactgtgaatctacaaaat

SEQ ID NO: 2532 - protein, 314 aa, Felis catus
  MOD_RES (314)..(314): Any amino acid
GPKQLHFSARFYSAWFLRPSPNWRWSYPGVVTLFYFIMWVGNTAIILASFLDSHLHTPMYFFLRNLSFLDLCFTTSIIPQMLVNLWGPDKTISYVGCVTQLYVYMWLGSTECLLLAVMSYDRFTAICKPLHYLVIMNPHLCLKMIITVWSISLAVSVLLCTLTLNLPRCGNNLLDHFLCELPAMIKIACIDTTTVEMSVFALGIVIVLTPLGLILISYGYIAKAVLRIKSKEGQQKAINTCGSHLTVVSIFYGTIIYMYLQPGNSASKDQGKFLTLFYTIITPSLNPLIYTLRNKDMKNALRKLVRVDCESTKX

SEQ ID NO: 2533 - DNA, 838 bp, Felis catus
ctacacgttgacactgttgggaaatattgctattattctggtttctcaactagattcccaactccaaagtcctatgtatttcttcctcacaaacctctcctttttggacctctgtttcaccaccacgactgtaccccaaatgctgttcaacttgggaggctccaacaagaacatcacttatataggctgtatggtgcaggcctatatatttcactggctgggctgtactgaatgtgtcctgcttggcatcatggccttagaccgctatgtggctgtgtgtaagcctctgaggtactctgtaatcatggaccacaagcactgccagcagctctccagctcagcctggctcattggtctggcaaattcactgctgcagtcgacgctcacagtccagctgcccctgtgtgggaatcaggagctagatcacttcttttgtgagctgcccgggcttattaagatggcttgcacggacaccacaatcaatgaggtcactttagcagtggtggccacctttctgataatgggacccctctccatgattcttgtctcttacagttgtattgcccaagctgtatttcgaatcccttctgctgataggagacttaaggccttcagcacttgttcatcacacttactggtggtgtctttattttatggccccggcatctacatctacatgcagccctcaggggacagccctcaagaccttaccaaagctctgacactgttttactgtgttattactcctatggccaacccattcatctacaccttgaggaacaaggatgttaaaggagctttgaggagatttctgaggagtgccattttgtccgaaaga

SEQ ID NO: 2534 - protein, 279 aa, Felis catus
YTLTLLGNIAIILVSQLDSQLQSPMYFFLTNLSFLDLCFTTTTVPQMLFNLGGSNKNITYIGCMVQAYIFHWLGCTECVLLGIMALDRYVAVCKPLRYSVIMDHKHCQQLSSSAWLIGLANSLLQSTLTVQLPLCGNQELDHFFCELPGLIKMACTDTTINEVTLAVVATFLIMGPLSMILVSYSCIAQAVFRIPSADRRLKAFSTCSSHLLVVSLFYGPGIYIYMQPSGDSPQDLTKALTLFYCVITPMANPFIYTLRNKDVKGALRRFLRSAILSER

SEQ ID NO: 2535 - DNA, 749 bp, Felis catus
aaaagaatgaccaaggcaagatgagatccacaggtggagaaagctttgagttttccttgggtggaagggattttcatcacagcagagatgatgaggctgtaggatgccaggatacaccccgaaggtaccgcaaaaataagccccactgcagccagaactatgaactgattgagactggtgttggaacaggagagggggaggagagagttgatatcacagaagaaatggtggatcatgttgttagagcagaagtgcagacgggcgagcatgagggtgtgcaagaggggattcaaagtggcaaggatccatggcacagccaccagagaggcacaaaggcactgggtcatgatggtggagtaacgcaaaggatgacagatggccacaaaacggtcatatgccatcactgtgagaaggaaattgtccatgttggcaaacatcatacagaaatacatctgagccaggcagccaggataggagatggtctgagtctgtgcctggatgttcagcagcatcttgggaactgtagatgaaggcaggcagaggtctactgcagacagattggcaaggaagaaatacatgggtgtgtggaggcggtggtctgagacaatagccagcaagatgagcaagtttccaagcagccctgttaagtagaggcacaggaaaagtgcaaagaggagagcctgcgactcgggccatcttgaaaaggccaagaggagaaattcggagacactggtttggtttccttgttc

SEQ ID NO: 2536 - protein, 250 aa, Felis catus
  MOD_RES (250)..(250): Any amino acid
EQGNQTSVSEFLLLAFSRWPESQALLFALFLCLYLTGLLGNLLILLAIVSDHRLHTPMYFFLANLSAVDLCLPSSTVPKMLLNIQAQTQTISYPGCLAQMYFCMMFANMDNFLLTVMAYDRFVAICHPLRYSTIMTQCLCASLVAVPWILATLNPLLHTLMLARLHFCSNNMIHHFFCDINSLLPLSCSNTSLNQFIVLAAVGLIFAVPSGCILASYSLIISAVMKIPSTQGKLKAFSTCGSHLALVILX

SEQ ID NO: 2537 - DNA, 959 bp, Felis catus
atggacccgaaaaatggaagttctttcactggctttatcctgctgggtttctctgaccggcctcagctggagcgagtcctctttgtggttcttctgatcttctatctgctcaccctgctgggaaacacaaccatcattgcgttgtcccacctggacccacacctgcagactcccatgtactttttcctgtccaacctaagctttctggacctgtgttacatgaccagcactgttcctcagctgctggttcatctcaggggagcagacaagtctatctcctttgctggctgtgtagctcagctgtttgtctctctagggttgggatgcacagaatgcattctgttaggggtgatggcatttgaccgctatgcagccgtctgcaggcccctgcactacacagtgatcatgcacccccgtctctgtgccctgatggcctctgcatcatgggtcacgggttttgcctactcctcattgcagacggtgctcatttttcttgtaccactttgtgggaagaataaaatagaccacttcttttgtgaggttcccccattgctcaagcttgcctgtgttgacaccactgtgtatgagtctgagatcttatttttcagtatggtctttcttttcatacctgtggcattaatcacattctcctatggtcagatcatcagagcagtgttaagaataaagtcagccgcaggacagaggaaagtgtttgggacatgtgggtcccacctcactgtggtctccctgttctatggcacggccatctatgcttacctgcagcccagcaacaaccactcccaggatcagggcaagttcatttctctcttctacaccattgtcacccccacagtcaaccccttcatatataccctgcggaacaaagatgtgacgggtgcaatgaagaaggtgttctgttgggactatgactccagatgactggggtgaagactctttga

SEQ ID NO: 2538 - protein, 312 aa, Felis catus
MDPKNGSSFTGFILLGFSDRPQLERVLFVVLLIFYLLTLLGNTTIIALSHLDPHLQTPMYFFLSNLSFLDLCYMTSTVPQLLVHLRGADKSISFAGCVAQLFVSLGLGCTECILLGVMAFDRYAAVCRPLHYTVIMHPRLCALMASASWVTGFAYSSLQTVLIFLVPLCGKNKIDHFFCEVPPLLKLACVDTTVYESEILFFSMVFLFIPVALITFSYGQIIRAVLRIKSAAGQRKVFGTCGSHLTVVSLFYGTAIYAYLQPSNNHSQDQGKFISLFYTIVTPTVNPFIYTLRNKDVTGAMKKVFCWDYDSR

SEQ ID NO: 2539 - DNA, 945 bp, Felis catus
gatggaccagaaaaatggaagttctttcactggctttatcctgctgggtttctctgaccggcctcagctggagcgagtcctctttgtggttcttctgatcttctatctgctcaccctgctgggaaacacaagcatcattgcgttgtcccgcctggacccacacctgcagactcccatgtactttttcctgtccaacctaagctttctggacctgtgttacacgaccagcactgttcctcagctgctggttcatctcaggggagcagacaagtctatctccttcactggctgtgtagctcagctgttcattgctctagggttgggatgcacagaatgcattctgttaggggtgatggcatttgaccgctacgcagccgtctgcaggcccctgcactacacagtgatcatgcacccccgtctctgtgccctgatggcttctgcatcatggttcattggttttgtcaactcctcattgcagacggtactcatcttccttgtaccactttgtgggagaaataaaatagaccacttcttttgtgagatccccccactgctcaagcttgcctgtgttgacaccactgtgaatgaatctgaggccttctttgccagtatgatcattctcctcatacctgtggcattaatcacattctcctatagtcggattgtcaaggtggtcttagcaataaagtcagcttcggggcagaggaaagcatttgggacatgtgggtcccacctcacggtggtctctctgttctatggctcggccatctatgcttacctccaacccagcaacaaccattcccaggatcagggcaagttcgtttctcttttctacaccattgtcacccccatggccaaccccttcatatataccctgcggaacaaggatgtgatgggagcaatgaaaaaagtgttctgtaggagctttgactccagatgactggg

SEQ ID NO: 2540 - protein, 312 aa, Felis catus
MDQKNGSSFTGFILLGFSDRPQLERVLFVVLLIFYLLTLLGNTSIIALSRLDPHLQTPMYFFLSNLSFLDLCYTTSTVPQLLVHLRGADKSISFTGCVAQLFIALGLGCTECILLGVMAFDRYAAVCRPLHYTVIMHPRLCALMASASWFIGFVNSSLQTVLIFLVPLCGRNKIDHFFCEIPPLLKLACVDTTVNESEAFFASMIILLIPVALITFSYSRIVKVVLAIKSASGQRKAFGTCGSHLTVVSLFYGSAIYAYLQPSNNHSQDQGKFVSLFYTIVTPMANPFIYTLRNKDVMGAMKKVFCRSFDSR

SEQ ID NO: 2541 - DNA, 961 bp, Felis catus
aggatggacccgaaaaatggaagttctttcactggctttatcctgctgggtttctctgaccggcctcagctggagcgagtcctctttgtggttcttctgatcttctatctgctcaccctgctgggaaacacaagcatcattgcgttgtccctcctggacccacacctgcagactcccatgtactttttcctgtccaacctaagctttctggacctgtgttacacgaccagcactgttcctcagctgctggttcatctcaggggagcagacaagtctatctctttcggtggttgtgtagctcagctgttcgtctctctagggttggcatctacagaatgcattctgttaggggtgatggcatttgaccgctacgcagccgtctgcaggcccctgcactacacagtgatcatgcacccccgtctctgtgccctgatggcttctgcatcgtggttccttggttttgtcaactcctcattgcacacggtgctcaccttccttgtaccactatgtgggagaaataaaatagagcacttctattgtgaggtccccccactgctcaagcttgcctgtgttgacaccactgtgaatgagtctgagctctttgtcagtgtgatcattctcctcatacctgtggctttaatcacgttctcctatggtcagattgtcaaggcagtgttaagaataaagtcagcttcagggcagaggaaagcttttgggacttgtgggtcccacctcacagtggtctccctgttctacggcacaggcatctacatttacctccagcccagcaacaactactcccaggatcagggcaagttcgtttctctcttctacaccatcgtcacccccatggtcaatccctttatatatacccttcggaacaaggatgtgactggagcaatgaagaaggcgctttgtaggggctatgactccagatgactcggtacagaagaccctgtga

SEQ ID NO: 2542 - protein, 311 aa, Felis catus
MDPKNGSSFTGFILLGFSDRPQLERVLFVVLLIFYLLTLLGNTSIIALSLLDPHLQTPMYFFLSNLSFLDLCYTTSTVPQLLVHLRGADKSISFGGCVAQLFVSLGLASTECILLGVMAFDRYAAVCRPLHYTVIMHPRLCALMASASWFLGFVNSSLHTVLTFLVPLCGRNKIEHFYCEVPPLLKLACVDTTVNESELFVSVIILLIPVALITFSYGQIVKAVLRIKSASGQRKAFGTCGSHLTVVSLFYGTGIYIYLQPSNNYSQDQGKFVSLFYTIVTPMVNPFIYTLRNKDVTGAMKKALCRGYDSR

SEQ ID NO: 2543 - DNA, 957 bp, Felis catus
gatggacctgaaaaatggaagttctttcactggctttatcctgctgggtttctctgaccggcctcagctggaacaagtcctctttgtggttcttctgatcttctatctgctcaccctgctgggaaacacaagcatcattgcattgtcccgcctggacccacacctgcagactcccatgtactttttcctctccaacctaagctttctggacctgtgttatacgaccagcactgttcctcagctactggttgatctcaggggaacagacaagtctatctcctttgctggctgtgtagctcagctcttcgtgtctctatggttgggatccacagaatgcattctgttgggggtgatggcgtttgatcgctacgcagccgtctgcaggcccctgcactacacagtgatcatgcacccccgtctctgtgccctgatggcttctgcatcgtggttcattggttttgtcaattcctcattgcacacggtgctcaccttccttgtaccactttgtgggagaaataaaatagaccacttcttttgtgagatcccctcactgctcaagcttgcctgtgttgacaccactgggaatgagaatgagctcttctctgtcagtgtgatgattcttttgatacctgtggcattaatcacattctcctatggtcagattgtcagggtggtcttggcaataaagtcagcttcagggcagaggaaagcgtttgggacatgtgggtcccacctcactgtggtttccctgttctacggcacaggcatctacatttacctccagcccagcaacaactactcccaggatcagggcaagttcatttctctcttctacaccattgtcacccccatggtcaaccctgttatatataccctgcggaacaaggatgtgatgggagcaatgaggaaggtgttgtgtaggggctatgactccagatgactgagggaagacccttt

SEQ ID NO: 2544 - protein, 312 aa, Felis catus
MDLKNGSSFTGFILLGFSDRPQLEQVLFVVLLIFYLLTLLGNTSIIALSRLDPHLQTPMYFFLSNLSFLDLCYTTSTVPQLLVDLRGTDKSISFAGCVAQLFVSLWLGSTECILLGVMAFDRYAAVCRPLHYTVIMHPRLCALMASASWFIGFVNSSLHTVLTFLVPLCGRNKIDHFFCEIPSLLKLACVDTTGNENELFSVSVMILLIPVALITFSYGQIVRVVLAIKSASGQRKAFGTCGSHLTVVSLFYGTGIYIYLQPSNNYSQDQGKFISLFYTIVTPMVNPVIYTLRNKDVMGAMRKVLCRGYDSR

SEQ ID NO: 2545 - DNA, 959 bp, Felis catus
aggatggacccgaaaaatggaagttctttcactggctttatcctgctgggtttctctgaccggcctcagctggagcgagtcctctttgtggttcttctgatcttctatctgctcaccctgctgggaaacacaagcatcattgcgttgtcccgcctggacccacacctgcagactcccatgtacttttcctctccaacctaagctttctggacctgtgttacacgaccagcactgttcctcagctgctggttcatctcaggggagcagacaagtctatctcctttgctgcctgtgtagctcagctgttcattgctctagggttgggatgcacagaatgcattctgttaggggtgatggcatttgaccgctacgcagccgtctgcaggcccctgcactacacagtgatcatgcacccccgtctctgtgccctgatggcttctgcatcgtggttcattggttttgccaactcctcgttgcagacggtgctcaccttccttgtaccactttgtgggagaaataaaatagaccacttcttttgtgaggtccccccactgctcaagctttcctgtgttgacactactgtgaatgaatctgagctcttctttgtcggtgtgatcattctcctcatacctgtggcattaatcacgttctcctatggtcaaatcgtcagggcagtgttaagaataaagtcagccgctggacagaggaaggtgtttgggacatgtgggtcccacctcactgtggtctccctgttctatggcacggccatctatgcttaccttcagcccagcaacaactactcccaagatctgggcaagttcatttctctcttctacaccattgtcacccccatggtcaaccccttcatatataccctgcggaacaaggatgtgatgggagcagtgagaaaggtattgtgtaggggctatgactccagatgactgaggggaagacccttt

SEQ ID NO: 2546 - protein, 89 aa, Felis catus
KGSSPQSSGVIAPTQYLSHCSHHILVPQGIYEGVDHGGDNGVEERNELAQILGVVVAGLKVSIDGRAIEQGDHSEVGPTCPKHLPLSSG

SEQ ID NO: 2547 - DNA, 957 bp, Felis catus
gtggtacaaaaggatggaccccaaaaatggaagttctttcacgggctttatcctgctgggtttctctgaccggcctcagctggagggtgtcctctttgtggttcttctgatcttctatctgctcaccctgctgggaaacacaagcatcattgcgttgtccctcctggacccacacctgcagactcccatgtactttttcctctccaacctaagctttctggacctgtgttacacgaccagcactgttcctcaactgctggttcatctcaggggagcagacaagtctatctcctttgctgcctgtgtagctcagctgttcatctctctagggttgggatccacagaatgcattctcttgggggtgatggcatttgaccgctatgcagccatatgcaggcccctgcactacacagtgatcatgcacccccgtctctgtgccctgatggcttctgcatcgtggttcattggttttgccaactcctcgttgcagacggtgctcaccttccttgtaccactttgtgggagaaataaaatagaccatttcctttgtgaggtccccccactgctcaagcttgcctgtgttgacactactgtgaatgaatctgagctcttctttgtcggtgtgatcattctcctcataccagtggcattaatcacgttctcctatggtcgaatcgtcagggcagtgttaagaataaagtcagccgcaggacagaggaaagcctttgggacatgtgggtcccacctcacggtggtctccctgttctatggcacggccatctatgcttacctccagcccagcaacaactactcccaggatcagggcaagttcatttctctcttctacgccatcgtcacccccatggccaacactttcatatatactctgcggaacaaggatgtgacgggagcaatgaggaaggtgttctgtgggggcaatgactccagatgactggg

SEQ ID NO: 2548 - protein, 312 aa, Felis catus
MDPKNGSSFTGFILLGFSDRPQLEGVLFVVLLIFYLLTLLGNTSIIALSLLDPHLQTPMYFFLSNLSFLDLCYTTSTVPQLLVHLRGADKSISFAACVAQLFISLGLGSTECILLGVMAFDRYAAICRPLHYTVIMHPRLCALMASASWFIGFANSSLQTVLTFLVPLCGRNKIDHFLCEVPPLLKLACVDTTVNESELFFVGVIILLIPVALITFSYGRIVRAVLRIKSAAGQRKAFGTCGSHLTVVSLFYGTAIYAYLQPSNNYSQDQGKFISLFYAIVTPMANTFIYTLRNKDVTGAMRKVFCGGNDSR

SEQ ID NO: 2549 - DNA, 957 bp, Felis catus
gatggacccgaaaaatggaagttctttcactggctttatcctgctgggtttctctgaccggcctcagctggagcgagtcctctttgtggttcttctcatcttctatctgctcaccctgctgggaaacacaagcatcattgcgttgtccctcctggacccacacctgcagactcccatgtactttttcctgtccaacctaagctttctggacctgtgttacacgaccagcactgttcctcaactgctggttcatctcaggggagcagacaagtccatctcctttgcaggctgtgtagctcagctgttcgtcgctctagggttgggaggcacagaatgcattctgttgggggtgatggcatttgaccgctatgcagccgtctgcaggcccctgcactacacagtgatcatgcacccccgtctctgtgccctgatggcttctgcatcatggttcattggctttgccaactcctcattgcagacggtgctcatctttcttgtaccactttgtgggagaaataaaatacaccacttcttttgtgaggtcaccccactgctcaagcttgcctgtgttgacaccactgggaatgagaatgagatcttctttgccagtgtgatcattctcctcatacctgtggcattaatcacgttctcctatggtcagatagtcagggcagtgttaagaataaagtcagccacaggacagagaaaagcttttgggacatgtgggtcccacctcacggtggtctccctgttctatggctcggccatctatgcttacgtccagcccagcaacaactactcccaggatcagggcaagttcatttctctcttctacaccatcgtcacccccatggccaaccccttcatatataccctgcggaacaaggatgtgacgggtgcaatgaagaaggtgttgtataggggctatgactccagatgactgagggaagacccttt

SEQ ID NO: 2550 - protein, 312 aa, Felis catus
MDPKNGSSFTGFILLGFSDRPQLERVLFVVLLIFYLLTLLGNTSIIALSLLDPHLQTPMYFFLSNLSFLDLCYTTSTVPQLLVHLRGADKSISFAGCVAQLFVALGLGGTECILLGVMAFDRYAAVCRPLHYTVIMHPRLCALMASASWFIGFANSSLQTVLIFLVPLCGRNKIHHFFCEVTPLLKLACVDTTGNENEIFFASVIILLIPVALITFSYGQIVRAVLRIKSATGQRKAFGTCGSHLTVVSLFYGSAIYAYVQPSNNYSQDQGKFISLFYTIVTPMANPFIYTLRNKDVTGAMKKVLYRGYDSR

SEQ ID NO: 2551 - DNA, 930 bp, Felis catus
tcatggttgcctccccaagacccttttcagcgctccttttacctccttgttccttaaggtgtatatgagtgggttcagcatgggggtgaccaggttgtagaagagggtgagaaacttgccctggtcttgggaagcgctgttcccgggctgcatgtacatgtagatgatgctcccgtagaacagagagaccacggtcaggtgggagctgcaggtgttgaatgccttgcggcgcccagcggccgactggatcttcagcacggctgccgcgatgtggccgtaggacacgagaatgagggcgaggggcaggaggacgatgaggatggcgaaggtgaaggccagcatttccaccgcgcgggcgtccacacaagccatcttgatcagtgctggcatttcacagaggaagtggttgaccctgcgccggccacatctggacagagtcattacgagcggggacatgacgatggcattgaccagtccactcccccaggccacggccaccagtcgcaaacacagctgggggtgcacaatgaccagatagtgcagaggcctgcagaccgcggcgaagcggtcataggccatcacggccaggaggatgcactccacgctccccacacagaggaaggagaagagctggaccgcacagccagcgtagctgatggtcttgtcagggccccagagattcaccagcatctgcgggatacagctcgtactgaagcagagatctagaaaggagagattggccagaaagaagtacattgggatatgaagtcgagggtctaaaatacacacaaggattatggttgagtttcccaacacagccactgaatacagagtgaaattgaccatgaagagtaccagctccagcctcggacgatcagagaagcccactaagataaaaccatactgtgagctgtcattggatttttccat

SEQ ID NO: 2552 - protein, 309 aa, Felis catus
MEKSNDSSQYGFILVGFSDRPRLELVLFMVNFTLYSVAVLGNSTIILVCILDPRLHIPMYFFLANLSFLDLCFSTSCIPQMLVNLWGPDKTISYAGCAVQLFSFLCVGSVECILLAVMAYDRFAAVCRPLHYLVIVHPQLCLRLVAVAWGSGLVNAIVMSPLVMTLSRCGRRRVNHFLCEMPALIKMACVDARAVEMLAFTFAILIVLLPLALILVSYGHIAAAVLKIQSAAGRRKAFNTCSSHLTVVSLFYGSIIYMYMQPGNSASQDQGKFLTLFYNLVTPMLNPLIYTLRNKEVKGALKRVLGRQP

SEQ ID NO: 2553 - DNA, 911 bp, Felis catus
atttcttgattaaggcggctcttgcaactaaccttttaaaggcctcctttacctctttattcttaagtgtgtatataagggggttcagcatgggtgcgatgatcccatagaagagggacaccatcttgccccggtccttggagttgggggatggtggttgcaggtacacagagatagcagtgccatagaagagtgacaccacaattagatgggagccacatgtcccaaatgcctttcgtctaccttccgcagattggattctcaacactgctcgggcaataaaagcatacgatacgaggatgagggtcaggggtattagatggaacagcacgctcacaaagaatagttcagcctcgtttgccgtcgtgtctacacaggacaacttgagcagagcagggacttcacagaggaagtgatccacttctttacggccacagagcggcagctgaagggtcaaggcggacaaccacactgagttgctgaaacccgtaatccaggacgcggccgccagctggaggcacagcctctggtgcatgacgactgagtaatggagaggccgacaaatagcgacaaacctatcaaaggacatgacggccaggagaacacattcagtggcccccaaagctagaaacatgaaaagctgggccacacagccgccataactaattaccttcctggtgctgcataaattgaccagcatttgtggaactgtacttgtggtgtagcaaaggtccaggagtgacagattggtaagaaaaaagtacatgggggtgtggagtttggggtccaggcgtgacactagaataatggtcagattcccaaagatagtggccacgtaagaaatgaagaagaccacaaagagtgggagctccagccgcggtcgatctgagaaacctaagagggtgaactcc

SEQ ID NO: 2554 - protein, 304 aa, Felis catus
  MOD_RES (304)..(304): Any amino acid
EFTLLGFSDRPRLELPLFVVFFISYVATIFGNLTIILVSRLDPKLHTPMYFFLTNLSLLDLCYTTSTVPQMLVNLCSTRKVISYGGCVAQLFMFLALGATECVLLAVMSFDRFVAICRPLHYSVVMHQRLCLQLAAASWITGFSNSVWLSALTLQLPLCGRKEVDHFLCEVPALLKLSCVDTTANEAELFFVSVLFHLIPLTLILVSYAFIARAVLRIQSAEGRRKAFGTCGSHLIVVSLFYGTAISVYLQPPSPNSKDRGKMVSLFYGIIAPMLNPLIYTLKNKEVKEAFKRLVARAALIKKX

SEQ ID NO: 2555 - DNA, 913 bp, Felis catus
ggagttcatcctcttgggtttctcagaccgaccatggctggagctcccactctttgtggtgttcctggtttcctatatcttgactatctttggcaatctggcgataattgccgtgtctcatctggaccccaaactccacacccccatgtactttttccttaccaatctgtcactcctggacctttgctacaccacaagcacagttccacaaatgctggtcaacatatgcagcaccaggaaggtaattagttacggcggctgtgtggcccagcttttcattttcctggccttgggttccactgaatgccttctcctggccgtcatgtccttggataggtttgtcgctatctgtcggcctctccattactcagtcatcatgcaccagaggctgtgcctccagctggcggccgcgtcctggattagcggctttggcaactcagtgttgcagtccaccttgacccttcagctgccgctctgtggccgtaaagaagtggatcacttcttctgtgaagtccctgctctgctcaagttgtcctgtgtggacacaacagcaaacgaggctgaactattctttatcagtgtgctatttcttttactacccctgaccctcatcctcgtatcgtatgcttttattgcccgagcagtgttgagaatccagtctgcggaaggtagacgaaaggcatttgggacgtgtggctcccatctaattgtggtgtcactcttctatggcactgctatctccatgtacctgcaaccaccatcccccaactccaaggaccggggcaagatggtgtccctcttctatgggatcatcgcacccatgctgaacccccttatatacacacttaggaataaagatgtaaagggagcatttaagagggtgattgtgtgggtcttcttaatcaagaaatag

SEQ ID NO: 2556 - protein, 303 aa, Felis catus
EFILLGFSDRPWLELPLFVVFLVSYILTIFGNLAIIAVSHLDPKLHTPMYFFLTNLSLLDLCYTTSTVPQMLVNICSTRKVISYGGCVAQLFIFLALGSTECLLLAVMSLDRFVAICRPLHYSVIMHQRLCLQLAAASWISGFGNSVLQSTLTLQLPLCGRKEVDHFFCEVPALLKLSCVDTTANEAELFFISVLFLLLPLTLILVSYAFIARAVLRIQSAEGRRKAFGTCGSHLIVVSLFYGTAISMYLQPPSPNSKDRGKMVSLFYGIIAPMLNPLIYTLRNKDVKGAFKRVIVWVFLIKK

SEQ ID NO: 2557 - DNA, 935 bp, Felis catus
atggaaatggttgctctggaaaaccaaactatcactgaatttgtcctccttggtttccatgatgtagctgagctgcatctcgttttctttgttgtgctcaccattgtctacgtgtccattgtcatggggaatgtgctgatcgtcgtggcggtggttagctcacggagtctccacacacccatgtatttcttcctggctaacctgtccttcctggagatcctctacacctccacagtggtgcccaaaatgctagagggcttcttgcaggaagcggccatctctgtggctggttgcttgctgcagttctttatcttcggttctctagccacggctgagtgcttcatgctggctgtcatggcctatgatcgctacctggcaatctgctatccactccgctacccactcctgatgggacccagggggtgcttggggctggtggtcatagcttggctctctggcttcatggtagatggactggttgtggccctaatgggccagctgaggttctgtggccccaaccacattgaccacttttactgtgacttcatgcccttgatgggcctggcctgctcggatcccagtgtggcccagatgacaacattcattctgtctgtggtctgcctcactgtccccttcgggctgattctgacatcttatgcccggatcgtggtaactgtgctcaaagtccctgctggggcccagaggctaaaggttttctccacctgctcctcccacctggtggtggtgtccaccttctatggaactctcatggtcttgtacattgcaccctctgctgtccattcccaacttgtctccaaggtcttcgccctgctctacactgtggtcacccctcttctcaatcctgtgatctacaccctgaggaacaaggaggttcatcatgcattgcggagacttctgtacattaagctcaccaa

SEQ ID NO: 2558 - protein, 312 aa, Felis catus
  MOD_RES (312)..(312): Any amino acid
MEMVALENQTITEFVLLGFHDVAELHLVFFVVLTIVYVSIVMGNVLIVVAVVSSRSLHTPMYFFLANLSFLEILYTSTVVPKMLEGFLQEAAISVAGCLLQFFIFGSLATAECFMLAVMAYDRYLAICYPLRYPLLMGPRGCLGLVVIAWLSGFMVDGLVVALMGQLRFCGPNHIDHFYCDFMPLMGLACSDPSVAQMTTFILSVVCLTVPFGLILTSYARIVVTVLKVPAGAQRLKVFSTCSSHLVVVSTFYGTLMVLYIAPSAVHSQLVSKVFALLYTVVTPLLNPVIYTLRNKEVHHALRRLLYIKLTX

SEQ ID NO: 2559 - DNA, 966 bp, Felis catus
ttagaatttaaaaatggcttttaaatacatctttctcggggaaacttctccttttgacagcaccttcctcagagcggccttcatggcttcattgcgtaaactgtagataaccggattgagtgtgggtggtatcaccgtgtagaatatggaaaacatgaggtccatagctgattgggagtcagaagggggccgcagaaactcaaaacctgctgtggagaggaagaaggtgactacaaacaggtgtggtaggcaggtggcgaagaccttggtccggccctctgctgatgggatcctcagcacggcagagaagatgtggacgtaggagagcacaatggacaccaggcagatgaatgctgctgaagttgtgaaggcagccactgcaatctcattgatgaattcatgagaacaagctagtttcagcatctgaggaatgtcacagaagaactggtaaatgactctctccccacagagaggtatggagaagttcacagcagtatgcatgagcccagagaagcccccagcaagccacacagctgccacggcgtgcctacaagtgcaggggtccataatggtctcatactgcaggggccgacagatggcgacataccggtcgtaagacatcacggtgaggatggccacttctgatgaggccagagctatgaagaagaaaacctgaaggatgcactgaccaagtgaaatgtaaccgctgttcgtaagtgaatttgcaatggactgaggcactgtgacagagatgaaacagaggtccaggacagagaggtgcttcaaaaagtaatacatgggggactgaaggcgatggtccaacgtggtcacggtgatgatgaggaggtttcctgtcaaggccatcaggtatgtcaccaaaaacagcaatgcatataaaatctgaagctttcggttttcagaaaaccccataaggaggaatccactcatggaggtcaaattggccat

SEQ ID NO: 2560 - protein, 321 aa, Felis catus
MANLTSMSGFLLMGFSENRKLQILYALLFLVTYLMALTGNLLIITVTTLDHRLQSPMYYFLKHLSVLDLCFISVTVPQSIANSLTNSGYISLGQCILQVFFFIALASSEVAILTVMSYDRYVAICRPLQYETIMDPCTCRHAVAAVWLAGGFSGLMHTAVNFSIPLCGERVIYQFFCDIPQMLKLACSHEFINEIAVAAFTTSAAFICLVSIVLSYVHIFSAVLRIPSAEGRTKVFATCLPHLFVVTFFLSTAGFEFLRPPSDSQSAMDLMFSIFYTVIPPTLNPVIYSLRNEAMKAALRKVLSKGEVSPRKMYLKAIFKF

SEQ ID NO: 2561 - DNA, 952 bp, Felis catus
ctacccgcgagttaaagcttttttccagagggttctccagagagccgccttgacctccttgttccgcaaactgtagatgatggggttgagcatggaggttaccactgtgtagaagagagctaggagcttatctgttcctggcgaatggctggccttgggcctcaggtaggtgacagaccctgagccgtagaagagcgtcactacaagcaggtgggaagagcaggtggacagagctttccggcggccttcaggtgagggcatgatcagcacagcagctaggattctgccataggaagcgatgatcagtagaaatgggctggaaatgcaaagaacggctacaacaaagaccgcggcctcgttacgggatgtatccccgcaggcaagagccaggataggggggaggtcgcagaagaagtggtctatttcacaggggccacagaagttcaaggagaaaatatagttggtctggcccaagcctaccacgcaacccactgcccaggaaaccacggccagctgggcacagagcccacggctcattcgtgtcgcgtagtgtagtggggagcatatggccatgtagcggtcaaaagccatggccgccagaagacagcactcactgatggcaaacagcgtgaagaagaacatctgtgtggcacacccctcgcgggagatgccccgggcctcactcacaaggctctgaagcatcttgggtatgaccgaacacgtgtagccaatctccaagagagacaggttggccaggaagaagtacatgggtgtgtggagggtggggttggtgcagatggccagggctatgagagcgttgcccgtcagggaggcgaggaacatgagcaggatgagggtgaatagaagcaagcactgctcggccgcggcagagaacttggcgaatgcaaagtgcttgacagactcgctgttgtcctgccactgggaacagctg

SEQ ID NO: 2562 - protein, 316 aa, Felis catus
SCSQWQDNSESVKHFAFAKFSAAAEQCLLLFTLILLMFLASLTGNALIALAICTNPTLHTPMYFFLANLSLLEIGYTCSVIPKMLQSLVSEARGISREGCATQMFFFTLFAISECCLLAAMAFDRYMAICSPLHYATRMSRGLCAQLAVVSWAVGCVVGLGQTNYIFSLNFCGPCEIDHFFCDLPPILALACGDTSRNEAAVFVVAVLCISSPFLLIIASYGRILAAVLIMPSPEGRRKALSTCSSHLLVVTLFYGSGSVTYLRPKASHSPGTDKLLALFYTVVTSMLNPIIYSLRNKEVKAALWRTLWKKALTRG

SEQ ID NO: 2563 - DNA, 945 bp, Felis catus
atgaacaaaaacaatggaagttccatgacagacttcatcctgctggggttttctgatcggccccagttagaacacatcatctctggggttgtcttcatcttctatattgtgactctggtaggaaacacaaccatcatccttgtatctaacctagacagccagctccatactcctatgtatttcttcctatccaatttgtcttttctggatctctgttatgcaactagcattatcccacagatgctggtaaatctatggggtccaacaaagtctattacctacggagggtgtgtgctccaattcttctttgcccttgacttgggagccacagaatgtcttctcttggctgtgatggcctatgatcgctacgccgctgtctgtcaacctcttcactacacagtaataatgcaccctcaactttgccaaaagatggtgcttgtcgcctggttaggtggtcttggcagtgccttaattctttgctccttgactctgaaactgccaagatgtgggcaccgggaggtggacaattttttctgtgagatgccagcattgctcaagatggcttgtgtctactcaaaagtaattgaggtcattgtctatgctcttggagtgatatttcttctagtacctctattactaattctcatctcatatgcagttatcactcaagctgtcatgaggatcaagtcaacagcaaggtggagtagggtccttaatacctgtggttcccacctcacagtagtaactctgttttatggaacactcatttatatgtacatgaagccacagaatagcacatcccaagatgaggggaagttctttacactcttttacacaatcgtcacacccacccttaaccctctgatctacactttaagaaacaaggatgtgaagagtgcagtaaagagaatactgtgtgcagaaaaatggtcagcaaagtcatga

SEQ ID NO: 2564 - protein, 314 aa, Felis catus
MNKNNGSSMTDFILLGFSDRPQLEHIISGVVFIFYIVTLVGNTTIILVSNLDSQLHTPMYFFLSNLSFLDLCYATSIIPQMLVNLWGPTKSITYGGCVLQFFFALDLGATECLLLAVMAYDRYAAVCQPLHYTVIMHPQLCQKMVLVAWLGGLGSALILCSLTLKLPRCGHREVDNFFCEMPALLKMACVYSKVIEVIVYALGVIFLLVPLLLILISYAVITQAVMRIKSTARWSRVLNTCGSHLTVVTLFYGTLIYMYMKPQNSTSQDEGKFFTLFYTIVTPTLNPLIYTLRNKDVKSAVKRILCAEKWSAKS

SEQ ID NO: 2565 - DNA, 941 bp, Felis catus
atggggggaggaaataattcggtggtgtctgagattgtgttggtgggactcaccaattctttgaagatgcagcttgtcttatttctagttttctctgtgttctatgtcacaggtattttaggaaacctcctcattgtgctcacagtgatctctgactcccatttacactcccctatgtacttcctgctggccaacctctcttttattgacatgtgggtttcctccattgcagctcccaagatgatttctgatcttttcaaggagagaaaagtaatctctttccaaggctgcattgctcagatgttcttcattcatgttattggaggaactgagatggttctgctcattgccatggcccttgaccgttatgttgctatatgcaggcctcttcactacctgaccatcatgaacttcagaacttgtattttactcttggtggtggcctggaccattgggatcatccactcactgatccaactggtgtttgttgtaaacctgccactctgtggccccaacgaactggacagcttttactgtgatcttcctcgatttattaggcttgcctgcacagacacttacagattggagctcatggtcactgccaatagtggtttcatctctctggggacttttttcattttggttatttcctatatcttcaccttggtcattgtttggcaacgttcttcaggtggcttgtccaaggccctctctactctgtcagctcacatcacagtggtagtcttgttttttggtccatgtatttttgtgtactcatggccatttcccacagtgccagtggataagttccttgccatttttgatgtaattatcactccatttctgaaccctgccatctatacttttaggaataaagaggtgaaagtggcaatgaggagaatattcagtcaggtgtcgagtttcaggaagatgttataagt

SEQ ID NO: 2566 - protein, 312 aa, Felis catus
MGGGNNSVVSEIVLVGLTNSLKMQLVLFLVFSVFYVTGILGNLLIVLTVISDSHLHSPMYFLLANLSFIDMWVSSIAAPKMISDLFKERKVISFQGCIAQMFFIHVIGGTEMVLLIAMALDRYVAICRPLHYLTIMNFRTCILLLVVAWTIGIIHSLIQLVFVVNLPLCGPNELDSFYCDLPRFIRLACTDTYRLELMVTANSGFISLGTFFILVISYIFTLVIVWQRSSGGLSKALSTLSAHITVVVLFFGPCIFVYSWPFPTVPVDKFLAIFDVIITPFLNPAIYTFRNKEVKVAMRRIFSQVSSFRKML

SEQ ID NO: 2567 - DNA, 971 bp, Felis catus
atggatggaggaaatcactcagtggtgtctgaatttttgttgctgggactcaccagttcttgggagattcagattcttcttttttgttttttactatattttatatagcaagtatgttaggaaaccttctcattgtgctcacaatcatttcagaccatcacttacattcccccatgtactttttgctggcaaatctttccatcattgacactggtgtttccagcattgcaagcccaaagatgatttacgaccttttcagaaaacataaagtcatctcgttggcagggtgcattactcagatgttctttattcacactgttgggggtacggagatggtgctgctcatagttatggcctatgacagatacattgctatctgtaagcctctccactacctgaccatcatgagcataagaatgtgcatttcccttttggctgttgcctggaccattggactcatccactccgtggcccaactggcttttgttataaacttgcccttttgtggtcccaacaaaatggatagtttttattgtgattttcctcggttcatcaaacttgcatgtacagacacatatagactggagtttctggtcactgccaacagtggtttcatctccatgggcaccttcttcatcttgattgtgtcttacatcttcatcctggtcacagttcgcaaacactcttcaggtggttcatccaaggctctctccactctctctgctcacatcaccgtggtggtctttttctttggtccttgcattattgtctatgtgtggccattccctaccttaccaatcgataaatttttagccatctttgatgcccttatcactccttttatgaatcctattatctatacattcagaaacaaggagatgaaagtggcaataaagagactgtttggtaaggttttaagtgtcaggaagagttctttcatgaacaatcaaagccatttggattcatcttga

SEQ ID NO: 2568 - protein, 285 aa, Felis catus
MLGNLLIVLTIISDHHLHSPMYFLLANLSIIDTGVSSIASPKMIYDLFRKHKVISLAGCITQMFFIHTVGGTEMVLLIVMAYDRYIAICKPLHYLTIMSIRMCISLLAVAWTIGLIHSVAQLAFVINLPFCGPNKMDSFYCDFPRFIKLACTDTYRLEFLVTANSGFISMGTFFILIVSYIFILVTVRKHSSGGSSKALSTLSAHITVVVFFFGPCIIVYVWPFPTLPIDKFLAIFDALITPFMNPIIYTFRNKEMKVAIKRLFGKVLSVRKSSFMNNQSHLDSS

SEQ ID NO: 2569 - DNA, 932 bp, Felis catus
atggatggagccaaccaatctgtggtatatgagtttgtgttcctgggactctctaattcatgggagatccagcttcttcttttcttcttttcctctgtgttctacatggcaagcctaatgggaaatctcctcattgtgttctctgtgagtactgaccctaacttgcactctcccatgtacttcctgctggccaatctctcctttcttgatgtgggggtttgctctattgcagcccccaaaatgatttatgacctcttcagaaaacgcaaagccatctcttttgggggttgtatatctcagatcttctttattcatgctattggggggacagaaatggtgctgctcattgccatggcctttgacagatatgttgctatatgtaagcctctccactacctgaccattatgagcccacgaatgtgcattttgattttggctgcagcctgggtccttggcctcatccactcagtggcccaattggcttttgttgtagacttacctttctgtggtcctaatgtattggacagcttttattgtgaccttcctcagctcattaaacttgcctgcacagagaccaataggctggagttcatggtcacagccaatagtggactcatctctgtgggttctttctttatactgattatttcttacatcatcattctggtcacagtttggaaacactcttcaggtgggttatccaaggccctctctactttgtcagctcatgtcactgtggtggttttattctttgggccattaatcttcttctacacctggcccttcccctcatcacacttggacaaatttcttgccatctttgatgcagttctcacaccttttctgaatccagtcatctacacattcaggaacaaggagatgaaggcagcaatgaagaaactctgtcatcagcttgtgagttacaggaggat

SEQ ID NO: 2570 - protein, 311 aa, Felis catus
  MOD_RES (311)..(311): Any amino acid
MDGANQSVVYEFVFLGLSNSWEIQLLLFFFSSVFYMASLMGNLLIVFSVSTDPNLHSPMYFLLANLSFLDVGVCSIAAPKMIYDLFRKRKAISFGGCISQIFFIHAIGGTEMVLLIAMAFDRYVAICKPLHYLTIMSPRMCILILAAAWVLGLIHSVAQLAFVVDLPFCGPNVLDSFYCDLPQLIKLACTETNRLEFMVTANSGLISVGSFFILIISYIIILVTVWKHSSGGLSKALSTLSAHVTVVVLFFGPLIFFYTWPFPSSHLDKFLAIFDAVLTPFLNPVIYTFRNKEMKAAMKKLCHQLVSYRRX

SEQ ID NO: 2571 - DNA, 935 bp, Felis catus
atggatggagcgaatcactctgtggtgtcagagtttgtgttcctgggactcaccgattcctgggagatccaacttctcctctttgtgttctcctccacgttttatgtggcaagcatgatgggaaactccctcattatgctcactgtgacctctgaccctcacttacactcccccatgtactttctgttggccaacctctccttcattgacctgggagtttcttctgtcacttctcccaagatgatttatgatctttttagaaagcgtaaagtcatctcctttggaggctgcatcgctcaaatcttctttatccacgtcattggtggtgtggagatggtgctgctcatcgccatggcctttgacagatatgttgccatatgtaagcctctccactatctgaccatcatgagcccaagaatgtgcctcttctttttagtggctgcctggatgactggcctcatccactccatggttcaactggcgtttgtggtaaacttacccttctgtggtcctaatgtgttggacagcttttactgtgaccttcctcggttcatcaaacttgcctgcacggacaccgaccgactagagtttatggtcacagccaacagtggattcatctctgttggctccttcctcatactgatcatttcctatatcatcatcattctcactgttcagaaacactcttcagctggttcatccaaggctctgtccacactgtcagctcacatcactgtggtattcttgttctttggtcctttgatttttttttatacatggccatctccctccatacacctggataagtttctggccatctttgatgctattctcactcctttcctaaatccagtcatctatacattcaggaaccaagaaatgcaggtggcaatgaggagagtatgcagacagctagtgaattacaggaagatctc

SEQ ID NO: 2572 - protein, 312 aa, Felis catus
MDGANHSVVSEFVFLGLTDSWEIQLLLFVFSSTFYVASMMGNSLIMLTVTSDPHLHSPMYFLLANLSFIDLGVSSVTSPKMIYDLFRKRKVISFGGCIAQIFFIHVIGGVEMVLLIAMAFDRYVAICKPLHYLTIMSPRMCLFFLVAAWMTGLIHSMVQLAFVVNLPFCGPNVLDSFYCDLPRFIKLACTDTDRLEFMVTANSGFISVGSFLILIISYIIIILTVQKHSSAGSSKALSTLSAHITVVFLFFGPLIFFYTWPSPSIHLDKFLAIFDAILTPFLNPVIYTFRNQEMQVAMRRVCRQLVNYRKIS

SEQ ID NO: 2573 - DNA, 939 bp, Felis catus
atggatagagcaaatcactctgtggtgtcagagtttgtgttcctgggactcaccgattcctgggagatccaacttctcctctttgtgttctcctctatggtttatgtggcaagcatgatgggaaactccctcatcatgctcactgtgatttctgaccctcacttacactcccccatgtactttctgttggccaacctctccttcattgacctgggagtttcttgtgtcatttctccgaagatgatttatgaccttttcagaaagcgtaaggtcatctcctttggtggctgcatcgctcaaatcttcttcatccacgtcattggtggcgtggagatggtgctgctcatcgccatggcctttgacagatatgttgccatatgcaagcctctgcactacttgactattatgaaccgaaaaatgtgtattttgcttacagttgctgcctgggtaattggcttgacccactctgtgattcaactggtttttgtaataacattgccattctgtggccctaatgtgttagacagcttttattgtgactttcctcggttcatcagacttgcctgcacagacacctaccgtctagagttcatggtcatagccaacagtgggttcatatctctgggatcattcttcatattgattgtctcctacatttctatcctgatcactgttcggaaacactcttcagcaggcacatctaaggccctctccactttgtcaactcatgtcatggtggtgattttgttctttggcccttgcatcttcgtttatatctggcctcaccccacctcacacctagacaaaaatcttgttgtctttgatgcagttctcactcctttttttaactcagtcatctatacattcaggaacaaagagatgaaagtggcaatgaggaaagtgtgtagtcggtttattatttatagaaggatttcttaa

SEQ ID NO: 2574 - protein, 312 aa, Felis catus
MDRANHSVVSEFVFLGLTDSWEIQLLLFVFSSMVYVASMMGNSLIMLTVISDPHLHSPMYFLLANLSFIDLGVSCVISPKMIYDLFRKRKVISFGGCIAQIFFIHVIGGVEMVLLIAMAFDRYVAICKPLHYLTIMNRKMCILLTVAAWVIGLTHSVIQLVFVITLPFCGPNVLDSFYCDFPRFIRLACTDTYRLEFMVIANSGFISLGSFFILIVSYISILITVRKHSSAGTSKALSTLSTHVMVVILFFGPCIFVYIWPHPTSHLDKNLVVFDAVLTPFFNSVIYTFRNKEMKVAMRKVCSRFIIYRRIS

SEQ ID NO: 2575 - DNA, 938 bp, Felis catus
tggatggagggaatcactcggttgtgtctgagtttgtgtttctgggactcactcattcatgggagatccagcttctcctcctggtgttctcctctgtgctctatgtggcaagcatgaccgggaacatcctcattgtgttctctgtgaccgttgatcctcacttgcattcccccatgtacttcctactggccaatctctctttcattgacttgggagcctgctctgccacctcacccaagatgatttatgaccttttcagaaagcacaaagtcatctcctttggaggctgcatcgcccagatcttcttcatccacgtcattggtggtgtggagatggtgctgctcatcgccatggcctttgacagatatgttgccatctgcaagcctctccactacttgaccatcatgagcccacgaatgtgcattttgtttctggctgctgcctgggcccttggtgtcagtcactcactgttccaactagcattcattgttaatttacccttctgtggtcctaatgtattggacagcttttactgtgaccttcctcggctcctcagactggcctgtacagatacttacagattgcagttcatggtcactgttaacagtgggtttatctgtgtgggttccttcttgatactcctcatctcctacgtcttcatcctgttttctgtttggaaacattcctccggtggctcatccaaggccgtttccaccctgtcagctcacatcactgtggtccttttgtttttcggcccaaccatgtttgtctatacatggccacatcccaattcccaaatggacaaatttcttgccctgtctgatgcagttatcactccttttctgaatccagtcatctacacgctcaggaataatgagatgaaggcagcagtgaagagaactttgagaccattaatgatttttaggaagatttcataa

SEQ ID NO: 2576 - protein, 311 aa, Felis catus
DGGNHSVVSEFVFLGLTHSWEIQLLLLVFSSVLYVASMTGNILIVFSVTVDPHLHSPMYFLLANLSFIDLGACSATSPKMIYDLFRKHKVISFGGCIAQIFFIHVIGGVEMVLLIAMAFDRYVAICKPLHYLTIMSPRMCILFLAAAWALGVSHSLFQLAFIVNLPFCGPNVLDSFYCDLPRLLRLACTDTYRLQFMVTVNSGFICVGSFLILLISYVFILFSVWKHSSGGSSKAVSTLSAHITVVLLFFGPTMFVYTWPHPNSQMDKFLALSDAVITPFLNPVIYTLRNNEMKAAVKRTLRPLMIFRKIS

SEQ ID NO: 2577 - DNA, 937 bp, Felis catus
ttattagataccagtaggatccataacccgcttgcccagtcttctcatggccactctcatgtctttgtttcttaatgtatagatggcaggatcaagaggggggtgatagcgaagttggcaatgaacaaatacttatccagtgatgatgtagggaaaggccacacatagagaaacatgcatggcataaaaacaaaatcactacagtgatgtgagctgacaatgtgacaaatgctttggacaagtcccctgaagaacgtttccagacagtgaccaaaatgaagatataggatataattaaggagaagaaagtagccatggatataaacccactgttggcagtgattacaaactctagcttgtaagtgtctacacaagcaagtttcatgacgcgaggaaaatcacagtaaaaactatctacttcattagggccacaaaagggcaagtttatgacaaaaacaaactgagatacagcatggattatccccactatccaggcagccactacaaaggagacacacgttttggggctcatgatggtcaggtagtggagaggtttacagattgcggtgtaccggtcatatgccatggctatgagcagcaccatctcgcctccacccatgacgtgaataaaaaatatctgtatcatgcattttggaaaggaaatgatgttgcagtcagtgaaaagatcagagatcgttttgggcactgtggtagaggacagacctagatcaagaagggagaggttggccaataggaagtacatgggggtgtgtaaatgagagtcaataattactgtgaacacaatgaagaggtttcccaggataattcccatgtagaacacagagaagaacccaaagagaaaaaggtgcatctcccatgaatttgaaaggccaatcaatacaaattcagataccacagtgtcatttggtccatccat

SEQ ID NO: 2578 - protein, 281 aa, Felis catus
MDGPNDTVVSEFVLIGLSNSWEMHLFLFGFFSVFYMGIILGNLFIVFTVIIDSHLHTPMYFLLANLSLLDLGLSSTTVPKTISDLFTDCNIISFPKCMIQIFFIHVMGGGEMVLLIAMAYDRYTAICKPLHYLTIMSPKTCVSFVVAAWIVGIIHAVSQFVFVINLPFCGPNEVDSFYCDFPRVMKLACVDTYKLEFVITANSGFISMATFFSLIISYIFILVTVWKRSSGDLSKAFVTLSAHITVVILFLCHACFSMCGLSLHHHWISICSLPTSLSPPS

SEQ ID NO: 2579 - DNA, 943 bp, Felis catus
tcaaccaattctggaatatactatcttttgcacacttgttttattgatacccttaggtctttgttctgtaatgtacagatggcagaattcgtgacaagggtgatagcaaagtcaacaacaaacaggtatttattaattgatgatgtggggaaaggccatacatagagaaacatgaatggagtgaaaaaagaactacgacaatgatgtgagttgacagagtgataaatgctttggataagtctcctgaagaatgtttccagacagtgaccaaaataaagacataggaaaggattattagcaggaagaaggtgcccatgctcatgaagccactgttggcagcaataataaactcaaacttggctgcatctctgcatgcaagttttatgatcctgggaagtcacagtaaaagctgtcttcttcattaggaccacaaaaaggcaagtttataatcaaagcaaactgagacatagcatgaatcaacccagttacccatccagtgattacaaatgaaacatatattttagggttcatcatgttcaggtagtgaagtgggttatagattgctgtgcacctgtcaaatgccatggcgatgagtaacaccatctccattccccctatgatgtggatgaaacgtatctgtgctatacaaccttggaaagaaattacttggcattcacttaaaaggtctttgattgtcttggggactataatagaagagaggcccacatcaatgagggacaagttggccagcaggaagtacataggagaatgtaagtgagaatcaaaaattatcaaaaacaaaataaaaagatttctcaacatgatcactaaatagagcaaagaacataacaaggtaaaaacaaacaaacaccccttttctcccaagagcaagaaaggccagtaacacaatctcagtgaccacagaatcatttagaccacccat

SEQ ID NO: 2580 - protein, 54 aa, Felis catus
STNSGIYYLLHTCFIDTLRSLFCNVQMAEFVTRVIAKSTTNRYLLIDDVGKGHT

SEQ ID NO: 2581 - DNA, 746 bp, Felis catus
agaaacatgaataaggtaaaaaactgagtcaacacagtgatgtgagctgacagagtgacaaatgccttgggtaagtctttctgagaacatttccagacagtgaccaaaataaggatataggaaaggattagtaaaaagaaggtgcccatgctcatgatgttattattggcagcaataataaattcaaacttggctccatctctgcatgcaagtttgatgattctggaaaagttataatagaaggtttttacttctaatataaccacaaaagcacacgtttgtaacgaaaacaaatggagacataagtagttaaccacagttacccagcaaatagttacaaatgaaacatgtattttagggttcatgatgtccaggtactgaagaggtttacagattgccatgtatctgtcagacgctatggctataactaacaccatctccactctgcccattatgtggatgaagcatgtctgtgccctgaaactttgcaaagaaatcttgcattcattaaaaaagtctataatcatcttgggaactgtggtaaagaaaagtccacatcaatgagggactggttggccagaaggaagtacacaggaaaatgtaaatgggaataaaaaaaaataccagaaagaaaatgaagaaatttcctgggacgatccctaaatagatcaaggagaatgtcaacatgagaaaaactttagtctcccaagatgtagaaagtcccagcaacacaaactcagaaacca

SEQ ID NO: 2582 - protein, 176 aa, Felis catus
MIIDFFNECKISLQSFRAQTCFIHIMGRVEMVLVIAIASDRYMAICKPLQYLDIMNPKIHVSFVTICWVTVVNYLCLHLFSLQTCAFVVILEVKTFYYNFSRIIKLACRDGAKFEFIIAANNNIMSMGTFFLLILSYILILVTVWKCSQKDLPKAFVTLSAHITVLTQFFTLFMFL

SEQ ID NO: 2583 - DNA, 914 bp, Felis catus
ctagaattcacattccatttactcagtcgtctcattgcagtcttcatgtctttgttcctcagtgtgtatataatcgggttcaagagaggagtgaccacagaataaaacacagcaagggatttatctagggacttgatggggaatggccaggcataaatgaagatacatggtccgaagaacaaaagaactactgtgatgtgagcagtcagagtggacagagccttggacgacttgtctgaagggcgttgctggatggttaccaggatgatagcataggagatgattaggaaaacaaaagaacacacagtgagcacaccactgttagcaatgaccatgacatccaatctataggtgtctatacaagcaagtttgataaccctaggtaggtcgcagtaaaagctatcaacctcattgggaccacagaaaggtaagtttactgcaaaagccaactggctcactgaatggagaaagccagttccccatgcagcagtcacaatgccaaaacatacatggtcacacataactgtagagtagcgaagaggtttacagattgctacatatctgtcaaaggccatggctataaggatcaccaactcactcccaccaaaaaagtgaacgagaaatatctgagcaaggcaacccttgaaagagatgactttgcgtttactgaaaaagtcagcaatcatcttgggggctgtgacggaagacagacataggtcaatgagtgagaggttagccagcaggaagtacatgggagagtgaagatgggagtcagaagccacagttatgacaataagaaggtttccaaacacaattcccacatagaatataaaaaagaacaccagtaggaatatctggaattcctgagaattggagagtcccagaaaaatgaactcagtcaccatggagtaatt

SEQ ID NO: 2584 - protein, 302 aa, Felis catus
  MOD_RES (302)..(302): Any amino acid
MVTEFIFLGLSNSQEFQIFLLVFFFIFYVGIVFGNLLIVITVASDSHLHSPMYFLLANLSLIDLCLSSVTAPKMIADFFSKRKVISFKGCLAQIFLVHFFGGSELVILIAMAFDRYVAICKPLRYSTVMCDHVCFGIVTAAWGTGFLHSVSQLAFAVNLPFCGPNEVDSFYCDLPRVIKLACIDTYRLDVMVIANSGVLTVCSFVFLIISYAIILVTIQQRPSDKSSKALSTLTAHITVVLLFFGPCIFIYAWPFPIKSLDKSLAVFYSVVTPLLNPIIYTLRNKDMKTAMRRLSKWNVNSX

SEQ ID NO: 2585 - DNA, 939 bp, Felis catus
ttatgacatctctctagaacttacaacttgtcgactcagccttctcattgctgccttcatatctctgttccttaaagtatagatggcaggatttaagacaggagtgacgacaaagtccacaatggcaaaaaatgtatccattgacttggtaggaaaaggccacacatagagaaacatgcatggaacaaaaaacaaaaccactacagtgatgtgagctgacaaagtgatgaatgctttggataaatcctttgaagaatgttgtctgacagtgatcagaataaagatgtatgatacaattaagaaaaagaaggtgcccatagatatgaagccactgttagcagtgaccacaaattctagtctgtaagtgtccatgcatgcaagtttaataaccctaggaaaatcacagtaaaagctccccacatttttagggccacagaaaggtaaatttatgacaaaaacaaattgagacacagcatggatcaccccaatgatccaagcagtcattaccaaaagcatgcacattttgagattcataatagttaagtagtggagaggcctgcaaattgccgtgtacctgtcatatgccatggctatgagcagtatcatctcaactcctcccatgacatgaataaaaaacatttgtatcatgcaactatggaaggagatgattttgcaatcactgaaaagatcagagatcatcctaggaactgtggtagatgaaaggcccaggtcaatgaatgataagttggccagcaggatatacatgggagagtgtaagtgagaatcaaaaatcactgtaaacataatgaagaggtttcccaagataattcccgcatagaataaagagaagaaaagaaaaagcaaaacctgcattcccaaggattgtgcaagtcccagtaacacaaattcatttaccacagagccatttacttggtccat

SEQ ID NO: 2586 - protein, 312 aa, Felis catus
MDQVNGSVVNEFVLLGLAQSLGMQVLLFLFFSLFYAGIILGNLFIMFTVIFDSHLHSPMYILLANLSFIDLGLSSTTVPRMISDLFSDCKIISFHSCMIQMFFIHVMGGVEMILLIAMAYDRYTAICRPLHYLTIMNLKMCMLLVMTAWIIGVIHAVSQFVFVINLPFCGPKNVGSFYCDFPRVIKLACMDTYRLEFVVTANSGFISMGTFFFLIVSYIFILITVRQHSSKDLSKAFITLSAHITVVVLFFVPCMFLYVWPFPTKSMDTFFAIVDFVVTPVLNPAIYTLRNRDMKAAMRRLSRQVVSSREMS

SEQ ID NO: 2587 - DNA, 936 bp, Felis catus
tcaacaaaatttggagttagatatccttttgtgcagtctttttatagataaccttatgtctttgttccttagtgtatagataacaggattcaagacaggggtaatagcgaagtctacaacgaacagatttttatcaattgaaggtgggggagaaggccagacatacagaaacatgcatggagtgaaaaacaaaaacaccacagtgatgtgagctgacaaagtaacaaatgccttggataattctcctgaagaacgtttccagacagtgatcaaaatgaatgaataggaaaggattagcaggaagaaggtgcccatgctcatgaagccactgttggcagtaacgataaactcaaacttggccgcatctgtgcatgcaagttttatgatcttaggaaagtcacagtaaaagctgtccactttattaggaccacaaaaaggcaagtttataacaaataaaaactgagacatagcatggatcaccccagttacccatccagtgattacaaatgaaacacatattttagggttcatgatgtttaggtagtgaagaggcttacagattgctgtgcacctgtcaaatgccatggctatgagtaacaccatctccactcctcctatgatgtggatgaagcatatctgtgtcatacaactttggaaagaaattattttgtattcatttaagaggtctgtgattatctttggaactgtagtagaggaaagacccacatcaatgagggacaggttggccagcaggaagtacatgggagaatgtaggtgcgaatcaaaaattaccaaaaacaaaataaaaaggtttcccaagatgacccctaaatacagcaaagaacatatcaaaataagaaaaagttttttctcccaagagcaagaaagggccagtaacacaatttcagtgaccacagagtcatttagtccacccat

SEQ ID NO: 2588 - protein, 311 aa, Felis catus
MGGLNDSVVTEIVLLALSCSWEKKLFLILICSLLYLGVILGNLFILFLVIFDSHLHSPMYFLLANLSLIDVGLSSTTVPKIITDLLNEYKIISFQSCMTQICFIHIIGGVEMVLLIAMAFDRCTAICKPLHYLNIMNPKICVSFVITGWVTGVIHAMSQFLFVINLPFCGPNKVDSFYCDFPKIIKLACTDAAKFEFIVTANSGFMSMGTFFLLILSYSFILITVWKRSSGELSKAFVTLSAHITVVFLFFTPCMFLYVWPSPPPSIDKNLFVVDFAITPVLNPVIYTLRNKDIRLSIKRLHKRISNSKFC

SEQ ID NO: 2589 - DNA, 924 bp, Felis catus
cataatgtccccatttgctcaatctttttattgatatctttatgtctttgttccgtaatgtatagatggcaggattcaagacaggggtgatagcaaagtcaacaatgaataggtatttatcaattgatgacgtggggaaaggccatacatagagaaacatgcatggagtgaaaaatagaaccaccacagtgatgtgagctgacagagtgacaaatgctttggataagtctcctgaagaacgtttccagacagtgaccaaaatgaagatataggaaaggattagcaggaagaaggtgcccatgctcatgaagccactgttggcagcaataacaaactcaaacttggctccatctgtgcatgcaagttttatgacctgggaaagtcacagtaaaagctgtctactttattaggaccacaaaaaggcaagtttataatgaaagcaaactgggacatagcatggatcacccaatgacccagccagcaattacaaatgaaacacatattttagggttcatgatgttcaggtagcgaagaggcttacagattgctgtgtacctgtcaaatgccatggcgatgagtaacaccatctccactcctcccatgatgtggatgaagcatatctgtgtcatacaactttggaaagaaattatcttatactcatttagaaggtctgtaatcatctttggaactgtggtagaggaaagccccacatcaatgagggataggttggccagcaggaagtacataggagaatgtaaatgagaatcaaaaattaccaaaaagaaaatgaaaagatttcccaggatgatccccaaataaatcaaggaaaatatcaacatgagaaaaactttagtttcccaagaactagcgagtcccaacaacataaactcagaaacaacagattcatttagtccattcattgac

SEQ ID NO: 2590 - protein, 153 aa, Felis catus
SMNGLNESVVSEFMLLGLASSWETKVFLMLIFSLIYLGIILGNLFIFFLVIFDSHLHSPMYFLLANLSLIDVGLSSTTVPKMITDLLNEYKIISFQSCMTQICFIHIMGGVEMVLLIAMAFDRYTAICKPLRYLNIMNPKICVSFVIAGWVIG

SEQ ID NO: 2591 - DNA, 894 bp, Felis catus
acttatcagtctctttatggcattcctaatgtctttatttctcagtgtgtaaatggctggattcaggagaggtgtgattactgtgtaaaacacagcaagaaacttgtccacccaagtgatgctaagtggccacagatagatgaagatgcagggtccaaagaacagcagcaccactgtgatgtgggcggtacaggtagacagtgcctttgatgctccattcttagagtgaaggcgcactgttactaggatataggtgtaggagatgagtaggataatgaagcaagttgttgccaagaccccactgtcagcatttatcaatattcctagagtatgtgtatccatgcaggccaatttgatcaccaaagggatatcacagaaaaaactgtccactgttctgggtccacagaagggcagatctaaaatcatagctagttggctcatggcatgcacaaagccaatgacccatgatatcaaaaccagccagaggcacttttgtctgtccatgatgctggaataatggagtggcttgcagatggccacataacggtcataggccattgtcacgagtagcaccatctcaccccctgcaaaaaaatgcacacagaggatctggctcatgcagccaccgaaggagatggtcttattatcctttaggaagtctatggtcagtttaggggtagttactgaggaaaggcagaagtccacaaatgagagattggctaagaggaagtacatcggggagtggagatgagggtcagtgatgaataagaacacgacaaggaggttgcccacaaccgtcatcaggtaaagcatggaaaatggcagtaagaggaagttctggagctctcttgaattacaaagtccacgaaaaataaactcagacaccacagactg

SEQ ID NO: 2592 - protein, 298 aa, Felis catus
QSVVSEFIFRGLCNSRELQNFLLLPFSMLYLMTVVGNLLVVFLFITDPHLHSPMYFLLANLSFVDFCLSSVTTPKLTIDFLKDNKTISFGGCMSQILCVHFFAGGEMVLLVTMAYDRYVAICKPLHYSSIMDRQKCLWLVLISWVIGFVHAMSQLAMILDLPFCGPRTVDSFFCDIPLVIKLACMDTHTLGILINADSGVLATTCFIILLISYTYILVTVRLHSKNGASKALSTCTAHITVVLLFFGPCIFIYLWPLSITWVDKFLAVFYTVITPLLNPAIYTLRNKDIRNAIKRLIS

SEQ ID NO: 2593 - DNA, 940 bp, Felis catus
ttagcagagtctgacataatgtccttatttgctcaatctttttatggctacctttatgtctttatttcttaacgtatatatgatgggatttaagatgggtgtgatagcaaagtcagcaatgaacaggtatttatcaactgacgatgtggggaaaggccatacatagagaaacatgcatggagtgaaaaatagaaccaccacagtgatgtgagctgacagagtgacaaatgctttggataagtctcctgaagaacgtttccagacagtgaccaaaataaagatataggaaaggattagcaggaagaaggtgcccatgctcatgaagccactgttggcagcaataataaactcaaacttggctccatctgtgcatgcaagttttatgattctgggaaagtcacagtaaaagctgtctactttattaggaccgcaaaagggcaagtttataatgaaagcaaactgggacatagcatggatcaccccaatgacccagccagcaattacaaatgaaacacatattttagggttcatgatgttcaggtagcgaagaggcttacagattgctgtgtacctgtcaaatgccatggcgatgagtaacaccatctccactcctcccatgatgtggatgaagcatatctgtgtcatacaactttggaaagaaattatcttgtgttcatttaaaaggtctctaatcattttggggactgtggtagaggcaacccccacgtcaatgaaggacagattggccagtaggaagtacataggagaatgtaaatgagaatcaaaaattaccaaaaagacaatgaagagatttcccaggatgattcctaaatagatcaaggaaaatattaatgtaagaaaaactttagtttcccaagaactagagagtccaagcaacacaaactcagaaaccatagaattatttaatccatccattgac

SEQ ID NO: 2594 - protein, 303 aa, Felis catus
MDGLNNSMVSEFVLLGLSSSWETKVFLTLIFSLIYLGIILGNLFIVFLVIFDSHLHSPMYFLLANLSFIDVGVASTTVPKMIRDLLNEHKIISFQSCMTQICFIHIMGGVEMVLLIAMAFDRYTAICKPLRYLNIMNPKICVSFVIAGWVIGVIHAMSQFAFIINLPFCGPNKVDSFYCDFPRIIKLACTDGAKFEFIIAANSGFMSMGTFFLLILSYIFILVTVWKRSSGDLSKAFVTLSAHITVVVLFFTPCMFLYVWPFPTSSVDKYLFIADFAITPILNPIIYTLRNKDIKVAIKRLSK

SEQ ID NO: 2595 - DNA, 927 bp, Felis catus
aattactctccagtgtctgaatttgtgttgctgggactttctacctatagaccagtgcagcattttctccttgctttctctgcagtgttttatgtaacaattgttctgggaaaccttttggttgtgttcgcagtgacctttgacccattcttacattctcccatgtacttccttttagccaatctctcattcattgatttgtgtttttctaccttaacagttcctaagatgattcataacctatactctgggtacaaaaccatatcctttcagggctgtgtcatccagatatttgcccttcatgtcctgggtggatccgagatggtcctgctcatcgccatggccttggacagatatgtggccatatgcaagcccctccactacctgattatcatgagcccacagatgtgcattttgcttctgtccggtgcttgggttattggcctcattcatgcagtggtccaggtagcttttgttgtccatttgcctttttgcggtcctaatgagatagatagcttttactgtgaccttccttggtttatcaaacttgcctgcaccgacacctacagaatggaattcatggttactgccaacagtgggttcatttccatgggcaccttcttcttattgctcatctcctatatcttcatcctggtcactgtatggaaacgttcctcaggtggtttgtctaaagccttttctactctgtcagctcacatcactgtggtggttttgttcttcggaccgtgcatctttgtttatgtgtggccatttcccacagtgccagtggataagtttcttgccattttggactttatgatcacacccattctgaatcccattatctacacgttgaggaacaaggacatgaagatggcaatgaaaagactgagtagtcaattcctgagtttgagaatgatctcctaa

SEQ ID NO: 2596 - protein, 308 aa, Felis catus
NYSPVSEFVLLGLSTYRPVQHFLLAFSAVFYVTIVLGNLLVVFAVTFDPFLHSPMYFLLANLSFIDLCFSTLTVPKMIHNLYSGYKTISFQGCVIQIFALHVLGGSEMVLLIAMALDRYVAICKPLHYLIIMSPQMCILLLSGAWVIGLIHAVVQVAFVVHLPFCGPNEIDSFYCDLPWFIKLACTDTYRMEFMVTANSGFISMGTFFLLLISYIFILVTVWKRSSGGLSKAFSTLSAHITVVVLFFGPCIFVYVWPFPTVPVDKFLAILDFMITPILNPIIYTLRNKDMKMAMKRLSSQFLSLRMIS

SEQ ID NO: 2597 - DNA, 927 bp, Felis catus
tcagcaaaccatgtgacgactcagtaacctcctcatggaagcttttacttcctggttgcgaagggtataaatcacagggttcatcaaaggaaagatcactgtgtgaaagagagaaaccactttgtcggctgggaaagctctgaagggacgagtatagatgaagatggcaggtccaaacatgagaaacacaatgataatgtgtgtggtacatgtggaaagagccttgtgtttgccttcagaggtgtgtcccttcacacgatagaggatgacagcataagaggccagaagccccaggaagcacagcagggtaagcaggccactgttggagaccatcaggagctccaccacaaaggtgtctgtgcaggccagcttgatgacctgtggcacatcacagaagaagttatccagctggtttgggccacagaagggcaagtggagaataagggctacttgcacaatggaatgagtaaagcccccaagccacagagccaacagcaaggcattgcagattctagggttcataacagtggtatagtgcaaaggatgacaaatggccatgtagcggtcaaaggccatcacaacaagaaggaacatctcccctgccccaagaaagtgcaagaaaaaaagctgagtgatgcagcccctgtaggagattattttcttctcagagaggaagtccatcagcatcctgggggccacaatgaaggagtaggatgcatccaggaaagccaagttgcccagaaagaagtagaggggggctgtgaggccagggtctgatctgatggtgaggatgatgagtagatttccagggagaatgatgaggtagaaaactaagactagcacaaagaccaggagttgagcctgttgagactgggtgagaccaaggaggataaattctgtcaccactgtgctgttctccctctccat

SEQ ID NO: 2598 - protein, 308 aa, Felis catus
MERENSTVVTEFILLGLTQSQQAQLLVFVLVLVFYLIILPGNLLIILTIRSDPGLTAPLYFFLGNLAFLDASYSFIVAPRMLMDFLSEKKIISYRGCITQLFFLHFLGAGEMFLLVVMAFDRYMAICHPLHYTTVMNPRICNALLLALWLGGFTHSIVQVALILHLPFCGPNQLDNFFCDVPQVIKLACTDTFVVELLMVSNSGLLTLLCFLGLLASYAVILYRVKGHTSEGKHKALSTCTTHIIIVFLMFGPAIFIYTRPFRAFPADKVVSLFHTVIFPLMNPVIYTLRNQEVKASMRRLLSRHMVC

SEQ ID NO: 2599 - DNA, 932 bp, Felis catus
ttctatgtggagataacattttggaactgtaattttctcatggcctctttcattttctgatttctcagggtataaataataggatttagtaagggtgtgaaaacagtgtaaaatacagcaaggactttatttcctgagaagctattgaatggccaggcatagataaaaatacaaggtccaaagaacagagtgaccacaatcatgtgtgcagacagtgtggacagtgccttggagagacctcccgatgatttttgttgtacggtgatcaggatgacaatgtaggagacaagaaggaggatgaaacagatgaatgagagcagcccactatcagcaatgacaaataattccagggtatatgtttccatacaagcaagcttaatcacaaggggaaggtcacaaaatatattgtctatgacattggggccacagaaaggcaagtttactgttaataccatctggctcatggtgtgtataaaaccaattatccatgaaagtatcataaacccactcaacagcctgtggctcatgattgtcctgtagtgcaggggtttacatatggctacatatctgtcaaaggccatagctatcaaaagagtcatctcagcacccccaaagaagtgcataaagaacatctgagtcatgcagccccataaggagatgatcttgtgttcactgagtaagtctgtgatcatcttgggtgtggtgactgtggagagacacatgtccaaaaaagagaggtttccaaggaggaagtacatgggagaatgaagggtggaactaaatgtcactgtgaccataatgagaacattccccaacacagtagcactgtagattaaggagaatgttacaaagaagaaaatccgaagttcccattgtccagaaaatcctagtaaaataaactcagtcactacagatccatttttaagatccat

SEQ ID NO: 2600 - protein, 309 aa, Felis catus
MDLKNGSVVTEFILLGFSGQWELRIFFFVTFSLIYSATVLGNVLIMVTVTFSSTLHSPMYFLLGNLSFLDMCLSTVTTPKMITDLLSEHKIISLWGCMTQMFFMHFFGGAEMTLLIAMAFDRYVAICKPLHYRTIMSHRLLSGFMILSWIIGFIHTMSQMVLTVNLPFCGPNVIDNIFCDLPLVIKLACMETYTLELFVIADSGLLSFICFILLLVSYIVILITVQQKSSGGLSKALSTLSAHMIVVTLFFGPCIFIYAWPFNSFSGNKVLAVFYTVFTPLLNPIIYTLRNQKMKEAMRKLQFQNVIST

SEQ ID NO: 2601 - DNA, 708 bp, Felis catus
tctttattcctgaatgtgtagatgattggatttaaaaggggagtaaaaatggtgtaaaacacagaaaggatcttatctatggagatcttgctgaatggccatatgtagataaagatgcaaggtccaaagaacagcaccaccactgtaatgtgggttgagagagtggacaaagccttggaagacctggtggaggagtgacgctggacagtaattagaatgatgctataggagatgaacagaaaggtgaaacagaacaaagcaagtagtccactgaatgcaatgaccaatagctccaggatgtaagtgtcagtgcaggcaagtctgatgacccgaggcagatcacaaaaaaaaactatccacaacattgggaccacagaatggtaaagttactgtgaacaccatttggctcatagtgtgtacaaaaccagtggtccaggaaaaaagtgcaagtccaatgcaaacatgatggttcatgatatttttgtaatggagaggtttgcaaatagcaatgaatctatcaattgccatggctacaagcaacatcatctcacttccacctaaaaggtgaaggaagaacatctgggccatgcagcctttataggagatagccttatattcactaattaggttacagatcattttaggagtagcaaaggaggccagggacatatcaataaaggagaggttggccagcaggaagtacattgg

SEQ ID NO: 2602 - protein, 122 aa, Felis catus
PMYFLLANLSFIDMSLASFATPKMICNLISEYKAISYKGCMAQMFFLHLLGGSEMMLLVAMAIDRFIAICKPLHYKNIMNHHVCIGLALFSWTTGFVHTMSQMVFTVTLPFCGPNVVDSFFL

SEQ ID NO: 2603 - DNA, 897 bp, Felis catus
tgaagcaaaatactctgaagtcttaatttgtattcctgggactttctacctatggaccagtgctacattttctccttgctttctctactgggttttctgtaacaatggtcctgggaaacctccttgtgtttacagtgacctttgatcctcatttacattaccccccatgtacttccttttagctaaactctcctttattgatttgtgtctttccaccttaagggtttctaagatgattgtgacctgtattctgggcacaaaaccacatactttcaggggtgtgtcaccagatgtttgcccttcatgtcctggctggatctgagatggtcctgcttattgctctggccttggacagatatgtggccatatgcaagcccctccactacctgactatcatgagcccacagatgtgcattttgcttctgtccagtgcttgggttattggcctcattcatgcagtggtccagttagcttttgttgtccatttgcctctttgtggtcctaatgagataaatagcttttactgtgaccttccttggcttatcaaacttgcctgcacagacacctacagaatggaattcatggttaatgccaacagtgggttcgtttccatgggcaccttcttcttagtgcttatctcctatatcttcatcctggtcactgtatagaaatgttcctcatgtggtttgtctaaagccttttctactctgtcagctcacatgactgtggtggttttgtttttcggaccgtgcatctttgtttatgtgtggccatttcccacagtgccagtggataagttttcttgccatgttggactttatgatcacacccattctgaatcccattatctacacattgaggaacaaggacatgaagttggcaatgaggagacggagt

SEQ ID NO: 2604 - protein, 64 aa, Felis catus
TPSPHCQLHVLVPQCVDNGIQNGCDHKVQHGKKTYPLALWEMATHKQRCTVRKTKPPQSCELTE

SEQ ID NO: 2605 - DNA, 858 bp, Felis catus
tgtgtttggtcttcagtctactaatggctactttcatctcctgattccttagagtgtaaataatggggttcagtaaaggtgtaataattgaataaaacacagaaagaaatttatccactgaaaagctactgaatggccaagcataaatgaagataattggcccaaagaacagagtgaccacagtaatgtgagcggacagtgtggacagagccttggagagtccaccagaagatcgacgtcggacagttaccagaatgacagtgtaggaaatgagcaagagtatgaagcagatgaaagacaacagtccactgtcagcagttaccagcaactccagaacataagtctcagtgcaggcaagttttagcactaggggaaggtcacaaaaaatatcgtccactatattgggaccacagaagggcaagttgatagtaaaaaccatctggctcatcgtatgcacaaaaccaactgcccaggacagcagcacagagccggtgaggactcggcggttcatgatggatgtgtagtgaagaggtttgcatattgcaatgtaccgatcaacagccatgactatgagaagagtcatctcactgccccctaaaaagtggaggaagaacatctgagccatacagccccacaaggaaatagttttgttctccttgagaaaatctgtgaccatcttaggggctgtgattgtagaaatacacatatccagaaaggagagatttccaaggaggaagtacattggtgtggagtacagatgtgagtcaaaggttatggtgaccacgatgagaaagtttcctgccacaatagctgcataggccaacaaaaatatgaaaaaaaagaaaatttcaagttccc

SEQ ID NO: 2606 - protein, 286 aa, Felis catus
  MOD_RES (286)..(286): Any amino acid
ELEIFFFFIFLLAYAAIVAGNFLIVVTITFDSHLYSTPMYFLLGNLSFLDMCISTITAPKMVTDFLKENKTISLWGCMAQMFFLHFLGGSEMTLLIVMAVDRYIAICKPLHYTSIMNRRVLTGSVLLSWAVGFVHTMSQMVFTINLPFCGPNIVDDIFCDLPLVLKLACTETYVLELLVTADSGLLSFICFILLLISYTVILVTVRRRSSGGLSKALSTLSAHITVVTLFFGPIIFIYAWPFSSFSVDKFLSVFYSIITPLLNPIIYTLRNQEMKVAISRLKTKHX

SEQ ID NO: 2607 - DNA, 924 bp, Felis catus
atggaaagggtgaaccattcagtggtgtctgagttcattttgctgggactttccaaatctcagaatcttcagattttattcttcctaggattctctgtggtctatgctgggattgtgttaggaaaccttctcatcttggtcaccgtgacctttgactcacgccttcacacaccaatgtattttctgcttatcaatctctcctgtatggatatgatcttggcttcttctgctacccctaagatgattgtggatttcctccgaaagcggaagaccatctcttggtggggatgttattctcagatgttcttcatccacctcctaggtgggagtgagatgatgttgcttgtagccatggcaatagacaggtatgttgccatatgcaaacccctccattacatgtccatcatgaacccccgagtgcttggtgggctgctgctatcctcctacacagttggatttgtgcactcatctagtcaaatggctttcatgttgaatttgcccttctgtggtcccaacgtggtggacagcttcttctgtgaccttccccttgtgatcaaactcgcctgcaaggataccttcatgctacaactgctggtcattgctgacagtggcctcctgtccctggtctgcttcctcctcttgcttgtctcctacatggtcatcatacactcagtcaggcaccgtgctgctagtggttccgccaaggccttctccactctctcggcacacatcacggttgtgactttatcgtttgccccatgtgtctttatctatgtatggcccttcagcagatactctgtagataaaattctttctgtgttttatacaattttcacacctctcttaaatcctattatttatacattaaggaatcaagaagtaaaagcagccattaagaagataagaactcgacacataaattca

SEQ ID NO: 2608 - protein, 308 aa, Felis catus
MERVNHSVVSEFILLGLSKSQNLQILFFLGFSVVYAGIVLGNLLILVTVTFDSRLHTPMYFLLINLSCMDMILASSATPKMIVDFLRKRKTISWWGCYSQMFFIHLLGGSEMMLLVAMAIDRYVAICKPLHYMSIMNPRVLGGLLLSSYTVGFVHSSSQMAFMLNLPFCGPNVVDSFFCDLPLVIKLACKDTFMLQLLVIADSGLLSLVCFLLLLVSYMVIIHSVRHRAASGSAKAFSTLSAHITVVTLSFAPCVFIYVWPFSRYSVDKILSVFYTIFTPLLNPIIYTLRNQEVKAAIKKIRTRHINS

SEQ ID NO: 2609 - DNA, 926 bp, Felis catus
tgcagaattattccttggtgtcagaatttgtgttgtatggactctgcacttcacagcatctccaacattttttctttatatttttctctgggatctatgtggtcactgtgctgggtaacctcattattgtggtcactgtaatttctgacccccacttgcactcttcccctatgtacttcctgctgggaaatctatccttcttggacatatggctagcctcatttgccacccccaagatgatcagggactttctcagtgatcgaaagctcaactcctttggaggatgtatggctcagatcttcttcttgcactttattggtggggctgagatggtgcttctggtttccatggcctatgacagatatgtggctatatgcattcctttgtattacatgactatgatgagctggcagacctacatggatctggtgttcatttcatggatcgttggatttgtgcactccatcagccaagtagcctttactgtgagtttaccttactgtggccccagtgaggtggacagcttcttttgtgaccttcctcttgtgatcaagcttgcctgcatggacacttatgtcttgggtatactcatgatctcagacagtggggttgctctctatgagctgttttgtgctcctcttggtctactacactgttgtcatcatcactgtccaacaacatgctgctggtggggtatccaaagcactctctacttgctctgcatgtatcatggtaatcatgctctctcttctttgggccctgcattttcatttgtgtgtggcctttcagttggttctttgtggacaagcttctgtttgtgtttttacaccatttttactcctctcttgaacccccttatctacacattgagaaataaagagatgaaaacagctatgaagaagctgtgaaccaacatgtgacttctc

SEQ ID NO: 2610 - protein, 301 aa, Felis catus
QNYSLVSEFVLYGLCTSQHLQHFFFIFFSGIYVVTVLGNLIIVVTVISDPHLHSSPMYFLLGNLSFLDIWLASFATPKMIRDFLSDRKLNSFGGCMAQIFFLHFIGGAEMVLLVSMAYDRYVAICIPLYYMTMMSWQTYMDLVFISWIVGFVHSISQVAFTVSLPYCGPSEVDSFFCDLPLVIKLACMDTYVLGILMISDSGVALYELFCAPLGLLHCCHHHCPTTCCWWGIQSTLYLLCMYHGNHALSSLGPAFSFVCGLSVGSLWTSFCLCFYTIFTPLLNPLIYTLRNKEMKTAMKKL

SEQ ID NO: 2611 - DNA, 942 bp, Felis catus
ttatgtctcctactttttccaagtaagtccactcctgtcccacagtttctgcatggctgacttgacctctttgttccgaagtgtatagatgaggggattcatcatgggggtaataacattgtagagtacagacaccatcttgtccacagaaaaagtggagaagggacgggcatagatgaaaatacagggtccaaagaagagtgttaccaccatgaggtgggagccacaggtggagagtgcctttcgccttccctccttggagcgaatcttgaccaggatagtggagtaggaagaaaccagtaccacaaaggagctggtagagatcaacccactgttagataccattagcaattcaatgacaaaggtgtctgtacaggcaagtttaatgacagggggaacatcacaaaagaagttgtccacatggtttggtccacaaaagggcagacggatagtgagaatcgtctggacagtagagtgcacaaatcctcccatccaggaggcagctaccaacacacagcataatcctcgactcatgatagtggtataatgcagggggcgacaaattgcaacatagcgatcataggccatcactgtgagcaggaacatctcagctgcccctacaaaatgcagaaaaaagagctgtgcaatgcattggtcatagtgaatgagcttgtcattatcaagaaagtcagccagaagcttcggagtagttactgttgaataacataagtccaggaaagagaggttgccaagaaggaaatacataggtgatgaattcaaatagttatcagaggccactgtgaccatgatgaggacattgcctacccaagtggacacatagaagaaaagaaatagtacaaatagtcctgcctcagtagatggtgtctgcgagaagcctgccaggacaaagtctgtcaccaccgctgtttgattttcatccat

SEQ ID NO: 2612 - protein, 310 aa, Felis catus
MDENQTAVVTDFVLAGFSQTPSTEAGLFVLFLFFYVSTWVGNVLIMVTVASDNYLNSSPMYFLLGNLSFLDLCYSTVTTPKLLADFLDNDKLIHYDQCIAQLFFLHFVGAAEMFLLTVMAYDRYVAICRPLHYTTIMSRGLCCVLVAASWMGGFVHSTVQTILTIRLPFCGPNHVDNFFCDVPPVIKLACTDTFVIELLMVSNSGLISTSSFVVLVSSYSTILVKIRSKEGRRKALSTCGSHLMVVTLFFGPCIFIYARPFSTFSVDKMVSVLYNVITPMMNPLIYTLRNKEVKSAMQKLWDRSGLTWKK

SEQ ID NO: 2613 - DNA, 1009 bp, Felis catus
tgtaatttggaaatctgttatttttgcagcattacaaacaaatgaatattccaacataaataattgctctagctctgtgagtaaattcatccttttaggcttttcttatacctgggaaattcagattttcctcttttcagtcttctctgggacatatattctgacactaactggaaatctttgtattatctgtgctgtgatgtgggaccatcaactacaaactccaatgtacatcctgctggccaatttttccttcctggagatctggtttatcacctccactgtccctaatatgctagccaactttctctctgagaccaacaccatttctgtctctggatgcttcctccagttctacttcttcttctccctgggcaccactgagaccttcttcttgtctgccatggcctttgacaggtaccttgctatctgcaggcccctgcattaccccactgtcatgacagttcaacgctgcatcagaacaggagctgggtgttgggtgtgtggcttcctgtacttccccttgcctatttacctcatctctcagcttccattttgttgtcccaatacaattgatcatttcctgtgtgacccaggacctcttataaagctgtcctgtgtgccagctcctgccactgagatcatctgtgctatctataactcagtcctcattttcaccaccttagtcttcattatcagctcctataccttggtgatcagagctgtgctgaaggtcccctcagcagaaggtcggcataaggctttctccacatgtggctcccatttggctgtggtgtccctgttctatggctctatcatggttgtatatgtgagcccaacagcaggcaatccagcagggattcagaaatatgtgactttgtcctattctgtgttaactccactcttcaaccccttgatctatagtcttcgaaataaagagatgaaggtggctctgagaaagttatttagaatggtgagatttagtcgtaggcatggaagaaatctttga

SEQ ID NO: 2614 - protein, 335 aa, Felis catus
VIWKSVIFAALQTNEYSNINNCSSSVSKFILLGFSYTWEIQIFLFSVFSGTYILTLTGNLCIICAVMWDHQLQTPMYILLANFSFLEIWFITSTVPNMLANFLSETNTISVSGCFLQFYFFFSLGTTETFFLSAMAFDRYLAICRPLHYPTVMTVQRCIRTGAGCWVCGFLYFPLPIYLISQLPFCCPNTIDHFLCDPGPLIKLSCVPAPATEIICAIYNSVLIFTTLVFIISSYTLVIRAVLKVPSAEGRHKAFSTCGSHLAVVSLFYGSIMVVYVSPTAGNPAGIQKYVTLSYSVLTPLFNPLIYSLRNKEMKVALRKLFRMVRFSRRHGRNL

SEQ ID NO: 2615 - DNA, 850 bp, Felis catus
caatactaaaaggccatttctcatatggaaatttgttatttttgcagcattacagacaaatgaatattccaacataagtaattgctctagttctaggagtaaattcattctttgggtttcccttatacctgggaaattcagaggaaagagaaaaatcctttcagtcttctctggaatatatttgttgacactaactggaaatccgttatctgtgctgtgatgtgggaccatcaactacaaactccaatgtacatcctgctggccaatttttccttcctggagatctggtttatcacctccactgtccctaatatgctagccaactttctctctgaggccaacaccatttcggtctctggctgcttcctccaatcctacttcttcttctccctgggcaccactgagaccttcttcttgtctgccatggcctttgaccagtaccttgctatcttcaggcccctgcattaccccactgtcatgtcagttcagcactgcatcagaacaggagctgggtgctgggtatgtggcttcctgtatttcctgttgcctatttacctgatctctcagctcccattttgttgttccagtaagattgatcacttcctgtgtgacctagacatcctcataaatctgtcccgtatgccatttcctgccactgagatcatctgtgccatctttaactcagtcttcattttccccacctttctttttattgccagctcctacgtcctggtgagtagaactgtgctcagggtcccttctccacgtgtggctcccatctggctgtggtatccctgttttatggctctatcatggttgtatatgtaagtccaacagcagacaatctagc

SEQ ID NO: 2616 - protein, 77 aa, Felis catus
MVPHHSTDNGFPVSVNKYIPEKTERIFLFPLNFPGIRETQRMNLLLELEQLLMLEYSFVCNAAKITNFHMRNGLLVL

SEQ ID NO: 2617 - DNA, 975 bp, Felis catus
ttactttgtttccagaaaaagaacatttcttatggctgcagaaacctggccagacttcagataccgactcttcagttttaacatggctgccttcacttctttgttccttagagtgtagataattgggtttaaaataggagtaaagattgtgtagaacacagcaaggactttgtcgacagaataactgctgaagggccacacatagatgaagatgcatggtccaaagaatagggtgaccacagtgatatgggcagtcaacgtggaacgggcctttgccatgctagcagaggagcgtttcctgactgtgataagtatcacagtgtaggagacaaccaagaggagaaaggaactcatagaaagaaagccactgtctgcaactataagtaggctgacaacataagtgtcaatgcatgccagcttggtcactaaagggaggtcacagaaaaaactatctacctgattagggccacaaaaaggcaagttaattgtaaatgccaactggctagtagtatggataaaacccacaagccaggagatgagaacaagaataatacacacacggcgactcatgattgtcatgtagtggagaggtttgcatatagcaacataacggtcataagccatggatacaaggagcaccatttcactgccagtgaaaaggtgaacaaagaaaatctgggccaaacaggcatcaaaagaaatagtcttctgctcaaccagaaagtctgcaatcattttgggtgtagcaaaagaggcaacacatatatctacaaaagagaggtttgcaagcaggaagtacatgggggtgtgaaggtgagaatctgaggttacagtgaggatgataagaaagtttcccagcagtattgctaggtaaagtagtgaaaatatgacaaacaagaaaggttggagctcctgggaattagagagtcccagcaacacaaactctgtcacccgggaatgatttgtctcattcat

SEQ ID NO: 2618 - protein, 324 aa, Felis catus
MNETNHSRVTEFVLLGLSNSQELQPFLFVIFSLLYLAILLGNFLIILTVTSDSHLHTPMYFLLANLSFVDICVASFATPKMIADFLVEQKTISFDACLAQIFFVHLFTGSEMVLLVSMAYDRYVAICKPLHYMTIMSRRVCIILVLISWLVGFIHTTSQLAFTINLPFCGPNQVDSFFCDLPLVTKLACIDTYVVSLLIVADSGFLSMSSFLLLVVSYTVILITVRKRSSASMAKARSTLTAHITVVTLFFGPCIFIYVWPFSSYSVDKVLAVFYTIFTPILNPIIYTLRNKEVKAAMLKLKSRYLKSGQVSAAIRNVLFLETK

SEQ ID NO: 2619 - DNA, 936 bp, Felis catus
ctagtttttccaggagttcacatgacggtttctcagctttcgcatggctgatttaacatcttcattccttagagagtagattatgggattcaacaggggcgtacaaacagtgtagaacacagaaaggaacttatccacagaaagtctgctaaaaggccatatatagaagtaaatgcaaggcccaaagaaaagaatcaccactgtgatgtgagcagttaatgtagaaagtgccttggatgacccactggaggaccggcgacgaacagtgatcaaaatgatggtgtaggaaataattaaagccagaaaacagcccaatgatatcaggccactgttagttagggtcataatttccatttcataagtatccatacaagccagctctatcactaggggaaggtcacaaaagaagctatcgacctcattggggccacagaatggcaaatccactgtaaaagccaagtgactcacagaatgaagaatacccacagcccaggaaataaatacgaaaattatacatagtctccgattcataattgtgctataatgtaggggcttacagatggctataaatctgtcatatgccatagctacaagcaacatcatctcactcccaacaaaactgtgaagaaggaatatctgggccatgcagccctcaaaggagatcgtcttatgctcaacaaagaagtccacaagcatcttgggggtggcaaaattagattggcagatatcaataaaagaaaggttactgagtaggaagtacataggagagttcaaatgtgagtcagaggaaattatgacaataatcatgatgttgcccagcactgatgtcacatacactaaagagaagatggcaaaaaagaaaagctgaagttcccaagagttagacagtcccagaagcacaaactcagataccactgattcatttgtgtgagccat

SEQ ID NO: 2620 - protein, 311 aa, Felis catus
MAHTNESVVSEFVLLGLSNSWELQLFFFAIFSLVYVTSVLGNIMIIVIISSDSHLNSPMYFLLSNLSFIDICQSNFATPKMLVDFFVEHKTISFEGCMAQIFLLHSFVGSEMMLLVAMAYDRFIAICKPLHYSTIMNRRLCIIFVFISWAVGILHSVSHLAFTVDLPFCGPNEVDSFFCDLPLVIELACMDTYEMEIMTLTNSGLISLGCFLALIISYTIILITVRRRSSSGSSKALSTLTAHITVVILFFGPCIYFYIWPFSRLSVDKFLSVFYTVCTPLLNPIIYSLRNEDVKSAMRKLRNRHVNSWKN

SEQ ID NO: 2621 - DNA, 972 bp, Felis catus
ttaataaagagaattcctcactactagtggcatttcagaaattttcttgggcctcaggtaataggtcataatcttcctcatggcagccttcatatccctgttccttagtgtgtaaataatggggtttagaatgggagtgaaaatggtgtaaaatatggctagaagtttatccacagggtaagtggtaaagggccacacatagataaagatgcaaggtccaaagaacaatattaccacggttatatgggcagcccgtgttgaaaatgccttggccattgcagcagaagacttaaaccagacggtgacaagaataatgatgtaagagacaaccaagagagagaaagtacttagggaaagaattccactattgactacaattagtatttcaacagtataagagtccaggcaggcaagtttggtcactcgaggaaggtcacaaaaaaagctgtctacaacattgggtccacaaaaaggcaggtttacagtaaatgataactggcttaatgtgtgcaccaagcccacagcccaggagaccattaccaggaaactgcacgtccttctgctcatgatgactacatagtgtaggggtttgcatatagctacatatctgtcataggccatggagacaagtagtaccatctctcctccagtaaaaaggtgaatgaagaaaatctgggctatgcagccactgaaggagatggtcttgtgttcactcagaaaatctgcaatcatcttaggggtagcaaaagaagcctgacagatgtccacaaaggacaggtttcccaggaggaagtacatgggggagtgcaggctgttatcagaggttactgtcatgatgatgagaaggtttcccagcacaatgaccacatataacacagagaagaaaacaaaaaagaaaagttggagatcctgagaactacagagtcccagcaatacaaattcagacaccactgaagaattgaccttatccat

SEQ ID NO: 2622 - protein, 323 aa, Felis catus
MDKVNSSVVSEFVLLGLCSSQDLQLFFFVFFSVLYVVIVLGNLLIIMTVTSDNSLHSPMYFLLGNLSFVDICQASFATPKMIADFLSEHKTISFSGCIAQIFFIHLFTGGEMVLLVSMAYDRYVAICKPLHYVVIMSRRTCSFLVMVSWAVGLVHTLSQLSFTVNLPFCGPNVVDSFFCDLPRVTKLACLDSYTVEILIVVNSGILSLSTFSLLVVSYIIILVTVWFKSSAAMAKAFSTRAAHITVVILFFGPCIFIYVWPFTTYPVDKLLAIFYTIFTPILNPIIYTLRNRDMKAAMRKIMTYYLRPKKISEMPLVVRNSLY

SEQ ID NO: 2623 - DNA, 950 bp, Felis catus
taaaaataatgccaaggagttgtcttgttaggatttagaagcctatttttcagtttattcatggctgtcttcacttcttgattccttaaagtataaattagtgggttcagaatgggagtaaagatggtataaaacacagacaggatcttgtctgtaagaaaactgcttagtggccacatatagatgaagatgcatggcccaaagaacatgaatacaacaatgaaatgagctgtgcaggtagaaagggccttagatgatccttttgaagaatgatgcttgatagtaacaaagacaataacataagagttgaataaaagaataaagcaggacaatgcaattatgccacttgttgagatcataaacaggcccagaacataagtatctacacaagctagctggaacaccacaggaaggtcacagaaaaagctgtctacttcattgggaccacagaatggtaatgtgagagcaaatatgacctggctcattgaatgcatgactcccacaacccaggaagccaccacaagggcagcacacacccagggtcttatgactgaagtgtagtggagaggcttgcatattgcaatatacctatcaagggacatggccataagtaaaattatctcagtaccagtaaaaaggtgtaggaaaaatatctgggtgatacaaccatcaaaggagatggttttgtgtccagtgaggtagtctgcaatcatcttaggggtggcaaaggaagcaagggacatatcaatgatggaaaggttggtaagtagaaaatacataggagagtgtaggtgagagtcagccataaccgtgatgactatgagactgttaccaaccattgttgccacataaaacaatgaaaacactatgaagaaaaacagctgtagttcccaggaattagagagtccaagcaaaacaaattcagaaacagacttattggccacatccat

SEQ ID NO: 2624 - protein, 317 aa, Felis catus
  MOD_RES (317)..(317): Any amino acid
MDVANKSVSEFVLLGLSNSWELQLFFFIVFSLFYVATMVGNSLIVITVMADSHLHSPMYFLLTNLSIIDMSLASFATPKMIADYLTGHKTISFDGCITQIFFLHLFTGTEIILLMAMSLDRYIAICKPLHYTSVIRPWVCAALVVASWVVGVMHSMSQVIFALTLPFCGPNEVDSFFCDLPVVFQLACVDTYVLGLFMISTSGIIALSCFILLFNSYVIVFVTIKHHSSKGSSKALSTCTAHFIVVFMFFGPCIFIYMWPLSSFLTDKILSVFYTIFTPILNPLIYTLRNQEVKTAMNKLKNRLLNPNKTTPWHYFX

SEQ ID NO: 2625 - DNA, 960 bp, Felis catus
tcattgcactggatatcttggagaagttttcccaagatttaggtattggttacttagtttcttcttcacagccgtcttcatttcctggtttctcaaagtatagatgagtggattcagaaagggggtaaagatggtatagaaaacagacagaactttgtccaccaggaagttggtgaaaggccacacatagatgaagatgcagggcccaaagaacattaacacaactaggaaatgtgcagtacaggtagaaaaaaccttagatgatcctgtggaagagtggtccttgatagtgacaagaacaatgacgtaggaggtgagcaaaagcagaaaacttacaagagcaatcacaccactagttgagatcatgaagattccaagaacatagatatctatacaagccagctggatgaccaaaggaaggtcacagaagaaactgtctacaacattgggaccacagaagggtaaacagagagtaaaagctaactggctcattgtatgcaggaagcccactgtccaagaagttaccacaagcccaacacacactctttggctcataattgttgaataatggagaggtttgcatatggcaatgtacctgtcaaaagacatggagatcagcagcacaatctcagtcccagtgaaaaggtgcaaaaaaaagatctgagaaatgcagccctcaaaggagatggtcttatgctcagcaaagaagtccatgatcatctttggagtggcaaaggaggacaagcacatgtcaatgagagacaggttgctgaggaggaaatacatgggggagtgaaggtgtggggtgcataggactgtgagcaaaatcaagcagttgcccaacatagttagtaaatagaaaacagaaaacatcacaaagaaaaaaatctggagctcaggagaatcagtaagtccaagtaatacaaattcagatactccagaatggttgaatccctccat

SEQ ID NO: 2626 - protein, 319 aa, Felis catus
MEGFNHSGVSEFVLLGLTDSPELQIFFFVMFSVFYLLTMLGNCLILLTVLCTPHLHSPMYFLLSNLSLIDMCLSSFATPKMIMDFFAEHKTISFEGCISQIFFLHLFTGTEIVLLISMSFDRYIAICKPLHYSTIMSQRVCVGLVVTSWTVGFLHTMSQLAFTLCLPFCGPNVVDSFFCDLPLVIQLACIDIYVLGIFMISTSGVIALVSFLLLLTSYVIVLVTIKDHSSTGSSKVFSTCTAHFLVVLMFFGPCIFIYVWPFTNFLVDKVLSVFYTIFTPFLNPLIYTLRNQEMKTAVKKKLSNQYLNLGKTSPRYPVQ

SEQ ID NO: 2627 - DNA, 924 bp, Felis catus
ttaggctatgtgctgattaaacagcctcctcatggaagcttttacttcctggttgcgaagtgtataaatcacaggattcagcaaaggaaagatcactgtgtgaaagagagaaaccaccttgtcagctgggaaggctctgaaggggcgagtgtagataaagataccaggcccaaacataagaaatataacgatgatatgggtggtgcatgtggatacggccttgctcttcccctcagaggaagatccatgtacacgacagaggatgactgcataggaggccagaagccccaggaagcacaggagggtcatcaggccactgttgaagaccattagaagctccaccacgaaggtgtctgtgcaggccagcttgatgacctgtggcacatcacagaagaagttatccagttggtttgggccacagaagggcaagtggaggatgagggccacctggataatggagtggacaaagcctccaagccacagggccaacagcaaggcatagcaggctctagggttcatgactgtggaatagtgtaaaggccgacagatggcgatatagcggtcaaaggccatcacaacaaggagtaacccttcccctcctccaaggaagtgcaagaaaaagagctgagtgatgcagcccctgtaggagattaccttcttctcagagaggaagtccaccagcatcctgggagccacaatgaaggagtaggatgcatccaggaaagccaagttgcccagaaagaagtagaggggggctgtgagaccagggtctgatctgatggtgaggatgatgaggaaatttccaggaaggatgatgagatagaaaattaaaactaggacaaagaccagaagctgaatatctcgagactgggtgagaccaagaaggatgaattctttcaccaccgtgctgttgtcattttccat

SEQ ID NO: 2628 - protein, 307 aa, Felis catus
MENDNSTVVKEFILLGLTQSRDIQLLVFVLVLIFYLIILPGNFLIILTIRSDPGLTAPLYFFLGNLAFLDASYSFIVAPRMLVDFLSEKKVISYRGCITQLFFLHFLGGGEGLLLVVMAFDRYIAICRPLHYSTVMNPRACYALLLALWLGGFVHSIIQVALILHLPFCGPNQLDNFFCDVPQVIKLACTDTFVVELLMVFNSGLMTLLCFLGLLASYAVILCRVHGSSSEGKSKAVSTCTTHIIVIFLMFGPGIFIYTRPFRAFPADKVVSLFHTVIFPLLNPVIYTLRNQEVKASMRRLFNQHIA

SEQ ID NO: 2629 - DNA, 945 bp, Felis catus
ctttcacttctctttacataaaatatatctgttgaccaacttcctcatggctgtctttacttccttatttcgcaaggtatagataatgggattaagtaaagggaatatcacagtatggaacactgacaccactttatctagggaaaaagagtcaaatgggcgagcataaatgtagatggatggcccaaacataaataccacaatggtgatgtgggaatagcaggtggacatggcccggctggtactctcatctgagcctgaatgtttcttaagcatggccaggaggaaggcgtaggacattaagagagcaatgaaacataccacagagatcagaccactgctaaaaatcatcactaattcctccgggaaggtattggcacaggcaatccggataacctgcgtgatgtcacagaagtaactgtctaactcattgggcccacagaacggaagtcgaacaatgagagccacttgtattatagaatgaataaagccccccaaccaggagagaaccaccaggatactgcagagacgtcgattcatgatagtagcatagtggagaggacggcagatagcagcatagcggtcaaacgccattactgtgagcaggaacatctctgaggctccaacaaagtgcaagaaaaagagctgtgcaatgcacccaccaaaggaaattctcttcctttccacaaagaagtctatgagcattttaggggctgtgatggaggagtaccaaatgtcaaggaaggccagattagccaacaggaaatacatgggtgaggtcaaatgagggtcaagcctgattgtgcaaataataagaatatttcctggaaggatgaacaaatagaaggatagaaatataacaaataggactagttgtacctctcgagtctgggataggccagtgagaacaaactctgtcactcttgtgtaatttgcaggttccat

SEQ ID NO: 2630 - protein, 313 aa, Felis catus
MEPANYTRVTEFVLTGLSQTREVQLVLFVIFLSFYLFILPGNILIICTIRLDPHLTSPMYFLLANLAFLDIWYSSITAPKMLIDFFVERKRISFGGCIAQLFFLHFVGASEMFLLTVMAFDRYAAICRPLHYATIMNRRLCSILVVLSWLGGFIHSIIQVALIVRLPFCGPNELDSYFCDITQVIRIACANTFPEELVMIFSSGLISVVCFIALLMSYAFLLAMLKKHSGSDESTSRAMSTCYSHITIVVFMFGPSIYIYARPFDSFSLDKVVSVFHTVIFPLLNPIIYTLRNKEVKTAMRKLVNRYILCKEK

SEQ ID NO: 2631 - DNA, 927 bp, Felis catus
cttttccttcaaggagaacttgcgactccatatccgtttcatggcattctttacatcctcattcctcagagtatagatgagtgggtttagcattggggtaatggtagtataaaacacagacacagccttatccagtgggaaagtagtggagggacggagataaataaatatacaagggacaaagaagaaagttactacagtgaaatgagacccacaggtagagagagccttgcgccggctctctgaagatcgcttacggagactaaacagaatgaccgtgtaggaggccagaagaatgaggaaacaccccagagagatgagaccactgttggcaaccaccaacatatttaccagggttgtatcagcacaggcaagctttaggactgggtggacatcacaaaagtagtggtcaatgacctgatcattgcagaaaggcagctgaaaggtcagaagggtctgaacaaaggaatgacccagggctcctaaccaggacaatgatgccagaacaatacaaacattggcactcatgatggtagtataacggagaggttggcagatggcagcataacggtcgaaagccataacagtcaaaacaaaaatctccgcacacccaaaaaagtggaaggtaaacatctgagttacacagccccagtaggaaatggtctttttctcagaaataaagtctgcaatcatcttgggtgctgtggctgaggaataggcaatgtccacaaaggacaggttactgaggaagaaatacatgggcgtttggagctggggatcagaaaagaccgtaagcaaaatgagcagatttcccaccatgatcacgatgtagaagaggagaaataaggcaaagaacatcagttgcattccaggatcttgggaaagtcctaggaatataaattcagtgacattattagccacttccat

SEQ ID NO: 2632 - protein, 309 aa, Felis catus
MEVANNVTEFIFLGLSQDPGMQLMFFALFLLFYIVIMVGNLLILLTVFSDPQLQTPMYFFLSNLSFVDIAYSSATAPKMIADFISEKKTISYWGCVTQMFTFHFFGCAEIFVLTVMAFDRYAAICQPLRYTTIMSANVCIVLASLSWLGALGHSFVQTLLTFQLPFCNDQVIDHYFCDVHPVLKLACADTTLVNMLVVANSGLISLGCFLILLASYTVILFSLRKRSSESRRKALSTCGSHFTVVTFFFVPCIFIYLRPSTTFPLDKAVSVFYTTITPMLNPLIYTLRNEDVKNAMKRIWSRKFSLKEK

SEQ ID NO: 2633 - DNA, 948 bp, Felis catus
tcatcctttaacatggcagaaggatgccacatgcttttttctcagcttcttcatgacagtcttcatttcagcatttctgagtgtgtagatgagaggattcaacataggtgtgatcactgtgtaaaagacagagaataccttatccacggagaagctgcagaaaggcctcaggtagatgaatacacatggcacaaagatcaggctgaccactgttaggtgggaggcacaggtagagagtgccttgctgtggccctgacggaagcgagttctcacagtgatgaggatgatggcataagagaacagcaagaccaaaaagcagacgagagataacagaccactatttgagaccatcagcacctctactacatatgtgtctgtgcacgctagcttgatgacctgtgggacatcacagtagaagttgtccagttcagtgggaccacagaagggcagctgtatgaccagcgtgacctgtgtgatagaatggatgaaacccccacaccaacaggcaaaaaccaactgaaagcagagctgacgattcatgactgtcaagtagtgcaaaggattacatatggcaacatacctatcataggccatgactgtcagcagaaacatctcactggctcccagaaagtgcaggaagtagatctgggccaagcatcctgaaaaagagatgatcttgtcttgctgtaggaaatctcctaacatcttgggcacagtaacacagctcaggcataggtcaatgaaggacagatggcccaaaaaatagtacataggagattggagcaggtgagcatcagctcgcactgttacaattatcaagaggtttcccaaaacaacagtcatgtaaaaaaacaaaaatattaagaagagaaatagctgtagctcccaagaggatgataggcccagaagaacaaattctgtcactttagaatcatttctttttttcat

SEQ ID NO: 2634 - protein, 315 aa, Felis catus
MKKRNDSKVTEFVLLGLSSSWELQLFLFLIFLFFYMTVVLGNLLIIVTVRADAHLLQSPMYYFLGHLSFIDLCLSCVTVPKMLGDFLQQDKIISFSGCLAQIYFLHFLGASEMFLLTVMAYDRYVAICNPLHYLTVMNRQLCFQLVFACWCGGFIHSITQVTLVIQLPFCGPTELDNFYCDVPQVIKLACTDTYVVEVLMVSNSGLLSLVCFLVLLFSYAIILITVRTRFRQGHSKALSTCASHLTVVSLIFVPCVFIYLRPFCSFSVDKVFSVFYTVITPMLNPLIYTLRNAEMKTVMKKLRKKHVASFCHVKG

SEQ ID NO: 2635 - DNA, 977 bp, Felis catus
tgactcaatgaatgtctctgagccatattccagctttgcttctgtaagagaatttatactcttaggtttttcctgtgagtggaaaattcagatcctcctattttcactctttactacaatgtatgctttgactgtaacagggaacggggccattgtctgtgctctgtggtgtgaatggaaactccacatccccatgtacagattcctggggaatttctcctttctagagatctggtatgtctcttctacagtccccaagatgttgatcaacttcctctcagataaaaagaccatctcatttgctggatgtttcctccaattttatttctttttctctttgggaacatctgaatgtttcctcttggccgtcatggcctttgatcggtaccttgctatctgccgtcccttgcactaccctaatatcatgactgggcatttctgtaccaaactggtcattatctgctgggtttgtggatttctgtggttcgtgatccccattgtattcatctctcagatgcccttctgtggtccgaacattattgaccatgttgtgtgtgacccagggccactgtttgcattggcatgtgcctctgccccaacaacccaacagctttgctacactctaagctcgttagttatctttggtaacttcctcttcatccttggatcctatacgcttgtcttattagctgtgttgcgtatgccttctgccactgggagacataaggccttctctacctgtgggtctcatttggctgtggtatcactcttctatggctccttgatggtcatgtatgtgagccctagactcagacattctgctggtatacagaaagttgcaactttgttctatgctatggtaaccccactcttcaaccccctcatctatagcctccggaataaggagataaaggcagccctgaggaaagttctggggcatctcaacataatccaagatacacttgatgatccctcca

SEQ ID NO: 2636 - protein, 324 aa, Felis catus
  MOD_RES (324)..(324): Any amino acid
MNVSEPYSSFASVREFILLGFSCEWKIQILLFSLFTTMYALTVTGNGAIVCALWCEWKLHIPMYRFLGNFSFLEIWYVSSTVPKMLINFLSDKKTISFAGCFLQFYFFFSLGTSECFLLAVMAFDRYLAICRPLHYPNIMTGHFCTKLVIICWVCGFLWFVIPIVFISQMPFCGPNIIDHVVCDPGPLFALACASAPTTQQLCYTLSSLVIFGNFLFILGSYTLVLLAVLRMPSATGRHKAFSTCGSHLAVVSLFYGSLMVMYVSPRLRHSAGIQKVATLFYAMVTPLFNPLIYSLRNKEIKAALRKVLGHLNIIQDTLDDPSX

SEQ ID NO: 2637 - DNA, 969 bp, Felis catus
atgaaaatcccagctgaaaacaaccactctgaccctgtcagtgaattcattcttcttggcttcccttgcacctgggaggtccagatcctcctcttctcaatcttctttgtgatctatgtcctgacattaatgggaaatctgtgtatcatctgtgcagtgtggtggaatgaccatctccacactcccatgtacatcctactggccaatttttccttcctggagatctggtatgtcacttctactgtccctaatatgctggccaactttctctctgaaaccaattccatctccttctatggctgcttcatccagttctacttcttcttctccatgggcaccactgagaccttcttcttgtctgccatggcctttgacaggtaccttgctatctgcaggcccctgcattaccccgctgtcatgacagttcagcgctgcatcagaataggagctgggtgctgggtgtgtggcttctcttgttttctcctcccagtttacctgatctcccagcttcctttttgtggtcccaatacaattgatcattttttgtgtgatccaggaccccttatgaatctgtcttgtgtggcagctcctgccactgagatcatctgtgccatctttaactcagtcctcattttctccaccttcctcttcattaccagctcctacaccttggtgatcagagctgtactgagggtcccctcagcagaaggtcggcataaggccttctccacgtgtggctcccatctggctgtggtgtccctgttctatggctccatcatggtgatgtatgtgagtccaacagcaggcaatccagcagggattcagaaaattgtgactttattttattctgtgatgactccacttttcaatcccttgatctatagcctccggaataaggagatgaagcaggccctgacaaaactatttaggattatgagatctggtcaaagacagcctctcaagaactag

SEQ ID NO: 2638 - protein, 322 aa, Felis catus
MKIPAENNHSDPVSEFILLGFPCTWEVQILLFSIFFVIYVLTLMGNLCIICAVWWNDHLHTPMYILLANFSFLEIWYVTSTVPNMLANFLSETNSISFYGCFIQFYFFFSMGTTETFFLSAMAFDRYLAICRPLHYPAVMTVQRCIRIGAGCWVCGFSCFLLPVYLISQLPFCGPNTIDHFLCDPGPLMNLSCVAAPATEIICAIFNSVLIFSTFLFITSSYTLVIRAVLRVPSAEGRHKAFSTCGSHLAVVSLFYGSIMVMYVSPTAGNPAGIQKIVTLFYSVMTPLFNPLIYSLRNKEMKQALTKLFRIMRSGQRQPLKN

SEQ ID NO: 2639 - DNA, 969 bp, Felis catus
atgagtatgtcagaagccaacaatatctctgggtctgtgagtgagttcatcctcctgggcttcccatgccgcagggagatccagatcctcctctttgtcatcttctccctcatctaccttctgactctcatggggaacacatccatcatctgtgccgtgtggtcaagccggaaactccacacacccatgtacatcctcctggccaacttctccttcctggagatctgctatgtcagttctgatgtgcccaaaatgttggccaacatcatctcccagactaagagtatctcctatgctggctgcctgcttcagttctactttttcttttctatgtgtgctgctgaaggctactttctgtctgcaatgtcctttgatcggttccttgctatctgtcgacctctacgttaccccaccatcatgacttaccatctatgtgcccgattagtggttttctgctgggtaggtggctttctatccatactcatgcctgcagttctcatgtcccaggtgcccttctgtggccctaacatcattgaccattttttctgtgacctgggaccattgctagccctgtcctgtgctccagttcccaaaactactctaacttgtgctactgtaagttctcttatcatctttatcaccttcctctacattctagggtcgtatagcttagttttgcgtgctgtacttcgggtcccagctggctcaggtaggaacaaagccttttctacatgtgcctcacatttcttggtggtttccctgttctatggatcagtcatggtgatgtatgtgagtccaggttccaggagccatcctggaacacagaaatttgtgaccctgttttactgcatggcaaccccattctttaatcctttgatttacagtcttcggaacaaagatatgaaagatgcactcaagaaagtcctgggagcaccatcaaaagaaattactaaaaataaagagaaatga

SEQ ID NO: 2640 - protein, 322 aa, Felis catus
MSMSEANNISGSVSEFILLGFPCRREIQILLFVIFSLIYLLTLMGNTSIICAVWSSRKLHTPMYILLANFSFLEICYVSSDVPKMLANIISQTKSISYAGCLLQFYFFFSMCAAEGYFLSAMSFDRFLAICRPLRYPTIMTYHLCARLVVFCWVGGFLSILMPAVLMSQVPFCGPNIIDHFFCDLGPLLALSCAPVPKTTLTCATVSSLIIFITFLYILGSYSLVLRAVLRVPAGSGRNKAFSTCASHFLVVSLFYGSVMVMYVSPGSRSHPGTQKFVTLFYCMATPFFNPLIYSLRNKDMKDALKKVLGAPSKEITKNKEK

SEQ ID NO: 2641 - DNA, 902 bp, Felis catus
tttcttgagtgcctctttcatatctttgttccagaagttgtaaatcaaaggattaaagagtggggttgcgaaagcatagaacaaggtcacaaatttctgcatcccaggatagtccccagaatctgggctaatgtacatcaccatgactgaaccatagaacagacacaccacagcaaggtgggaggcacaagtaaagaaagccttatgccttcctgagcctgggggcacctataacaccacactcaagacacagaactaagtgccatgtacaggaaagtgagaaagatgatgagagagctgttgataccacatatttgagtaatttcacatactggagcacaggacaatgccagcaaaagtgcaagatcacagagaaaatggtcagtggtgtttggaccacagaaaggcacctgagatattagagtcaaaggagtcagtaaccagagaaagcccctacccagcagaagaccactaactgaaagcataggcggtgggtcattatggtaggatagcggaaaggtctacaaatggcaagtaatcaatcaaaagacatcactgacagaaataagccctcagcggcacacatggaaaagaagtagaactggagcaggcagccagcataggagatactcttagtctgggagatgatgttggccaacattttgggcacatcagaactgacatagcagagctccaggaaggagaagttggccaggaggatgtacatgggtgcgtggagtttccggcttgaccacatggcacagatgatggatgtgttccccatgagagtcagaaggtagatgagggagaagatgacaaagaggaggatctggatctccctgtggcatgggaagcccaggaggatgaactcactcacagacccagagatgatagtagtctcc

SEQ ID NO: 2642 - protein, 120 aa, Felis catus
ETTIISGSVSEFILLGFPCHREIQILLFVIFSLIYLLTLMGNTSIICAMWSSRKLHAPMYILLANFSFLELCYVSSDVPKMLANIISQTKSISYAGCLLQFYFFSMCAAEGLFLSVMSFD

SEQ ID NO: 2643 - DNA, 942 bp, Felis catus
atgacttcggaggccagaaatatttctcacactgtgagtgagttcatcctcttgggctttccttgccgttgggaaatgcagatcctcctcttttccatattctttgtgacttacatcatgacgctccttggaaacatggccatcgtgtgtgtggtgcgctgggaccgccggctccacacccccatgtatattctgctggccaacttctccttcctggaaatctgttatgtcaactctgatgtgcccaacatgctggccaacttcctctcccagaccaaaaccatctcctttgcttggtgcctcctccagttgtacttcttcttctcactaggcacaactgaatgcttatttctgtccatcatggcctatgaccggttcctggcaatctgtcaccccctgcattaccccaccatcatgactgtgaagttctgttgcagcctggtcatcttttgctgggtctatggttttctctggtttctgatcccagtgatacttgttacccagctaccattttgtggcccaaacgtgattgatgacttcctgtgtgacctgggtcctctgctggccttggcttcagcctgtgtcccaatcccagggactattctcatatgtggcaccatgagctcactcctcatctttgccacctttttctacattactggctcctataccctggtgctgagggctgtagtgcaggtgccctcagttgctggccggaagaaggccttttctacgtgctcctcacatctggctgttgtgtttctattctatggctctgtcatgatgacatatgtgagcccggggtcaggacaagcagaaggaatgcagaagttcacaactctattctactcagttctgacccctttttttaaccccatgatctacagcctccggaataaagaaatgaaggatgccttgaagaaagttctaggaggtttctaa

SEQ ID NO: 2644 - protein, 313 aa, Felis catus
MTSEARNISHTVSEFILLGFPCRWEMQILLFSIFFVTYIMTLLGNMAIVCVVRWDRRLHTPMYILLANFSFLEICYVNSDVPNMLANFLSQTKTISFAWCLLQLYFFFSLGTTECLFLSIMAYDRFLAICHPLHYPTIMTVKFCCSLVIFCWVYGFLWFLIPVILVTQLPFCGPNVIDDFLCDLGPLLALASACVPIPGTILICGTMSSLLIFATFFYITGSYTLVLRAVVQVPSVAGRKKAFSTCSSHLAVVFLFYGSVMMTYVSPGSGQAEGMQKFTTLFYSVLTPFFNPMIYSLRNKEMKDALKKVLGGF

SEQ ID NO: 2645 - DNA, 936 bp, Felis catus
atgaatatctccaacacccccaacacctccagcaccttcactggcttcatcctcctgggcttcccttgctccagggaggggcagatcctcctctttgtgctcttctctgttgtctacctcctgaccctcatgggcaacgggtccatcatctgtgctgtgcgctgggatcagagactccacacccccatgtacatcttgctcgccaacttctccttcctagagatctggtatgtcacctccactgtccccaacatgttagccaacttcctctctgacaccaaggtcatctccttctctgggtgctttctccagttctactttttcttctccttgggttctacagaatgctttttcttggccattatggcatttgatcggtaccttgccgtctgctggcctctacactatccaaccattatgactggacgtctctgcaccaatcttgtgatcagctgctgggtatttggtttcctctggttcttgattcccatcatcatcatctcacaaatgtccttctgtggatccaggattattgaccacttcctgtgtgatcctggtcccctgttggccctcacctgtactagagcccctgcaatagagttaactagctccaccttaagttctctgctcttatttattccctttttctttatcgtggtgtcctacgctcttgttctgagagctgtgttgagggtcccttcagcagctggacgaagaaaagctttctccacctgtgggtcccatctggcagtggtttcactgttctatggctcagtgatggtcatgtatgtgagcccaacatctgagcgtgaagctgggatgcagaagatggtgactttgttttattctgtaattactccactcatcaaccctataatatatagtctgaggaacaaagatatgaaacatgctatgaaaacattgttgagaacataa

SEQ ID NO: 2646 - protein, 311 aa, Felis catus
MNISNTPNTSSTFTGFILLGFPCSREGQILLFVLFSVVYLLTLMGNGSIICAVRWDQRLHTPMYILLANFSFLEIWYVTSTVPNMLANFLSDTKVISFSGCFLQFYFFFSLGSTECFFLAIMAFDRYLAVCWPLHYPTIMTGRLCTNLVISCWVFGFLWFLIPIIIISQMSFCGSRIIDHFLCDPGPLLALTCTRAPAIELTSSTLSSLLLFIPFFFIVVSYALVLRAVLRVPSAAGRRKAFSTCGSHLAVVSLFYGSVMVMYVSPTSEREAGMQKMVTLFYSVITPLINPIIYSLRNKDMKHAMKTLLRT

SEQ ID NO: 2647 - DNA, 916 bp, Felis catus
caacacctccagcaccatcactggcttcatcctcctgggcttcccttgctccagggaggggcagatcctcctctttgtgctcttctctgttgtctacctcctgaccctcatgggcaacgggtccatcatctgtgctgtgcgctgggatcagagactccacacccccatgtacatcttgctcgccaacttctccttcctagagatctggtatgtcacctccactgtccccaacatgttagccaacttcctctctgacaccaaggtcatctccttctctgggtgctttctccagttctactttttcttctccttgggttctacagaatgcttcttcttggctattatggcatttgatcggtaccttgccatctgctggcctctacattaccccactcttatgactggacatctctgcaccaaccttgtggtcagctgctgggtacttggtttcctttggttcccagtacctatcattgttatttcccaaatgtccttctgtggatccaggatcattgaccacttcctgtgtgatccaggtcccctattagcactcacctgtgccagagtcccagtaatggagtttttttggactattataagttccttgctcttatttattcctttcctctgcatcatggggtcctatactctggtcctgagagctgtgtttagagtcccttcagcagctggacgaagaaaagctttctcgacctgtgggtcccatctggccgtggtttcactgttctatggttcggtgatggtcatgtatctgagcccaacatctgagcatgaggctgggatgcagaaacttgtgactctgttttattctgtaggaaccccactcattaatcctgtgatctacagtctaaggaacaaagatatgaaatatgccctgcagaaatttctaggaatataa

SEQ ID NO: 2648 - protein, 304 aa, Felis catus
NTSSTITGFILLGFPCSREGQILLFVLFSVVYLLTLMGNGSIICAVRWDQRLHTPMYILLANFSFLEIWYVTSTVPNMLANFLSDTKVISFSGCFLQFYFFFSLGSTECFFLAIMAFDRYLAICWPLHYPTLMTGHLCTNLVVSCWVLGFLWFPVPIIVISQMSFCGSRIIDHFLCDPGPLLALTCARVPVMEFFWTIISSLLLFIPFLCIMGSYTLVLRAVFRVPSAAGRRKAFSTCGSHLAVVSLFYGSVMVMYLSPTSEHEAGMQKLVTLFYSVGTPLINPVIYSLRNKDMKYALQKFLGI

SEQ ID NO: 2649 - DNA, 936 bp, Felis catus
atgaatatctccaacacccccaacacctccagcaccatcactggcttcatcctcctgggcttcccttgctccagggaggggcagatcctcctctttgtgctcttctctgttgtctacctcctgaccctcatgggcaacgggtccatcatctgtgctgtgcgctgggatcagagactccacacccccatgtacatcttgctcgccaacttctccttcctagagatctggtatgtcacctccactgtccccaacatgttagccaacttcctctctgacaccaaggtcatctccttctctgggtgctttctccagttctactttttcttctccttgggttctacagaatgcttcttcttggctattatggcatttgatcggtaccttgccatctgccggcctctacactatccaaccattatgactggccgtctctgcaccaatcttgtggtaagctgctgggtatttggtttcctttggttcttgattcccatcatcatcatctcacaaatgtccttctgtggatccaggattattgaccacttcctctgtgatccaggtcctcttctaacactcacctgcaaaaaagctcctgtggtagagattatcttctccactttaagtcctctgcccctcgttattccctttctcttcatcatgggatcctatgctctggtcctaagagcagtgttgaaagtcccttcagcagctgggaaaagaaaggctttctccacctgtgggtctcatctggccgtggtttcactgttctatggctcagtactggtcatgtatgggagcccaacatctgagcatgaagctggaacacagaagattgtgactctgttttattctgttgtgaccccactccttaatccagtgatatacagtcttaggaacaaagatatgaaaaataccctgcagaaatttctggaaatataa

SEQ ID NO: 2650 - protein, 311 aa, Felis catus
MNISNTPNTSSTITGFILLGFPCSREGQILLFVLFSVVYLLTLMGNGSIICAVRWDQRLHTPMYILLANFSFLEIWYVTSTVPNMLANFLSDTKVISFSGCFLQFYFFFSLGSTECFFLAIMAFDRYLAICRPLHYPTIMTGRLCTNLVVSCWVFGFLWFLIPIIIISQMSFCGSRIIDHFLCDPGPLLTLTCKKAPVVEIIFSTLSPLPLVIPFLFIMGSYALVLRAVLKVPSAAGKRKAFSTCGSHLAVVSLFYGSVLVMYGSPTSEHEAGTQKIVTLFYSVVTPLLNPVIYSLRNKDMKNTLQKFLEI

SEQ ID NO: 2651 - DNA, 900 bp, Felis catus
atgaacagttcagagacaagcactgtgactgagtttgtcctcctaggcttccctggttgtcaggagttgcaaagtttccttttctcactgttcttggggatctatatatttaccataatgggaaatgggattattgtctgtgctgtgaggttggaccaacggctccataccccaatgtatattctcctaggcaattttgctttccttgaaatcttgtacattacctccactgtgcccagtatgctagtcaatttcctctcagaaacaaaaaccatctctttcgttggctgtttcctccagttatatttttttacttcccttggtacaactgaggcatatttcctctgcatcatggcatatgatcggtacctcgctatctgccacccactgcactactcaaccaccatgacccaacagctctgctatatcttgatgtctctttgctgggtgttggggttccttagttactctgtctccactatacagctctctcaattgcctttctgtggacccaacaccattgaccactttatgtgtgacatggacccactgatggctctgtcctgtgctacagctccagtcatggagatcatcttctatgtcctgaactccctcatcatcatcctcacacttctgtatattcttggctcctatactcttttactgatagctgtgttaaaagtgccttcagctgctggcctgcggaaggccttttccacctgcggatcacatctgacagtggtatgcttattctttggagcccttttggcaatgtatgtgagtcccacagctgataacccagatgaaattcagaagattttgactctgttctactccgtggtgactcccttcttaaaccctctgatttacagtttacgaaacaaggacatgaaggctgca

SEQ ID NO: 2652 - protein, 300 aa, Felis catus
MNSSETSTVTEFVLLGFPGCQELQSFLFSLFLGIYIFTIMGNGIIVCAVRLDQRLHTPMYILLGNFAFLEILYITSTVPSMLVNFLSETKTISFVGCFLQLYFFTSLGTTEAYFLCIMAYDRYLAICHPLHYSTTMTQQLCYILMSLCWVLGFLSYSVSTIQLSQLPFCGPNTIDHFMCDMDPLMALSCATAPVMEIIFYVLNSLIIILTLLYILGSYTLLLIAVLKVPSAAGLRKAFSTCGSHLTVVCLFFGALLAMYVSPTADNPDEIQKILTLFYSVVTPFLNPLIYSLRNKDMKAA

SEQ ID NO: 2653 - DNA, 993 bp, Felis catus; identical to SEQ ID NO: 25

SEQ ID NO: 2654 - protein, 330 aa, Felis catus; identical to SEQ ID NO: 55

SEQ ID NO: 2655 - DNA, 945 bp, Felis catus
atgaataagtcagggatatctactgtgacacagtttgtcttgttgggttttcctggtccctggaaaatacagatcatccttttctcaatggttttgttggtctacatcttgactctgactgggaatatggccatcatttgtgcagtgaggtgggaccatcgactccatacacctatgtatgtgctcctggccaacttctcctttctagagatctggtatgtgacctgcacagtccccaacatgctggtcaattttctttccaaaactaagaccatatcattctctggctgcttcactcaattctacttcttcttttccctgggcacaactgagtgcttcttcctctgtgtcatggcctatgatcggtacctggccatctgccgtccactgcactatccctccattatgaccgggaagctctgtgtcattctggtgtgtctttgttggctcattggtttccttggacatgcaattactattttcttcatttctcaactacccttttgtggtcccaacattattgatcacttcctgtgtgatgtggacccactgatggcattgtcctgtgcccccacaccaatcatagagtatgtattccactttgtgagctctcttatcatcattctcaccattttgtacattattgggtcctatgccttagtgctcagagctgtgcttcaggttccttcttcagctgggcggcaaaaggccttctctacctgtggatcccacttagctgtggtgtctctattctatggaaccataatggtgatgtatgtgagtcctacatctggcaactcagttgctatgtataagatcatcacactgatatactctgtagtgacaccagtcttaaaccccctcatctatagcttacgcaacagggaaatgaaatttgctctccgtcaggtcatttgtggaataagaatcatccaaccctcatga

SEQ ID NO: 2656 - protein, 314 aa, Felis catus
MNKSGISTVTQFVLLGFPGPWKIQIILFSMVLLVYILTLTGNMAIICAVRWDHRLHTPMYVLLANFSFLEIWYVTCTVPNMLVNFLSKTKTISFSGCFTQFYFFFSLGTTECFFLCVMAYDRYLAICRPLHYPSIMTGKLCVILVCLCWLIGFLGHAITIFFISQLPFCGPNIIDHFLCDVDPLMALSCAPTPIIEYVFHFVSSLIIILTILYIIGSYALVLRAVLQVPSSAGRQKAFSTCGSHLAVVSLFYGTIMVMYVSPTSGNSVAMYKIITLIYSVVTPVLNPLIYSLRNREMKFALRQVICGIRIIQPS

SEQ ID NO: 2657 - DNA, 944 bp, Felis catus
tcatttgctttgactaatttttgtgcacatatgaatttttctcaaggcagccttcacgtcattgttccggagactgtagatcagtgggtttataagtggggtcactgatgagtagaacaaggttacaatcttctgtatcccagctgcatttccagaggttgggctgatgtacatgaccatgatggatccatagaagagagacaccacagtcaggtgggagccacaggtggagaaggccttacgtcggccagctgctgaagggacacgcaacactgctctgagaaccagggtgtaggatgcaaggatgaagaagaagctgatgaagataataagagagctcaatatagaacaggaaagctcaattccaggggcagggatgcaggacagagccagaagaggaccagggtcacagacaaagtggtcaatggtattggggccacaaaaggggagttgtgtgataaaatagatagggactggatagcagaggaaggctgtgacccagcagagggccaccaggttcatgcagaagtggctactcatgatgttaggataatggagaggccgacagatggccaagtaccgatcaaagccatgaggggcagtaagaaagtctcagtaatgcccatggagaagaagaaatagaactggaagaagcaagcagtgaaagagatggttttggtctcagataggaagttctttaacatattgggaacagtggtgttgatgtaacagatctccaggaatgagaagttggacagcagaatgtacatgggggtgtgaagcctgtgatccagcttcactgcacagacaatggccccgttccccatcagtgtcaggatgtaggacacaaagaacaacacgaaaaggaggacctgaatctctctggagcacggaaaactcagtagtatgaattcggtcactgtgctgactcctgacatattcat

SEQ ID NO: 2658 - protein, 179 aa, Felis catus
MSSHFCMNLVALCWVTAFLCYPVPIYFITQLPFCGPNTIDHFVCDPGPLLALSCIPAPGIELSCSILSSLIIFISFFFILASYTLVLRAVLRVPSAAGRRKAFSTCGSHLTVVSLFYGSIMVMYISPTSGNAAGIQKIVTLFYSSVTPLINPLIYSLRNNDVKAALRKIHMCTKISQSK

SEQ ID NO: 2659 - DNA, 947 bp, Felis catus
atgaacaggtcagcaacacacattcaccttgtgactgagtttattctcctggggttccctggttgctgggagatacagattttcctcttctcactctttttggtggcttatgtcttgacgctgctggggaatggaactattatctgcgcaataagatgggacccacgactgcataccccaatgtactttctgctgggaaattttgccttccttgagatctggtatgcttcatccacagttcctaacatgttagccaacattctctccaaaaccaagaccatttcattttctgcctgcttcctccagttctacttcttcttttccctgggcacaactgaatgtctcttcctggcagtcatggcttatgatcggtacctggccatctgccacccactgcactaccccaccatcatgactgggaaactctgtagaattctggtgtctctctgctggcttactggattccttggctacccaatccccattttcttcatctcccaactccccttctgtggatccaatatcattgatcatttcctgtgtgatatggatccactgatgtctctgtcttgtgctccagcccccattactgaatttgttttctatactcagagctcccttgttctcttttttactattatgtacattcttcgatcctataccctgttgctcagagctgtttttcaggtcccttctgcagctggccggagaaaggcttttgccacctgtggttctcatttagttgtggtgtctcttttttatgggacagtcatggtaatgtatgagtcctacatatggcatcccaactttgatgcagaagatcctgacagtggcatattcaataatgactcctctctttaatcccctgatttacagtcttcgtaataaggacatgaaacttgccctgagaaatatcctgtttagaatgagaattagtcaaaattctt

SEQ ID NO: 2660 - protein, 286 aa, Felis catus
MNRSATHIHLVTEFILLGFPGCWEIQIFLFSLFLVAYVLTLLGNGTIICAIRWDPRLHTPMYFLLGNFAFLEIWYASSTVPNMLANILSKTKTISFSACFLQFYFFFSLGTTECLFLAVMAYDRYLAICHPLHYPTIMTGKLCRILVSLCWLTGFLGYPIPIFFISQLPFCGSNIIDHFLCDMDPLMSLSCAPAPITEFVFYTQSSLVLFFTIMYILRSYTLLLRAVFQVPSAAGRRKAFATCGSHLVVVSLFYGTVMVMYESYIWHPNFDAEDPDSGIFNNDSSL

SEQ ID NO: 2661 - DNA, 995 bp, Felis catus
tcacttcactccttcctactgaaactcttaggtagcaaaagttccccccaaaagcccgctaccactttcctaaacatatctttcaaagcttccttgacttgctcattgcgtaaggcatagatgaatggattcatcagtggtgtcacaaatgttgttaccactgtcactgcccagttagtatccacagagccactctgtgatggtcgcacataaagaaaaatggcacttccatagaagagggtcaccaccatcaagtgggaggtacaggtagagaaggccctctgtcggcctgaaacagaggggatgcgcaggacagccagaactatgtgaccataggacacagcagtaatcatcagtgaggatacaatgacgagaaaggccagtacaaagtctgttttctccagcttctcggtgtcggtgcatgccaggcggagcagtggaccactgtcacagaagaagtgctgcaccatggcgtcctgttcacagaaaggaagtaaggccacagccactgtggggccaagcacagggaaaagtccccccatccagcaggccaaggccacccgaaagcacacagtgccattcatgagcaaggggtagtgcagagggtgacagatggccaggtagcgatccacagacatggcagccaacagcaggaactctgaggccccaagaaagaagtagaaatagaactgggcaatacatgcagcaaaggaaatagtgtgttgccttgataggaaattgctcagcatcttgggaatgatgacagaagtgagcaagatttctaggcaggacaagttacccagaaagaagtacataggagtctgcaggcgagtgtcagctcctaccactccaacaatcaacacgttgcctgttagagtcagcagatagacgagaaggaagacagaaaacagttctgcttttgtgctgttgagatttgggaaacctgccaggatgaactctgtaacaccaatgctctggttccccccaggagccat

SEQ ID NO: 2662 - protein, 329 aa, Felis catus
MAPGGNQSIGVTEFILAGFPNLNSTKAELFSVFLLVYLLTLTGNVLIVGVVGADTRLQTPMYFFLGNLSCLEILLTSVIIPKMLSNFLSRQHTISFAACIAQFYFYFFLGASEFLLLAAMSVDRYLAICHPLHYPLLMNGTVCFRVALACWMGGLFPVLGPTVAVALLPFCEQDAMVQHFFCDSGPLLRLACTDTEKLEKTDFVLAFLVIVSSLMITAVSYGHIVLAVLRIPSVSGRQRAFSTCTSHLMVVTLFYGSAIFLYVRPSQSGSVDTNWAVTVVTTFVTPLMNPFIYALRNEQVKEALKDMFRKVVAGFWGELLLPKSFSRKE

SEQ ID NO: 2663 - DNA, 939 bp, Felis catus; identical to SEQ ID NO: 27

SEQ ID NO: 2664 - protein, 312 aa, Felis catus; identical to SEQ ID NO: 57

SEQ ID NO: 2665 - DNA, 938 bp, Felis catus
cctctcccctccaaccttcccattaacttgttcaaggcatttttcatgtcttcattcctaagagtatagatgatggggttcagcaggggggtgacagcggtgaaaaacacagccaccaccttgtcctcagggaggctggtggatggacgggaatagatgaagatgcagtggcccaggaataatgtgaccacggtgaggtgggctgcacaggtggataaggccttccgcctgccttcggacagctgctgccgcaggctaaccaggatgactgcataggacaccacaaggaccacgaaacagaccacagagatcagcccactgttggagatgatgaggatttcaatgatgtgggtatccgtgcaggccaatttgatcacctgaggtacatcgcagaagaagttgtcgatctcatcgggaccacagtagggcagcttgatggtgagggaggtcagtgcgacggagtggatggttcctcctgtccagagggccacagcaagaagcacacatactttccagttcataactgtcatgtactgcaggggtttgcaaatggccacataccgatcataggccatgatggtgaggagaaagatctctgtgcaggcaaagaggtgcaggaaaaacatctgagtgacacaggcatcaaaggagatgagcttctcttctgaccatgtatctatcagcatcttggggactgtgacagtggagtggcagacatcgataaaagacaggttgctgaggaagaaatacataggggtatggagccggcggtcataggtaatagttatgacaatgaggatgttcccaatcagtgtcaggacatagaaagtgaggaacatggcaaacacagccatctgcaccttctgatttacagataagcctctaagtcgtatatatgtgatggaagaggtttgattgagtaggccggcctcttccat

SEQ ID NO: 2666 - protein, 313 aa, Felis catus
MEEAGLLNQTSSITYIRLRGLSVNQKVQMAVFAMFLTFYVLTLIGNILIVITITYDRRLHTPMYFFLSNLSFIDVCHSTVTVPKMLIDTWSEEKLISFDACVTQMFFLHLFACTEIFLLTIMAYDRYVAICKPLQYMTVMNWKVCVLLAVALWTGGTIHSVALTSLTIKLPYCGPDEIDNFFCDVPQVIKLACTDTHIIEILIISNSGLISVVCFVVLVVSYAVILVSLRQQLSEGRRKALSTCAAHLTVVTLFLGHCIFIYSRPSTSLPEDKVVAVFFTAVTPLLNPIIYTLRNEDMKNALNKLMGRLEGRG

SEQ ID NO: 2667 - DNA, 924 bp, Felis catus
atgaggaaccacaccactgtcaccgagtttgtcctgctgggactctcagatgcctgtgagttgcagatgctcatcttcctggggctgctgctgacctacctcctcactctgctggggaatctcctcatcgtgggcatcaccctcgtggacaggcgcctccacacccccatgtactacttcctccgcaactttgctgtcctggagatctggttcacctcggtcatcttccccaagatgctgaccaacatcctgactggatacaagaccatctctctcccaggctgtttcctacaaagtttcctctatttctccctgggcaccacagagttcttcctactggcagtgatgtcctttgacaggtatgtggccatatgtaaccccttgcgttatgcaaccatcatgagcaaaaaggtctgtgtgaagtcagttctttgttcatggatggcaggattccttctcattgtctttccaagttccatcacttttcagcagccattttgtggccccaacgtcattaaccatttcttttgtgacaactttccactcctggaactgatatgtgcagacacgagtctgatagagcttctgggttttattgtggccaacctcagtttgctgggcactctgtccgtgacggccacctgctacggccacatcctccacaccatcctgcgcatcccctcggccaaggagagacagaaagccttctcaacctgctcctcccacatcattgttgtgtctctcttctatggcagctgcatcttcatgtacatccggtcaggcaagggaaatgagggggaggacaggaacaaggtggtggccttgctcaacaccgtggtgaccccgatgctcaatcccttcatctacaccctgcggaacaagcaggtgaagcaggtgtttaaggagcaggtaaacaagctcttc

SEQ ID NO: 2668 - protein, 308 aa, Felis catus
MRNHTTVTEFVLLGLSDACELQMLIFLGLLLTYLLTLLGNLLIVGITLVDRRLHTPMYYFLRNFAVLEIWFTSVIFPKMLTNILTGYKTISLPGCFLQSFLYFSLGTTEFFLLAVMSFDRYVAICNPLRYATIMSKKVCVKSVLCSWMAGFLLIVFPSSITFQQPFCGPNVINHFFCDNFPLLELICADTSLIELLGFIVANLSLLGTLSVTATCYGHILHTILRIPSAKERQKAFSTCSSHIIVVSLFYGSCIFMYIRSGKGNEGEDRNKVVALLNTVVTPMLNPFIYTLRNKQVKQVFKEQVNKLF

SEQ ID NO: 2669 - DNA, 957 bp, Felis catus
tcaaatttattgcatctttctggtcaaaagcaatctctttcttgttagaacttttctgaaagctttcttcacatctttgtttctcagggtgtatatgagagggtttaccaatggagtgaccacacagtagaacactgagatcactttaccaatagtgaagttgtgtgtggctggagggcgaacataagcaaagataatggtgccataataaatggtgaccacagtgaggtgggaggcacatgtggaaaaagctttcctctgagctttttgggaagacagcttgattattgtgaccacaatgtatccataggaaaacatagtgagaaggaaagaacttagaatcacaacagatgtacatgtgtagcccaaggcctccaccaaaaatgtatcagagcaagacagtttaaaaatggggtctgagtcacaaaagaaatggttgatcttctgggggccacagaagcttagatgggagatgagtatagtaggtagcagaggggcaatgaagcccccaatccatgatccagctgaaaaccgcaggcacacccgaagactcatgagaagtgaataccttaaagggctgcagatggccaggtaccggtcataggccatcactgcgagcaggatgcactctgtagctcccatggagaaaaagaagagtactggtatacaaccaaaaacagagatggtaacaacccgtgcgaggcaggtggccagcaacttaggcaccgtggctgtggtgtaccagatctccaggaatgacaaatttcctaaaaaaatgtacatgggtgtttggagtgtgacatccgtgagaacaatgaaaataataagagtgtttcccatgagggagagcagatacacagtgagaaatatcacaaacaaagttagccgcagatagagaacactagaaaacccaagaaaaatgaactctgtcactgctgtttggtttgttccatccat

SEQ ID NO: 2670 - protein, 316 aa, Felis catus
MDGTNQTAVTEFIFLGFSSVLYLRLTLFVIFLTVYLLSLMGNTLIIFIVLTDVTLQTPMYIFLGNLSFLEIWYTTATVPKLLATCLARVVTISVFGCIPVLFFFSMGATECILLAVMAYDRYLAICSPLRYSLLMSLRVCLRFSAGSWIGGFIAPLLPTILISHLSFCGPQKINHFFCDSDPIFKLSCSDTFLVEALGYTCTSVVILSSFLLTMFSYGYIVVTIIKLSSQKAQRKAFSTCASHLTVVTIYYGTIIFAYVRPPATHNFTIGKVISVFYCVVTPLVNPLIYTLRNKDVKKAFRKVLTRKRLLLTRKMQ

SEQ ID NO: 2671 - DNA, 1047 bp, Felis catus
ctagatagattctgcctgggccaggctggtcctcccaagggccctcaccatggcccccttcatttccttgtttcgaaaactatagatgatggggttgcacatgggggtgatgatggtgtagagaagggagaaaggcttgtctttgtcagggccatgtgtgctgcgaggattcatgtaagagaacatggctgaggtatagagaaagatgaccacagtcagatgggaggcacaagtagagaaggtcttcccccgacctgaggaagaggttctgccaaggatggaggccaggatgcgggcgtaggagataacaatgagcaccatggggctgagcagcaccacgatggcatcggcaaagatcattttcaggctaaactgggggtctccacaagagagggcaatcactatgggggcctcacagaagaagttttctatgtggttgtctctgcagaagggattccggaatgacatatactcaagaaagatgccattgatcagcccaaagaaccaggcagtactcaccagcctcacacagacatgctggctcatgatctgggcataattgagtgggtggcagatagcaatgtaacggtcataggccataaaagccaagaggacgcactcggctacacccacacagaagaccaggtacatctgggtcaagcaagagacaaaggagacagtgtggttcttgaccaccaggtggattagcatctgtgggatggtggtggtgatgaagcagacatccaggaaggacagatggccaaggaagaagtacatggggctgttgagtctggggtctgtccaggtgatgaagatgatgaggccattcatggccatggcaaggctgtagagggctaggaagagggcaaagagcaatgcccgagtggaagaggagctctgctcgaagcccacgaggataaactctgtcactgtgctcccattccttaggtccaccatctgcggcctgcttaaggagggaggacaggaaaagcacaggtgagatagttgtaggggaatgcaaggtactcacttgggcccagaaaccca

SEQ ID NO: 2672 - protein, 318 aa, Felis catus
MVDLRNGSTVTEFILVGFEQSSSSTRALLFALFLALYSLAMAMNGLIIFITWTDPRLNSPMYFFLGHLSFLDVCFITTTIPQMLIHLVVKNHTVSFVSCLTQMYLVFCVGVAECVLLAFMAYDRYIAICHPLNYAQIMSQHVCVRLVSTAWFFGLINGIFLEYMSFRNPFCRDNHIENFFCEAPIVIALSCGDPQFSLKMIFADAIVVLLSPMVLIVISYARILASILGRTSSSGRGKTFSTCASHLTVVIFLYTSAMFSYMNPRSTHGPDKDKPFSLLYTIITPMCNPIIYSFRNKEMKGAMVRALGRTSLAQAESI

SEQ ID NO: 2673 - DNA, 1006 bp, Felis catus
  modified_base (84)..(103): a, c, t, g, unknown or other
ctagatagattctgcctgggccaggctggtcctcccaagggccctcaccatggcccccttcatttccttgtttcggaaactatnnnnnnnnnnnnnnnnnnnncatgggggtgatgatggtgtagagaagggagaaaggcttgtctttgtcagggccatgtgtgctgcgaggattcatgtaagagaacatggctgaggtatagaaaaagatgaccacagtcagatgggaggcacaagtagagaaggtcttcccccgacctgaggaggaggttctgccaaggatggaggccaggatgcgggcgtaggagataacaatgagcaccatggggctgagcagcaccacgatggcatcggcaaagatcattttcaggctaaactgggggtctccacaagagagggcaatcactatgggggcctcacagaagaagttttctatgtggttgtctctgcagaatggaccacgaaatgtcatataatcaagcagaatgccattgatcagcccaaagaaccaggcagtactcaccagctttacacagacctgccggctcatgatctgtgcatagctgagtgggtggcagatagcaacgtaacggtcataggccataaaagccaagaggatgcactcggccacacctacaccaaaaaccagatacatctgggtcaagcaggaggcaaaggagacagtgtggttcttgaccaccaggtggattagcatctgtgggatggtggtggtgatgaagcagacatccaggaaggacagatggccaaggaagaagtacatggggctgttgagtctggggtctgtccaggtgatgaagatgatgaggccattcatggccatggcaaggctgtagagggctaggaagagggcaaagagcaatgcccgagtggaagaggagctctgctcgaagcccacgaggataaactctgtcactgtgctcccattccttaggtccaccatctgcggcctgcttgaggagggaagacaggaaaagcacaggtgaga

SEQ ID NO: 2674 - protein, 308 aa, Felis catus
  MOD_RES (302)..(308): Any amino acid
SHLCFSCLPSSSRPQMVDLRNGSTVTEFILVGFEQSSSSTRALLFALFLALYSLAMAMNGLIIFITWTDPRLNSPMYFFLGHLSFLDVCFITTTIPQMLIHLVVKNHTVSFASCLTQMYLVFGVGVAECILLAFMAYDRYVAICHPLSYAQIMSRQVCVKLVSTAWFFGLINGILLDYMTFRGPFCRDNHIENFFCEAPIVIALSCGDPQFSLKMIFADAIVVLLSPMVLIVISYARILASILGRTSSSGRGKTFSTCASHLTVVIFFYTSAMFSYMNPRSTHGPDKDKPFSLLYTIITPMXXXXXXX

SEQ ID NO: 2675 - DNA, 921 bp, Felis catus
ggcacacttttgttgcttcagcatcctctgcagagcagccttcacctcctggttcttgaggctgtagatgagggggttcagcaaggatgtgatcacactgtactgaatggagaccacacgctccaacactgagcctgaagcagggctgatgtacctgaatagagctgtcccatagaacaagagcaccacggtgaggtgggaggagcaggtggagaaggctttggcttggccctcagaggagcggatgttcagaatggcacaaattactctggagtaagagaagaggatcaggggaagtgtcagcagccctagaaatgcacaggacactgcaagaagaatctcattgacaatgggatcggtacaggacagaggaaagagaggaggtagctcacagctaaagtggaggatgatgttggacccgcagaaatacaacttgtggatgaagagactattcagcaaggaaatcagaaatcccactgcccacgatatgctcacaatcacaatacagagaggtctgtttatgaccatggtgtagaccagagggtggcagatagcagcatagcggtcataggccatggcagagagcagacaagcttctgtccccccagagagagtgaaaaagaagctctgagtgatgcatccccacattgagatgcttttattctgagttaagaagttctgtagcatcttgggcacagtgactgaggagaaactgagatccaggaaggataggtgtccaaggaagaagtacatgggtgtgtggaggcggggatcaaccctgatcaccaggatcatcaccagattccccaccagggtcaggaggtaaatccccaggaacagcacgaagagcatggtctggatctgggggtcactggataatcccaggaggacaaactcagtaatcatactgacatttttcat

SEQ ID NO: 2676 - protein, 307 aa, Felis catus
MKNVSMITEFVLLGLSSDPQIQTMLFVLFLGIYLLTLVGNLVMILVIRVDPRLHTPMYFFLGHLSFLDLSFSSVTVPKMLQNFLTQNKSISMWGCITQSFFFTLSGGTEACLLSAMAYDRYAAICHPLVYTMVINRPLCIVIVSISWAVGFLISLLNSLFIHKLYFCGSNIILHFSCELPPLFPLSCTDPIVNEILLAVSCAFLGLLTLPLILFSYSRVICAILNIRSSEGQAKAFSTCSSHLTVVLLFYGTALFRYISPASGSVLERVVSIQYSVITSLLNPLIYSLKNQEVKAALQRMLKQQKCA

SEQ ID NO: 2677 - DNA, 906 bp, Felis catus
ttactgcctcagtatcctctgcagagcagccttcacctcctggttcttgaggctgtagatgagggggttcagcaaggatgtgatcacactgtactgaatggagaccacacgctccaacactgagcctgaggcagggctgatgtacctgaatagagccgtcccatagaacaagagcaccaccgtgagatgggaggagcaggtggagaaggctttggcttggccctcagaggagcggatgttcagaatggcagaaatgattctggagtaagagaagaggatcaggggaagcgtcagcagccctagaaatgcactggaccctgacagaaggaacttgttggcagtgggatcagtacatgacagagggaagagtgagggcagctcacagcagaagtggaagatgatgttggacccacagaaatgtaacttgtggatgaaaagattatttaccagtgagttcagaacccctattccccatgctgcgctgaccattaccatgcagagaggcctgttcatgaccatggtatagagcagagggtggcagatggcggcatagcggtcataggccatggcagagagcagactggcttccgcacacccacagagaagaaaaaagaaactctgggtgatacagccccacacagagatgcttttcttctgagacaggaagttctgtagcattttgggcatagtaactgaagagaagcagatatctaggaaggacagatgtccaaggaaaaaatacatggggatgtggaggtgagaatcccctctgatcaccaggatcatcaccagattccccaccagggtcaggaggtaaatccccaggaacaccacaaagagcagagtctggatgcggcagtcagcagacagcccgaggaggatgaactcagtgaagaaagtgaagtt

SEQ ID NO: 2678 - protein, 301 aa, Felis catus
NFTFFTEFILLGLSADCRIQTLLFVVFLGIYLLTLVGNLVMILVIRGDSHLHIPMYFFLGHLSFLDICFSSVTMPKMLQNFLSQKKSISVWGCITQSFFFLLCGCAEASLLSAMAYDRYAAICHPLLYTMVMNRPLCMVMVSAAWGIGVLNSLVNNLFIHKLHFCGSNIIFHFCCELPSLFPLSCTDPTANKFLLSGSSAFLGLLTLPLILFSYSRIISAILNIRSSEGQAKAFSTCSSHLTVVLLFYGTALFRYISPASGSVLERVVSIQYSVITSLLNPLIYSLKNQEVKAALQRILRQ

SEQ ID NO: 2679 - DNA, 918 bp, Felis catus
acacatttattgcttcaacattttatacagagctgccttcacctcctggttcttgaggctgtagatgatggggttcagcaaggatgtgatcacactgtactgaatggagaccacttgttccaacttggagccggagaggggagtcatgtatctgaataaagctgtgccataatacaaaagcaccacagtaaggtgggaagaacaggtagagaaggctttgccttgaccctcagaagaacgtatgcttaggatggcagagatgattctggaataagagaagaggatcaggggaagtgtcacaaatcccaacagtgcacatgacccagcaagaagggcctcattggcagtagggtcagtgcaggagagagggaagagtgaaggcagctcacagcaaaagtgagggatgatattggggccacagaaatgtaagttgtaagtgaaaagactgtttggcaaggagtttaggaaccccactgcccatgctgcagttaccatcccaacacaaaaaggcctattcataaccatgctgtagaggagagggtggcagatggcagcatagcggtcatatgccatggcagagagtaggcaggcctctgtgctcccagagaatatgagaaagaaactctgggtcacacagccccacacagatacggttttcttctgcattagtaagttctgcagcatcttgggcatggttactgaagaaagacagagatctagaaatgacaggtgacctaggaagaagtacatgggtgtcttaaggtgagaatcagttctgatcaccaggatcatcatcacattccccattagggtcaagaggtaaatcaccagaaatagtgcaaaaaggatggtctggatctggggatttctggacaatcccatgaggacaaactcggtaacgatggtgagatttttcat

SEQ ID NO: 2680 - protein, 303 aa, Felis catus
MKNLTIVTEFVLMGLSRNPQIQTILFALFLVIYLLTLMGNVMMILVIRTDSHLKTPMYFFLGHLSFLDLCLSSVTMPKMLQNLLMQKKTVSVWGCVTQSFFLIFSGSTEACLLSAMAYDRYAAICHPLLYSMVMNRPFCVGMVTAAWAVGFLNSLPNSLFTYNLHFCGPNIIPHFCCELPSLFPLSCTDPTANEALLAGSCALLGFVTLPLILFSYSRIISAILSIRSSEGQGKAFSTCSSHLTVVLLYYGTALFRYMTPLSGSKLEQVVSIQYSVITSLLNPIIYSLKNQEVKAALYKMLKQ

SEQ ID NO: 2681 - DNA, 921 bp, Felis catus
aaagaattaacatatcttcttaatattcttctcatagctgtcttcacctccttgttctgtaggctgtagacaagggggttcagcatgggagtgaccacgctgtactgcaaggagggcatcatcgccagacgggagcctgaagttggcaagagatagctgaggaaacctgagccatagaacaagatcacagtagtgaggtgagaagagcaagtagagaaggccttgcttctgcctgaggtggagctgatgctcaggatggtggagacaatgcgaacataggaaaaacatcataacgaaggttccaaagaaatgcaagacagaggagcacagcaggagtgtgaagttggtcgaggtatcagaacaagacagagggaagagagaagacagctcacagctgaagtggggaagagtctggtcctcgcaatagtctaaattgacagccaagaggatattaatgagagcatcaacaaaggccaggccccaggaaccccacaccatcccaacacagagctggttgctcatcacctggccatagagcagaggggagctgatggctacatagcggtcataggccatcacagccagcagacaggcctctgtacccccggtggcaaacacaaagaaggcctgagccaggcagctctctacaaagatgactttgctttcagaaagtagattctccagcatcttggggactgtaaaagttgggtggcagaggtccaggaaggacagctgtctcaaaaagaagtacatgggcatgtgaaggtgagaatcagtcctaatcaccagcagcatcaccaggttccccatcagggtcaggacgtaaatcaccagaaacaacatgaagagcagaatttgagtctgagggtcagcagataacataaggaggatgaactcactgacaatgctgtggtttctcat

SEQ ID NO: 2682 - protein, 304 aa, Felis catus
MRNHSIVSEFILLMLSADPQTQILLFMLFLVIYVLTLMGNLVMLLVIRTDSHLHMPMYFFLRQLSFLDLCHPTFTVPKMLENLLSESKVIFVESCLAQAFFVFATGGTEACLLAVMAYDRYVAISSPLLYGQVMSNQLCVGMVWGSWGLAFVDALINILLAVNLDYCEDQTLPHFSCELSSLFPLSCSDTSTNFTLLLCSSVLHFFGTFVMMFFLCSHCLHHPEHQLHLRQKQGLLYLLFSPHYCDLVLWLRFPQLSLANFRLPSGDDALLAVQRGHSHAEPPCLQPTEQGGEDSYEKNIKKIC

SEQ ID NO: 2683 - DNA, 936 bp, Felis catus
ctacatgagagaatgaaaatattttctgaacattcttcccatagctgccttcacctctttgttctgcaggctgtagacaagggggttcagcatgggagtgaccacgctgtactgcaaggagggcatcatcgccagacgggagcctgaagttggcaagagatagctgaggaaacctgagccatagaacaagatcacagtagtgaggtgagaagagcaagtagagaaggccttgcttctgcctgaggtggagctgatgctcaggatggtggagacaatgcgaacataggaaaaaacaatcataacgaaggttccaaagaaatgcaagacagaggagcacagcaggagtgtgaagttggtcgaggtatcagaacaagacagagggaagagagaagacagctcacagctgaagtggggaagagtctggtcctcgcaatagtctaaattgacagccaagaggatattaatgagagcatcaacaaaggccaggccccaggaaccccacaccatcccaacacagagctggttgctcatcacctggccatagagcagaggggagctgatggctacatagcggtcataggccatcacagccagcagacaggcctccgtgcccccagtggcaaacacaaagaaggcctgagccaggcagctctctacaaagatggttttactttcagaaagtagattctccagcatcttggggactgtgacagatgagtggcagaggtccaggaaggacagttgtcccaaaaagaagtacatgggcatgtggaggtgagaatcagccctaatcaccagcagcatcaagaaatttcccatcaaagtgaagagataaatcagaaagaacagcacaaagagtatagcctgaatattggggtcaatagatagtccaaggagaatgaactcactgatagcactgtagtttttcattgccat

SEQ ID NO: 2684 - protein, 311 aa, Felis catus
MAMKNYSAISEFILLGLSIDPNIQAILFVLFFLIYLFTLMGNFLMLLVIRADSHLHMPMYFFLGQLSFLDLCHSSVTVPKMLENLLSESKTIFVESCLAQAFFVFATGGTEACLLAVMAYDRYVAISSPLLYGQVMSNQLCVGMVWGSWGLAFVDALINILLAVNLDYCEDQTLPHFSCELSSLFPLSCSDTSTNFTLLLCSSVLHFFGTFVMIVFSYVRIVSTILSISSTSGRSKAFSTCSSHLTTVILFYGSGFLSYLLPTSGSRLAMMPSLQYSVVTPMLNPLVYSLQNKEVKAAMGRMFRKYFHSLM

SEQ ID NO: 2685 - DNA, 918 bp, Felis catus
ctagatacgttttctcaaaattcttctcacagctgccttcacctctttgttctttaggctatagatgagaggattcagcataggagtgaccacactgtactgcaaggagaagattaactcttgagtggatcctgaatttggcatgagatagcggagtaatcctgagccataaaagaagatcactgcagtgaggtgggaggagcaggtggagaaggccttgtttctgcctgtggtagcattgatactcaggatggtgaacaaaatgcaaacataggagaaaaatatcaagaggaaatttccaaagaaatgcaggaggctggaggagagcagggcagtaaaacttgcagacacatcagagcaagacaaagggtagagagaaggcagttcacagctgaagtgatgtatattttgagccccacagaaatctaaattgagagctacaaggatattgataagagcatccaaaaaagccacgctccatgagccccacaccagccccatacacaattgtctgttcatcatctggccatagagcagaggggagctgatggcaacatagcggtcataggccatgacagtgagtaggcaggattcagtgcccccagtggcaaacacaaagaaggcctgagccaggcagccctctactgagatggttttcttctcagacaggaggttctccaacagcttgggcacagtgacagaggagtggcagagatccaggaaggacaactgtcccaggaagaagtacatgggggtgtggaggcaagaatcagccctaatcaccagcagcagcatcaggttccccatcagggtcaggaggtaaataacaaggaacagtacaaagaggagaacctcgatctgggggtcagcagacagcccgaagaggatgaactcagaaacaacactgtggtttctcat

SEQ ID NO: 2686 - protein, 305 aa, Felis catus
MRNHSVVSEFILFGLSADPQIEVLLFVLFLVIYLLTLMGNLMLLLVIRADSCLHTPMYFFLGQLSFLDLCHSSVTVPKLLENLLSEKKTISVEGCLAQAFFVFATGGTESCLLTVMAYDRYVAISSPLLYGQMMNRQLCMGLVWGSWSVAFLDALINILVALNLDFCGAQNIHHFSCELPSLYPLSCSDVSASFTALLSSSLLHFFGNFLLIFFSYVCILFTILSINATTGRNKAFSTCSSHLTAVIFFYGSGLLRYLMPNSGSTQELIFSLQYSVVTPMLNPLIYSLKNKEVKAAVRRILRKRI

SEQ ID NO: 2687 - DNA, 916 bp, Felis catus
atggctttggggaaccacaccaccatcacagagtttatcctgcttgaactacctgctgacccccacattcagactctgctctttgtgcttttcttggtgatttatctcctgaccctagtagggaatctgacaatgatgctggtgaccaaggctgattcttacctccacagcctcatgtacttcttcctaagtttcctctctttcttagacctctgtttcccttgtcactgtgcccaagatgttggaaaacctcctttctaagaagaaaaccatctcagaagagggctgcctggctcaggtcttctttgtatctatcatggcagggactgaagtctgcctactctcagagatggcttatgaccactatgttgccatctgccacccactgctcaatggccaggtgatgagtaaacagtggtatttgcagctagtgtagggttcatggaacctgggcattctggacacattcattaatgtccctttggcaatgaaaatggacttctgtgataaccataccagcccacactacagctgtgagctgccctccctcttccttctctcttactcagatatttctacaaacctctttgtcatattctgctctttcctcccatatggccttgtaacttccctgtcaatcttcatctcttatgcccacattatctccaccatcctgagcatcacctccacctctggcagaagcaaagctttttccacctgctcctccaccttaccacaatgatcttgttctatggctcaggtcttcttcattatttcattccaacttcagaatccaccccccactctggatctgatctctgcaatatggtgtgatcactcccatgctgaatcctctcatctgcagaccaaaaaatgaggtgaaggatgctctgcagagaacactgggaaagtattt

SEQ ID NO: 2688 - protein, 86 aa, Felis catus
MALGNHTTITEFILLELPADPHIQTLLFVLFLVIYLLTLVGNLTMMLVTKADSYLHSLMYFFLSFLSFLDLCFPCHCAQDVGKPPF

SEQ ID NO: 2689 - DNA, 926 bp, Felis catus
atggccttggggaaccgcagcaccatcactgaattcttcctcctcgggctgtctgtcaacccccacatccaagctctgttttttgtgctgttcctgaatatttaccttctgaccatcatggggaacctgctgctgctgctggtgatcagggctgactctcacctccacacacccatgtactttttcctcagtcatctctctttcctggacttttgtttatcttcagctactgtgcccaggatgttgaaagacctcctatcggagataaaaactatctcagtaaggggctgcctggctcaaggcttctttgtgtttatcaccgcagggactgaagcttttctgctctcagtgatggcctatgaccgctatgctgccatctgccaccctctgctctatggacagatgatgagaaaacagctgtgtgtgcaacttgtattgggctcatggggcttgagttttttgaatgcacttattaacatcctccttgctgccagcttggacttctgtgagagccataccatcaaccactacagctgtgaggtgcccactctctttcctctgtcctgctctgatgtttctaccaacttcctagtgctgctctgctccatcctgcttcatggacttgggaccttcttcccaatcatctcatcctatggctgcattgtctccaccatcctgaacatcagctcgacctcaggcagaagcaaggccttctccacctgctcctcccacctcatcgcagtgatcttcttttatggatcaggttttctccgctatctcgtgccaacctcaggatccccccttgagttgatcttctctatgcagtatggtatgatcacccccatgctgaatcctctcatctatagcctgaagaacaaggaggtgaaggcagctgtgagaaggacactgggaacgtatttgccatg

SEQ ID NO: 2690 - protein, 309 aa, Felis catus
  MOD_RES (309)..(309): Any amino acid
MALGNRSTITEFFLLGLSVNPHIQALFFVLFLNIYLLTIMGNLLLLLVIRADSHLHTPMYFFLSHLSFLDFCLSSATVPRMLKDLLSEIKTISVRGCLAQGFFVFITAGTEAFLLSVMAYDRYAAICHPLLYGQMMRKQLCVQLVLGSWGLSFLNALINILLAASLDFCESHTINHYSCEVPTLFPLSCSDVSTNFLVLLCSILLHGLGTFFPIISSYGCIVSTILNISSTSGRSKAFSTCSSHLIAVIFFYGSGFLRYLVPTSGSPLELIFSMQYGMITPMLNPLIYSLKNKEVKAAVRRTLGTYLPX

SEQ ID NO: 2691 - DNA, 939 bp, Felis catus
atggacttggggaactacagcaccatcacggagtttatcctcctcgggctctccgccaatccccacgtccaggctgcactctttgtgctcttcctggggatttacctgctgaccatcatggggaacctgatgctgctgctggtgatcaggattgattttcacctgcacacacccatgtacttcttcctgagtcacctctcttttgtcgatatctgcttctcttcggtcactgtgcccaagatgctggagaaccttctgtctcaaaaagaaaacaatatcagtagagggctgccttgctcaagtcttctttgtgtttgttgctgcaggaactgaagcctgtctgctttctgcaatggcctatgaccgctatgctgccatctgccaccctctgctgtacggacagatcatgagtaaacagctgtatatgcagcttgtgtggggctcttgggactgggctttctggatgcactcatcaacatcttcctagctgtgaagatggtcttctgcaaggcccaaatcatcccccactacagctgtgaaatgccctctctcctctcactgtcctgttccgatatctccagcaacctcattgccttgctctgctccactcttctacatggactcggaaccttccttttggtcttcttatcctacacccgtataatcgccaccatcctgagcatcagctccaccttaggcagaagtaaggccttttccacctgctcctcccacctcatcgcagtgaccctttactatggctcaggtttgctccgccacctaatgccaaattcaggtgcgccccttgagctgatcttttctgtgcagtatactgtagtcactcccatgctgaatcctctcatctatagcctgaagaacaaggaggtgaaggcagctctggcaagaactttggaaaagtatttgcaacatatcaggtgctga

SEQ ID NO: 2692 - protein, 110 aa, Felis catus
MDLGNYSTITEFILLGLSANPHVQAALFVLFLGIYLLTIMGNLMLLLVIRIDFHLHTPMYFFLSHLSFVDICFSSVTVPKMLENLLSQKENNISRGLPCSSLLCVCCCRN

SEQ ID NO: 2693 - DNA, 957 bp, Felis catus
atggccttggtaaatcacagcaccatcattgagtttctccttcttggagtccctgaagatcatcatacccgggctctagtctttgtgcttttcctggtagtttacctcctgactctgtcagggaacctgttgataatcctggttatcaggaccaattctcaccttcacacacccatgtacttcttcttgaatcacctctccttcctggatctctgttactcttcggtcactgtgcccaagatgctagagaacctcctgtctgagaagaaagccatctcagtggaagactgtttgacccaggccttctttgtgcttgcctttgggggaacagagctctgcctccttgcagtcatggcctatgaccgctatgctgccatttgctaccctctactctatggtcagatgatgagcaatgagctgtgtgtgggactggcgtggggatcttggggtctggcctttttggatgctttcatcaataccctcctagcctggaatttggacttctgtgagacgcaagtcatctccaacttcatttgtgagattccttctctgttccctctatcctgttccaatagctctgacaactttgcagttctgctcggctctgccctcctgcatgcctttgggaccttcattctggtcttcttctcttacgcccgtattgtctccaccatcctgagcatcacctccacctcaggcagaagcaaggccttctccacctgctcctcccacctcaccgcagtgagcttattttacggctcaggttttcttcgctatctcatgccaacctcaggttccccgtgggagttggttttttccatgcagtacagtgtggtcactcccctagcgaatccccttgtttatagcctaaagaacaaggaagtaaaagcatctctgaaaaacatgttgcagaaaagtttacaacatctcaggtagcagatggcaagcagcggatga

SEQ ID NO: 2694 - protein, 311 aa, Felis catus
MALVNHSTIIEFLLLGVPEDHHTRALVFVLFLVVYLLTLSGNLLIILVIRTNSHLHTPMYFFLNHLSFLDLCYSSVTVPKMLENLLSEKKAISVEDCLTQAFFVLAFGGTELCLLAVMAYDRYAAICYPLLYGQMMSNELCVGLAWGSWGLAFLDAFINTLLAWNLDFCETQVISNFICEIPSLFPLSCSNSSDNFAVLLGSALLHAFGTFILVFFSYARIVSTILSITSTSGRSKAFSTCSSHLTAVSLFYGSGFLRYLMPTSGSPWELVFSMQYSVVTPLANPLVYSLKNKEVKASLKNMLQKSLQHLR

SEQ ID NO: 2695 - DNA, 936 bp, Felis catus
atggctttgaggaaccacagcaccatcacagagttcatcctccttggcctgtctgttgactcccacgtccaggttctgctctttgtgcttttccttgggatttacctctttactataatgggaaatctatcgatgctgttggtcatcagggaagatccccatctccacacacctatgtacttcttcctgagccacctctctttcatggacttttgtctctctactgccatagtgcccaagctgctggagaacctcctgtctcagagcaaaaccatctcagttgggggctgcctggctcaagccttctttgtgtttgacattggaggaacagaagtctgcttactttcagcaatggcctatgaccgttatgctgctatctgtcacccactcctctatggccgggtaatgaataatcagctgtatatgcagcttgtatggggctcatggagcctggggtttctagatgcactcattaacacccccctgacaatgaacttggatttctgtgaagcgaaaatcatccatcactatagctgtgagttgccctccctcttccctttgtcctgctctgatgtctctaccagcctcactgtcctggtctgttctacactcctgcatggcggtggtacattcttcctgattttcttctcctatgtgcgcattgtctccaccatcctgagcattagctcctcctcaggcagaagcaaggccttctccacctgctcctctcacctcactgcattgagcttcttctatggctcagctttcctccgttatctcatgccaacctcaggctcacctctggagctcatcttctccatacagtatggtgtggtcactcccctagtgaatcccctcatctacagcctgaaaaacaaggaggttaaaaatgcactgagaagaaccttgggaaagtgtttgcaatagtacatgtag

SEQ ID NO: 2696 - protein, 308 aa, Felis catus
MALRNHSTITEFILLGLSVDSHVQVLLFVLFLGIYLFTIMGNLSMLLVIREDPHLHTPMYFFLSHLSFMDFCLSTAIVPKLLENLLSQSKTISVGGCLAQAFFVFDIGGTEVCLLSAMAYDRYAAICHPLLYGRVMNNQLYMQLVWGSWSLGFLDALINTPLTMNLDFCEAKIIHHYSCELPSLFPLSCSDVSTSLTVLVCSTLLHGGGTFFLIFFSYVRIVSTILSISSSSGRSKAFSTCSSHLTALSFFYGSAFLRYLMPTSGSPLELIFSIQYGVVTPLVNPLIYSLKNKEVKNALRRTLGKCLQ

SEQ ID NO: 2697 - DNA, 947 bp, Felis catus
atggtcttgggaaaccacagcaccatcacagaattcatcctccttgggctatctgctgaccctcacacccaaattctcctctttgcatttttcctggaaatttacctcctgaccatcatggggaacctgatgatgatgatggcgattatgactgattcccatctccacacccccatgtacttcttcttgagtcacctctccttcctggatctttgtttaacttcagtcactgtgcccaagatgctggagaatctcctgtctcagaagaaatcagtatccatagaaagctgcctcgctcaggcattttttgtgttttccatcgcagggactgaagcttttgtgctctctgccatggcctatgaccgctatactgccatctgcaaccccctgctctatgaccaggtgatgagtaaacagctgtgtgggggtctggtatgggtctcatggggactgggctttctggatgctctcattaacaccctcacggcttgcaatttggacttctgtgaggctcgtgtcatacctcacttcagctgtgaactgccatctctattctctctgtcttgctctgatatctccaccaactttgcagtcctggtgtgctctgccatcattcatgcctctggaaccttactcctggtcttcttctcttacacccgtattatctccaccatcctgagcatcacctccacctcaggcagaagcaaggccttctccacctgctcctcccacctcactgcagtgagtttcttctatggatctgcttttcttcgctatctcatgccaaccttaagttccccgctggagttaattttttccatacagtacagtgtggtcactcctctagtgaatccccttgtctacagcttgaagaacaaggaagtaaaagcagctgtgcaaagaatgttgcaaaaaggtttacaacagctcagagagcagagaacagg

SEQ ID NO: 2698 - protein, 316 aa, Felis catus
MVLGNHSTITEFILLGLSADPHTQILLFAFFLEIYLLTIMGNLMMMMAIMTDSHLHTPMYFFLSHLSFLDLCLTSVTVPKMLENLLSQKKSVSIESCLAQAFFVFSIAGTEAFVLSAMAYDRYTAICNPLLYDQVMSKQLCGGLVWVSWGLGFLDALINTLTACNLDFCEARVIPHFSCELPSLFSLSCSDISTNFAVLVCSAIIHASGTLLLVFFSYTRIISTILSITSTSGRSKAFSTCSSHLTAVSFFYGSAFLRYLMPTLSSPLELIFSIQYSVVTPLVNPLVYSLKNKEVKAAVQRMLQKGLQQLREQRTG

SEQ ID NO: 2699 - DNA, 948 bp, Felis catus
atggcctcagggaatcacagccgcatcacagagttcattctcctcgggctgtctgctgacccccatgtccaggctctgctctttgttctgttcctgatgatttaccttctgactctgctggggaacctgctgatcatactcgtgatccatacagactctaacctccgcacacccatgtacttcttcctcagccacctctccttccaagacctcttctattcttccgtcactgtgcccaagctgctggagaacctcctgtctcagagaaaagccatctcagtagagggctgcctggctcaggtattctttgtgtttgccactacggggattgaggcttgcctgctctcagtgatggcctatgaccgctatgccgccatctgccaccctctgctctatggccaggtgatgagtaaacagctatgtgagaggctggtgtggggttcttgggttgtggcctttctggatgcactcatgaacatcctcctggctttgaatatggacttctgtgatgttcaaaccatccaccactactcctgtgagctgccttccctcttccctctctcctgctctgatgtctccaccaactctgcgatgctactctgctctgcgctcctgcatgccattgggacctgcctcctgatctttttctcttacgttcgcattgtctccaccatcctgagcatcggctccacctcaggcagaagcaaggccttctccacctgctcctcccacctgactgcagtgagcctgttctatggctcagccatttttcgctatctcatgccaacctcgggttcacctctggagctgatcctctccatacagtacagtgtaatcacgcccctggtgaatccgctcatctacagctggaagaacaaggaggtgaaggcagctctgaggagaatgacgataaaatatttacaatgtctcagcacagaagagatataa

SEQ ID NO: 2700 - protein, 315 aa, Felis catus
MASGNHSRITEFILLGLSADPHVQALLFVLFLMIYLLTLLGNLLIILVIHTDSNLRTPMYFFLSHLSFQDLFYSSVTVPKLLENLLSQRKAISVEGCLAQVFFVFATTGIEACLLSVMAYDRYAAICHPLLYGQVMSKQLCERLVWGSWVVAFLDALMNILLALNMDFCDVQTIHHYSCELPSLFPLSCSDVSTNSAMLLCSALLHAIGTCLLIFFSYVRIVSTILSIGSTSGRSKAFSTCSSHLTAVSLFYGSAIFRYLMPTSGSPLELILSIQYSVITPLVNPLIYSWKNKEVKAALRRMTIKYLQCLSTEEI

SEQ ID NO: 2701 - DNA, 929 bp, Felis catus
atggccttgagaaaccacagcaccatcacggagttcatcctccttgggctgtcggctgaccccgaagtccaggcgctgctctttgcgctcttcctggggatttacctcctgaccatgatggggaacctgatgatgctgctggtgaccagagctgattcccagctccacacacccatgtattatttcctgagtcatctctccttcctggatctttgcttttcttcagtcactgtgcccaagcttctggagaacctcctgtctgaaaggaaaatcatctcaaaagagggctgcctgattcaagctttctttgtgttggccattggaggaacagaaattttcctgctgtctgccatggcctatgaccgctatgctgccatctgccaccctctgctctatggccagatgatgagcagccagctgtgtgtaaggctggtatgggtttcatggagcctgggtttcctggatgcagttatcaacatccccctggctatgaacttgaacttctgtgaagcccataccatctcccactacagctgtgagctaccctctctctttcctttgtcctgctctgacgtctccagcaatgtcactgtcctgattgcttccacactcttgcatggctttggtacattcgtcctgatcttcttctcttatgcccgtgttgcaaccaccatcctgagcatcagctccaccacaggcagaagcaaggccttctccacctgctcctcccacctcaccacagtgagcttcttctatggatcagctttccttcgttatctcgtgccaacttcaggctcaccgctggagctcatcttctccatacagtatggtgtggtcactcccctaatgaatcccctcatctatagcctgaaaaacaaagaagtaaaggcggctctgagaagaatgttggagaaatgtttgcagtggca

SEQ ID NO: 2702 - protein, 310 aa, Felis catus
  MOD_RES (310)..(310): Any amino acid
MALRNHSTITEFILLGLSADPEVQALLFALFLGIYLLTMMGNLMMLLVTRADSQLHTPMYYFLSHLSFLDLCFSSVTVPKLLENLLSERKIISKEGCLIQAFFVLAIGGTEIFLLSAMAYDRYAAICHPLLYGQMMSSQLCVRLVWVSWSLGFLDAVINIPLAMNLNFCEAHTISHYSCELPSLFPLSCSDVSSNVTVLIASTLLHGFGTFVLIFFSYARVATTILSISSTTGRSKAFSTCSSHLTTVSFFYGSAFLRYLVPTSGSPLELIFSIQYGVVTPLMNPLIYSLKNKEVKAALRRMLEKCLQWX

SEQ ID NO: 2703 - DNA, 943 bp, Felis catus
atggcctggaggaaccacagcatcatcaccgagttcattctcacggggctgtccgacgacccccacatccaggctctgctcttcgtgctcttcctggggatttacctcctgaccgtgatggggaatctgatgctgctgctggtgatcaggaccgactcccgcctccacacgcccatgtacttcttcctgagtaacctgtccttcatggacctttgcttctcttctgtcactatgcccaagctactgaaggaccttctgtctgagaagaaaaccatctcagtagaaggctgcctgactcaggtgttctttgtgtttttttcttcggggactgaagcctgtctgctctcggtgatggcctatgaccgctatgccgccatctgccaccctctgctctacggccaagtgatgagcagccagctttgtgtggggctggtgctggcctcatggggcctggcctctctcaatgcatttgtcattgtgcttttggctattaacctggacttctgtgaggcccaaaccatccaccactacacctgtgagctgcctgctcttttccctctgtcttgttctgatatctccatcacaaccaatatcctgctctgctccagtttactgcacgggctgggaaccttcctcccaatctttttctcttatgcccgtattatctccaccatcctgcacatcagctccacctcaggcagaagcaaggccttctccacctgctcctcccacctcatcgcagtgatcctgttctttggctcaggttttctttgttatctcatgcccccctcgggttcctctttggatttgctcctctccttacagtacagtgcagtcacgcccttgctgaatcccctcatctacagcctaaagaacgtagaggtgaaggcggctgtgagaaggacactggggaaatatctctaatgtagtgaacaaagacaca

SEQ ID NO: 2704 - protein, 307 aa, Felis catus
MAWRNHSIITEFILTGLSDDPHIQALLFVLFLGIYLLTVMGNLMLLLVIRTDSRLHTPMYFFLSNLSFMDLCFSSVTMPKLLKDLLSEKKTISVEGCLTQVFFVFFSSGTEACLLSVMAYDRYAAICHPLLYGQVMSSQLCVGLVLASWGLASLNAFVIVLLAINLDFCEAQTIHHYTCELPALFPLSCSDISITTNILLCSSLLHGLGTFLPIFFSYARIISTILHISSTSGRSKAFSTCSSHLIAVILFFGSGFLCYLMPPSGSSLDLLLSLQYSAVTPLLNPLIYSLKNVEVKAAVRRTLGKYL

SEQ ID NO: 2705 - DNA, 925 bp, Felis catus
atggcctggaggaaccacagcatcatcaccgagttcattctcacggggctgtccgacgacccccacatccaggctctgctcttcgtgctcttcctggggatttacctcctgaccgtgatggggaatctgatgctgctgctggtgatcaggaccgactcccgcctccacacgcccatgtacttcttcctgagtaacctgtccttcctggacctctgcttctcttccgtcactgtgcccaagctactgaaggaccttctgtctgagaagaaaaccatctcagtggagggctgcctggctcaggtgttcttcgtgtttatcaccgcagggactgaagcctttctgctctcggtgatggcctatgaccgctatgccgccatctgccaccctctgctctacggccacgtgatgagcagccagctctgtgtgaggctggtgctggcctcatggggcctggcttccctcaattcagtcatcattgtgcttttggctattaacctggacttctgtgaggcccaaaccatccaccactacacctgtgagctgccctccctcttccctctgtcttgctctgatatttccatcaatattgacatcttgatctgctccaccttactgcacgggctgggaaccttcctcccaatctttttctcctatgcccgtattgtctccaccatcctgcacatcagctccacctcaggcagaagcaaggccttctccacctgctcctcccacctcatcgcagtgatcctgttctttggctcaggtttgattcgctatcttatgcccacctcgggttcctccctggatttgctctcctccttacagtacagtgcagtcacgcccttgctgaatcccctcatctacagcctaaagaatgtagaggtgaaggcggctgtgagaaggacagtggagaaatacctacact

SEQ ID NO: 2706 - protein, 309 aa, Felis catus
  MOD_RES (309)..(309): Any amino acid
MAWRNHSIITEFILTGLSDDPHIQALLFVLFLGIYLLTVMGNLMLLLVIRTDSRLHTPMYFFLSNLSFLDLCFSSVTVPKLLKDLLSEKKTISVEGCLAQVFFVFITAGTEAFLLSVMAYDRYAAICHPLLYGHVMSSQLCVRLVLASWGLASLNSVIIVLLAINLDFCEAQTIHHYTCELPSLFPLSCSDISINIDILICSTLLHGLGTFLPIFFSYARIVSTILHISSTSGRSKAFSTCSSHLIAVILFFGSGLIRYLMPTSGSSLDLLSSLQYSAVTPLLNPLIYSLKNVEVKAAVRRTVEKYLHX

SEQ ID NO: 2707 - DNA, 891 bp, Felis catus
gaaaaccagaccacctggctgatcctggttggctttggggagctgcaacacctgggcttcctccccttcaccttctttttagccatctatgtggtaacagttgggggcaacgccctcatcgtgctggctgtggcctccagtcggacactccacacacccatgtacttcttcctctgccacttttccttgctggagattggctacacctccaacatcatgcctcagctgctgcagagcttcctgaaagggagggaggccatctcactggtcagctgtctggtccagttctacatgtttgcctcgctggctgcagttgagtgcctcctgctatctgctatgtcctatgaccgttacctggccatctgccacccacttcgctaccctgtcctgatgagcacatggttgtgtggctgcctggctgctggagtctgggtcagtggattttctttctctgccttcactctggccctggcagcccctctgaccctctgccctggcaacagggagatcgaccactacttctgtgactttgctccagttgtagggctgttctgtggagatgtgggggttatgtgggcagctggagtgagcatctcaggctttctgacactggtccccttcctgttgattgtggcatcctatgccttcatcttaaggactgtgctgcaaataccttcaggccatggtagacagaaagctttctccacctgttcctcccacctcagtgtggtcggggtgtattatggcactctcattgtggtctatgtagccccaacagaccacatggcccccttgctccgaaaggccttctctgtcctctacactgtattcacccctatggtcaaccccattatttacagcctcaagaaccaagaggtaaagggggccctt

SEQ ID NO: 2708 - protein, 297 aa, Felis catus
ENQTTWLILVGFGELQHLGFLPFTFFLAIYVVTVGGNALIVLAVASSRTLHTPMYFFLCHFSLLEIGYTSNIMPQLLQSFLKGREAISLVSCLVQFYMFASLAAVECLLLSAMSYDRYLAICHPLRYPVLMSTWLCGCLAAGVWVSGFSFSAFTLALAAPLTLCPGNREIDHYFCDFAPVVGLFCGDVGVMWAAGVSISGFLTLVPFLLIVASYAFILRTVLQIPSGHGRQKAFSTCSSHLSVVGVYYGTLIVVYVAPTDHMAPLLRKAFSVLYTVFTPMVNPIIYSLKNQEVKGAL

SEQ ID NO: 2709 - DNA, 874 bp, Felis catus
atgggtgataagggagcaggcaaccactcagatgtaactgacttcattcttgtaggcttcagggtctgtccagaactccacattctcttcttcctcctattcctgctggtctatggcatggtccttttgggtaacattagtatgatggcaatcattgtgacagactcccagctgaatacaccaatgtttctttcgaggcaatctctccttcattgacctctcctactccactgttattgcccaaaaagccatggtcaacttcctgtctgagaaaaagactatctcttttgcaggttttgtggctcagctgttcctttatgcatttttcatggttacagaagcttttctcctggcagtcatggaatatgaccgcttcattgccataggcaaccctcttctttacagtgtgcacatgtcaagacgactttgcactcagctggtggctggttcctatctctgtggatggctcagttccatcctccaagtcagcacaacattctcagtgtctttctgtgcttcccgagtcattgatcacttctactgtgattcttaccaaattgagaagatctcctgctccaatctctctgtcaataagatggtgtctcttagtttggctgccttcattattttgcccaccatagttgttattgtagtatcttacatgtacatttgaccacagtcttgaaaatcccttccagtggagggagaaagaaagccttctccacctgcagctcccatttgggagtggtaagtttgctctatgggactgtctcctttgtgtatctcacacctccaagcaatcctgaacttgcttaaagtggcttcagtattttacatattggtcacactcatgttaaatcctctgatctactct

SEQ ID NO: 2710 - protein, 71 aa, Felis catus
MGDKGAGNHSDVTDFILVGFRVCPELHILFFLLFLLVYGMVLLGNISMMAIIVTDSQLNTPMFLSRQSLLH

SEQ ID NO: 2711 - DNA, 946 bp, Felis catus
atgggtgacaagggaggagacaaccactcagaagtgactgacttcattcttgtaggcatcagggtccgtccagagctccacagtctcctcttcctactattcctggttgtttatgggatggtccttctggggaaccttagtatgattggcatcattgtgaccgatccccggctgaacacaccaatgtatttcttcctaggcaatctctccatcattgacctctcctactccactgttattgtacccaaagccatggtcaacatcctatctcagaaaaagaccatatcctttgcaggctgtgtgactcagctatttctttatgcacttttcatggtcaccgaggcctttgtcctggcagccatggcctatgaccgcttcatcgccatctgcaatccactcctctacactgtccgcatgtcaagaagcctctgtatccagttggtggctggttcctatctctgtggctgggtcagttccatccttcaaatcagtgtaacattctcaatgtctttctgtgcttcccgagtcattgatcacttctactgtgattcaaaccccatcgagaagatctcctgttccaatatctttatgaataagatggtgtcattcagtctggctgtcctcattattttgcccacaatagttgttattgtggtatcttacatgtatattgtgtctgcagttttaaaaatccgctccagtgaagggaggaagaaagccttctccacttgcagctcacacctgggagttgtcagtttgctctatggaactgtttcctttgtctatctcacacctccaaataaccctgaacttcgtaaagtggcttcagtatgttacattttgttcacacctatgctgaaccctttaatctactctctgagaaataaagatgttaaagatgccgtgaaaaaagtcatatggaagcaaaaagttttactttaaatct

SEQ ID NO: 2712 - protein, 313 aa, Felis catus
MGDKGGDNHSEVTDFILVGIRVRPELHSLLFLLFLVVYGMVLLGNLSMIGIIVTDPRLNTPMYFFLGNLSIIDLSYSTVIVPKAMVNILSQKKTISFAGCVTQLFLYALFMVTEAFVLAAMAYDRFIAICNPLLYTVRMSRSLCIQLVAGSYLCGWVSSILQISVTFSMSFCASRVIDHFYCDSNPIEKISCSNIFMNKMVSFSLAVLIILPTIVVIVVSYMYIVSAVLKIRSSEGRKKAFSTCSSHLGVVSLLYGTVSFVYLTPPNNPELRKVASVCYILFTPMLNPLIYSLRNKDVKDAVKKVIWKQKVLL

SEQ ID NO: 2713 - DNA, 942 bp, Felis catus
atgggtgacaggggaccagacaatcactcggaagtgactgacttcatccttgtaggcttcagggtccgccctgagctccacattctcctcttcctgatctttctgcttgtgtatgccatgatcctcctagggaatgttgggatgatgaccattattatggccgatccccggctgaacacacccatgtatttcttcctgggcaacctgtccttcattgatctcttctattcgtctgttattgcacccaaggccatgatcaacttctggtctgagagcaagtccatctcttttgcaggctatgtgacccaattctgtctctttaccctcttcatcgtggcagagggatttctcctggcagccatggcctatgaccgcttcattgccatctgcaacccactcctctactctgtgcagatgtcagcacgtctctgcactcagttggtggccggttgttatttatgtggctgcatcagctcggttcttcagaccagtatgacatttactctgtccttttgtggttctcgggccattgaccacttttactgtgacactcgcccacttcagaggctatcttgttctgacctcttcatctctagaatcatttccttttccttatccagcatcatcatcttgcctaccatcatagttattattatttcttacttgtatattgtgtccaccgttctcaagatacgctcctctgagggacgtaagaaagcattctccacttgcagctcacacctgggagtcgtgagtgtgctgtacggtgctgtgttttttatgtatctcactcctgacagatttcctgagctgagtaaagtggcctctttgtgttacaccctagtcactcccatgttgaatcctttgatttactccctgagaaacaaagatgtcaaagaagctctaaaaaaacttctggagaagaaaaatcctattctttga

SEQ ID NO: 2714 - protein, 313 aa, Felis catus
MGDRGPDNHSEVTDFILVGFRVRPELHILLFLIFLLVYAMILLGNVGMMTIIMADPRLNTPMYFFLGNLSFIDLFYSSVIAPKAMINFWSESKSISFAGYVTQFCLFTLFIVAEGFLLAAMAYDRFIAICNPLLYSVQMSARLCTQLVAGCYLCGCISSVLQTSMTFTLSFCGSRAIDHFYCDTRPLQRLSCSDLFISRIISFSLSSIIILPTIIVIIISYLYIVSTVLKIRSSEGRKKAFSTCSSHLGVVSVLYGAVFFMYLTPDRFPELSKVASLCYTLVTPMLNPLIYSLRNKDVKEALKKLLEKKNPIL

SEQ ID NO: 2715 - DNA, 945 bp, Felis catus
atgggtgacaagggagcaggcaaccactcagatgtaactgacttcattcttgtaggcttcagggttcatccagagctccacattctcctcttcctcctattcctgctggtctatggcatggttctttttgggaacattagtatgatgacaatcattgtgactgactctcagctgaacacaccaatgtatttctttctaggcaatctctccttcattgacctctcctactccactgttattgccccgaaagccatggtcaacttcctgtctgagaaaaagactgtctcctttgtggggtgtgctgcccagctcttcttttttgccttcttcattgtaacagaagggtttgttctggcagccatggcttatgaccgtttcatcgccatttgcaaccctcttctttacagtgtgcacatgtcaagacgactttgcactcagctggtggctggttcctatctctgtggatggctcagttccatcctccaagtcagcacaacattctcagtgtctttctgtgcttcccgagtcattgatcacttctactgtgattcttaccaaattgagaagatctcctgctccaatctctctgtcaataagatggtgtctcttagtttggctgccttcattattttgcctaccatagttgttattgtagtatcttacatgtacattgggaccacagtcttgaaaatcccttccagtgaagggagaaggaaagccttctccacctgcagctcccatttgggagtagtaagtttgctctatgggactgtctcatttgtgtatctcacacctccaagcaatcctgaactgcgtaaagtggcttcagtattttatatattggtcacacccatgttaaaccctctgatctattctctaagaaacaaagatgtcaaacaagctttgggaaaaatcctgtggaagaaaaaagctttatactaattc

SEQ ID NO: 2716 - protein, 313 aa, Felis catus
MGDKGAGNHSDVTDFILVGFRVHPELHILLFLLFLLVYGMVLFGNISMMTIIVTDSQLNTPMYFFLGNLSFIDLSYSTVIAPKAMVNFLSEKKTVSFVGCAAQLFFFAFFIVTEGFVLAAMAYDRFIAICNPLLYSVHMSRRLCTQLVAGSYLCGWLSSILQVSTTFSVSFCASRVIDHFYCDSYQIEKISCSNLSVNKMVSLSLAAFIILPTIVVIVVSYMYIGTTVLKIPSSEGRRKAFSTCSSHLGVVSLLYGTVSFVYLTPPSNPELRKVASVFYILVTPMLNPLIYSLRNKDVKQALGKILWKKKALY

SEQ ID NO: 2717 - DNA, 963 bp, Felis catus
atgagtgacaggggaacaaacaatcactcggaagtgactgacttcatccttgtaggcttcagggtccgctctgagctccacattctcctcttcctgatctttctgcttgtgtatgccatgatcctcctagggaatgttgggatgatgaccattattatgactgatccccggctgaacacacccatgtatttcttcctgggcaacctgtccttcattgatctcttctattcgtctgttattgcacccaaggccatgatcaacttctggtctgagagcaagtccatctcctttgcaggctgtgtgacccagctctttctctttgccctcttcatcgtggcggagggatttctcctggcagccatggcctatgaccgcttcattgccatctgcaacccactcctctactctgtccagatgacagcacatctctgcacgcagttggtggctggttcctatatttgtggctgctttagctcaattcttttgaccagcgtgacatttactctgtccttttgtgcttcccgagccatcgaccacttttactgtgattaccgtccacttcaaaggatttcttgttctgatatctactttcttaaggtggtttcttttttcttatgcagcattattattttgcctaccataattgtcattattgtgtcctatatgtatattgtgtccacggttttaaagataaaatcctctgaaggacgtaagaaagccttctccacttgcagttcacacctgggagtcgtgagtgtgttgtacggtgctgtgatttttatgtatttcatccctgatagatttcctgagctgagtaaagtggcctcattatgttacaccctagtcactcccatgctgaatcctttgatttactccctgataaacaaagatgtcaaagaagctttgagaaagattctagggaaaaaaatacttttatttcattctatcttaacagtgacataa

SEQ ID NO: 2718 - protein, 320 aa, Felis catus
MSDRGTNNHSEVTDFILVGFRVRSELHILLFLIFLLVYAMILLGNVGMMTIIMTDPRLNTPMYFFLGNLSFIDLFYSSVIAPKAMINFWSESKSISFAGCVTQLFLFALFIVAEGFLLAAMAYDRFIAICNPLLYSVQMTAHLCTQLVAGSYICGCFSSILLTSVTFTLSFCASRAIDHFYCDYRPLQRISCSDIYFLKVVSFFLCSIIILPTIIVIIVSYMYIVSTVLKIKSSEGRKKAFSTCSSHLGVVSVLYGAVIFMYFIPDRFPELSKVASLCYTLVTPMLNPLIYSLINKDVKEALRKILGKKILLFHSILTVT

SEQ ID NO: 2719 - DNA, 952 bp, Felis catus
tcaaagaataggatttttcttctctagaagttttttttagagcttctttgacatctttgtttctcagggagtaaatcaaaggattcagcatgggagtgactagggtgtaacacaaagaggccactttactcagctcaggaaatctgtcagggatgacatacataaaaatcatggcaccgtacaacacactcacgactcccaggtgtgaactgcaagtggagaacgctttcttacgtccctcagaggagcgtatcttgagaactgtggccatgatatacaagtaagaaataataataactatgatggtaggcaagatgatgatgctggataaggaaaaggaaatgattctagagatgaagaggtcagaacaagatagcctctgaagtgggcgtgtgtcacagtaaaagtggtcaatggcccgagaaccacaaaaggacagagtaaatgtcatactggtctgaactgagtatggtctgaactgagctgatgcagccacataaataggaactggccaccaactgcgtgcagagacgtgctgacatctggacagagtagaggagtgggttgcagatggcaatgaagcggtcataggccatggctgccaggagaaatccctccgccaccatgaagagggcaaagagaaagagctgggtcacacagcctgctaaagagatggacttgctctcagaccagaagttgatcatggccttgggtgcaataacagacgaatagaagagatcaatgaaggacaggttgcccaggaagaaatacatgggtgtgttcagccggggatcggccataataatggttatcatcccaacattccctaggaggatcatggcatacacaagcagaaagatcaggaagaggagaatgtggagctctgggtgggctctgaaccgtacaagaatgaagttagttacttcagagtcattgttcctctgtcacccat

SEQ ID NO: 2720 - protein, 197 aa, Felis catus
  MOD_RES (197)..(197): Any amino acid
MTASLPSATHSSTLSRCQHVSARSWWPVPIYVAASAQFRPYSVQTSMTFTLSFCGSRAIDHFYCDTRPLQRLSCSDLFISRIISFSLSSIIILPTIIVIIISYLYIMATVLKIRSSEGRKKAFSTCSSHLGVVSVLYGAMIFMYVIPDRFPELSKVASLCYTLVTPMLNPLIYSLRNKDVKEALKKTSREEKSYSLX

SEQ ID NO: 2721 - DNA, 963 bp, Felis catus
ttatgtcactgctaagatagaattaaacaaaaatatttttttccccagactctttctcaaagcttctttgacatctttgtttcttagagagtaaatcaaaggattcagcatgggagtgactagggtgtaacacaacgaggcaactttactcagctcaggaaatctgtcaggagtgagatacataaaaaacacagcaccgtacagcacactcacgactcccaggtgtgagctgcaagtggagaatgctttcttacgtccctcagaggagcgtatcttgagaactgtggacacaatatacaagtaagaaataataataactatgatggtaggcaagatgatgatgctgcataaggaaaaggaaatgattctagagatgaagaggtcagagcaagatatcctctcaagtgggcgagtgtcacagtaaaagtggtcaatggcccgagagccacaaaaggacagagtaaatgtcatactggtctgaagaaccgagctgatgcagccacataaataggaaccagccaccaactgagtgcagagacgtgctgacatctggacagagtagaggagtgggttgcagatggcaatgaagcggtcataggccatggctgccaggagaaatccctctgccacgatgaagagggtaaagagacagaattgggtcacacagcctgcaaaagagatggacttgctctcagaccagaagttgatcatggccttgggtgcaataacagatgaatagaagagatcaatgaaggacagattgcctaggaagaaatacatgggtgtgttcagccggggatcagtcataataatggtcatcatcccaacattacccagaaggatcatggcgtacacaagcagaaagatcaggaagaggagaatgtggagctcggagctgaccctgaagcctaccaggatgaagtcagtcacttcagagtgattgtttgttcctctgtcactcat

SEQ ID NO: 2722 - protein, 320 aa, Felis catus
MSDRGTNNHSEVTDFILVGFRVSSELHILLFLIFLLVYAMILLGNVGMMTIIMTDPRLNTPMYFFLGNLSFIDLFYSSVIAPKAMINFWSESKSISFAGCVTQFCLFTLFIVAEGFLLAAMAYDRFIAICNPLLYSVQMSARLCTQLVAGSYLCGCISSVLQTSMTFTLSFCGSRAIDHFYCDTRPLERISCSDLFISRIISFSLCSIIILPTIIVIIISYLYIVSTVLKIRSSEGRKKAFSTCSSHLGVVSVLYGAVFFMYLTPDRFPELSKVASLCYTLVTPMLNPLIYSLRNKDVKEALRKSLGKKIFLFNSILAVT

SEQ ID NO: 2723 - DNA, 963 bp, Felis catus
ttatgtcactgttaagatagaattaagtaaaagtatttttttccccagaatctttctcagagcttctttgacatctttgtttctcagagagtaaatcaaaggattcagcatgggagtgactagggtgtaacacaacgaggccactttactcagctcaggaaatctgtcaggagtgagatacataaaaaacacagcaccgtacagcacactcacgactcccaggtgtgagctgcaagtggagaatgctttcttacgtccctcagaggagcgtatcttgagaactgtggacacaatatacaagtaagaaataataataactatgatggtaggcaagatgatgatgcttgataagaaaaaggaaatcatcctatagatgaagaagtcagaacaagatatcctctcaagtgggcgagtgtcacagtaaaagtggtcaatggcccgagagccacaaaaggacagagtaaataccatgcttgtctgaagaaccgagctaatgcagccacagatataagaaccagccaccaactgaatgcaaagacgtgttgacatctgggaagagtagaggagtgggttgcagatggcaatgaagcggtcataggccatagctgccaggagaaatccctccgccacgatgaagagggcaaagagaaagagctgggtcacacagcctgcaaaggagatggacttgctctcagaccagaagttgatcatggccttgggtgcaataacagacgaatagaagagatcaatgaaggacaggttgcctaggaagaaatacatcggtgtgttcagccggggatcagtaataataatggtcatcatcccaacattccctaggaggatcatggcatacacaagcagaaagatcaggaagaggagaatgtggagctcagggcggaccctgaagcctacaaggatgaagtcagtcacttccgagtgattgtctgttcccctgtcacccat

SEQ ID NO: 2724 - protein, 320 aa, Felis catus
MGDRGTDNHSEVTDFILVGFRVRPELHILLFLIFLLVYAMILLGNVGMMTIIITDPRLNTPMYFFLGNLSFIDLFYSSVIAPKAMINFWSESKSISFAGCVTQLFLFALFIVAEGFLLAAMAYDRFIAICNPLLYSSQMSTRLCIQLVAGSYICGCISSVLQTSMVFTLSFCGSRAIDHFYCDTRPLERISCSDFFIYRMISFFLSSIIILPTIIVIIISYLYIVSTVLKIRSSEGRKKAFSTCSSHLGVVSVLYGAVFFMYLTPDRFPELSKVASLCYTLVTPMLNPLIYSLRNKDVKEALRKILGKKILLLNSILTVT

SEQ ID NO: 2725 - DNA, 939 bp, Felis catus
tcatttatataaagaaaagaccattctctggaccatgttcttgaaggcttgctttacctgctgattccttagtgaatatatgaaaggattcaggagaggagcaactgaggtaatgattacagctacccctttgtttaaagtcaccctttcccttgcagaaggcttaatgtacatgaagatgcagcttccataagagagggagaccactatcatgtgggaggaacaagtggaaaaggcttttttcctttgactcttggaaggaattttcagaattgtccggatgatgtacgtataggagagcataactagtgttaaggtgaccataagtgttaccactgctaaaataaatgccatgagttctaaaaagcgagtgtttgtacaggaaagctgtagaatcggagaagagtcgcagataaaatgatcaattacattggaggcacagaactccaacttctgcagcagaattactggtggaaagatgatcaggaatcctgcaagccatgagctaaagacaaggagtatgcagactctgtgattcatgatggtcatgtaatggagaggcttgcagatggccacgtagcggtcataggacatggcagccagaaggtaaaattctgtcacccccaacaggatgaagaaaaataactgagccacacaatcattgtaggaaatagttctgtttcccgtcactatagtgacaaggaatctggggatgcagacagatgtgaatgataattctgggaatgagaagtttcgaaggaagaaatacattggagtctttaagtggggatctgaaagtgtgagaatgataacgatcaggttcccagtcacactaagcatgtaggtagcaagaagaaatacgaaaagtacaacctgccattgtgggtcatttgtcaatccgagaagaataaattctgttactgctgtgtaatttctcat

SEQ ID NO: 2726 - protein, 312 aa, Felis catus
MRNYTAVTEFILLGLTNDPQWQVVLFVFLLATYMLSVTGNLIVIILTLSDPHLKTPMYFFLRNFSFPELSFTSVCIPRFLVTIVTGNRTISYNDCVAQLFFFILLGVTEFYLLAAMSYDRYVAICKPLHYMTIMNHRVCILLVFSSWLAGFLIIFPPVILLQKLEFCASNVIDHFICDSSPILQLSCTNTRFLELMAFILAVVTLMVTLTLVMLSYTYIIRTILKIPSKSQRKKAFSTCSSHMIVVSLSYGSCIFMYIKPSARERVTLNKGVAVIITSVAPLLNPFIYSLRNQQVKQAFKNMVQRMVFSLYK

SEQ ID NO: 2727 - DNA, 937 bp, Felis catus
atgggtggtaagggaggagacaaccactcagaagtgactgacttcattcttgtaggcttcagggtccgtccaaagctccacagtctcctcttcctactattcctggttgtttatgggatggtccttctggggaaccttattatgattggcatcattgtgaccgatccccggctgaacacaccaatgtatttcttcgtaggcaatctctccatcattgacctctcctactccactgttattgtacccaaagccatggtcaacatcctatctcagaaaaagaccatatcctttgaacgttgtgtgactcaattgtttctttatgcatttttcatggtcaccgaggcctctgtcttggcagccatggcctatgaccgcttcatcgccatctgcaatccactcctctacactgtccgcatgtcaagaagcctctgtatccagttggtggctggttcctatctctgtggctgggtcagttccatccttcaaatcagtgtaacattctcaatgtctttctgtgcttcccgagtcattgatcacttctattgtgattcaaacccagttgagaagatctcctgttccaatatctttatgaataagatggtgtcgttcagtctgactgtcctcattattttgcccacaatagttgttattgtggtatgttacatgtatattgtgtctgtagttttaaagatgcactccagtgaagggaggaagagagccttctccacttgcagttaccacctggggatcgtaagtttgctctgagactatttcctttgtcaatttcacacctcccaataaccttaaactttgtaaagtggcttcagtatgttacattttgttcacacctatgctgaaccctttaatctactctgagaaataagggtgttaaagatgccatgagaaaagtcctatggaagaaaaagttttactttaa

SEQ ID NO: 2728 - protein, 254 aa, Felis catus
MGGKGGDNHSEVTDFILVGFRVRPKLHSLLFLLFLVVYGMVLLGNLIMIGIIVTDPRLNTPMYFFVGNLSIIDLSYSTVIVPKAMVNILSQKKTISFERCVTQLFLYAFFMVTEASVLAAMAYDRFIAICNPLLYTVRMSRSLCIQLVAGSYLCGWVSSILQISVTFSMSFCASRVIDHFYCDSNPVEKISCSNIFMNKMVSFSLTVLIILPTIVVIVVCYMYIVSVVLKMHSSEGRKRAFSTCSYHLGIVSLL

SEQ ID NO: 2729 - DNA, 930 bp, Felis catus
atgggtgacaggggaacagacaatcattcggaagtaactgacttcatccttgtaggcttcagggtccgctccgagctccacattctcctcttcctgatctttctgcttgtgtatgccatgatcctcctagggaatgttgggatgatgaccattattatgactgatccccggctgaacacacccatgtatttcttcctgggcaacctgtccttcattgatctcttctattcgtctgttattgcacccaaggccatgatcaacttctggtctgagggcaagtccatctcttttgcaggctgtgtgacccagttctgtctttttgccctcttcatggtggcagagggatttctcctgggagccatggcctatgaccgcttcattgccatctgcaacccacttctctactctgtccagatgtcagcacgtctctgcactcagttggtggctggttcctatttatgcggctgcatcagctcagttcttcagacaagcacgacatttactttgccattttgtggttctcgggccattgaccactttttctgtgatattcgcccacttcagagactatcttgttctgacctcttcatctatagaatgatttctttttccttatccagcatcattaccttgcctacaataattgtcattattgtgtcctatatgtatattgtatccacagtactaaagatacgctcctctgagggacgtaagaaagcgttctccacttgtagctctcacctaggagtcgtgagtgtgctgtacggtgctgtgttttttacatatctcactccggacagatttcctgagctgagtaaagtgacctccttatgctataccttagtcactcccatgttgaatcctttgatttactctctgagaaacaaagatgtcaaagaggctctaaaaaaacttttagagatgaaaaat

SEQ ID NO: 2730 - protein, 310 aa, Felis catus
MGDRGTDNHSEVTDFILVGFRVRSELHILLFLIFLLVYAMILLGNVGMMTIIMTDPRLNTPMYFFLGNLSFIDLFYSSVIAPKAMINFWSEGKSISFAGCVTQFCLFALFMVAEGFLLGAMAYDRFIAICNPLLYSVQMSARLCTQLVAGSYLCGCISSVLQTSTTFTLPFCGSRAIDHFFCDIRPLQRLSCSDLFIYRMISFSLSSIITLPTIIVIIVSYMYIVSTVLKIRSSEGRKKAFSTCSSHLGVVSVLYGAVFFTYLTPDRFPELSKVTSLCYTLVTPMLNPLIYSLRNKDVKEALKKLLEMKN

SEQ ID NO: 2731 - DNA, 963 bp, Felis catus
ttatgtcactgttaagatagaattaaataaaataatttttttccccagaatctttctcaaagcttctttgacatctttgtttctcagggagtaaatcaaaggattcagcatgggagtgactagggtgtaacacaaagaggccactttactcagctcaggaaatctgtcagggatgacatacataaaaatcacagcaccatacagcacactcacgactcccaggtgagagctgcaagtggaaaacgctttcttacgtccctcagtggatcttatctttaaaaccgtggacacaatatacatataggaaacaataatgacaattatggtaggcaaaataataatgctgcataagaaaaacgtaaccatgttatgaaagtagagatcagaacaagatagcctctgaagtggacggtcatcacagtaaaagtggtcaatggttcgggaagcacaaaaggacaaagtaaatgttatgcttgtctgaagaaccgagctgatgcagccacataaatagcaaccagccaccaactgagtgcaaagacttgctgacatctgcacagagtagaggagtgggttgcagatggcaatgaagcggtcataggccatggctgccaggagaaatgcctccgccacgatgaagagggcaaagagaaagagctgggtcacacagcctgctaaagagatggacttgctctcagaccagaagttgatcatggccttgggtgcaataacagatgaatagaagagatcaatgaaggacaggttgcccaggaagaaatacatgggtgtgttcagccggggatcagtcataataatggtcatcatcccaacattccctaggaggatcatggcatacacaagcagaaagatcaggaagaggagaatgtggagctcagagcggactctgaagcctacaaggatgaagtcagtcacttccgaatgattgtctgttcccctgtcacccat

SEQ ID NO: 2732 - protein, 320 aa, Felis catus
MGDRGTDNHSEVTDFILVGFRVRSELHILLFLIFLLVYAMILLGNVGMMTIIMTDPRLNTPMYFFLGNLSFIDLFYSSVIAPKAMINFWSESKSISLAGCVTQLFLFALFIVAEAFLLAAMAYDRFIAICNPLLYSVQMSASLCTQLVAGCYLCGCISSVLQTSITFTLSFCASRTIDHFYCDDRPLQRLSCSDLYFHNMVTFFLCSIIILPTIIVIIVSYMYIVSTVLKIRSTEGRKKAFSTCSSHLGVVSVLYGAVIFMYVIPDRFPELSKVASLCYTLVTPMLNPLIYSLRNKDVKEALRKILGKKIILFNSILTVT

SEQ ID NO: 2733 - DNA, 920 bp, Felis catus
atgaagagcgagcctaacaggaattactcagaagtgactgagtttgttctactaggattcataacccctccaaaagtacagatcctcttattcctagtgttcttgctgatctacatggtcactgtggtgggaaatattagcatgataattgtcattaaggtggactccagacttcatatgcctatgtatttcttccttagaaacttgtcttatttagatctctgctactccacagtcattgctcccaaaaccttagccaacttcctatctaagggaaagaagatttcttacaatggctgcgcagcccaatttttcttctttgccctgtttgtcacaactgaaggctttcttctggctgtcatggcatttgatcgattctcggccatttgctcccctctcctttaccccgtgcacatgtcccagaaagtctgtgctcagttggtgactggatcctacatctgtggaggcatcaactccatggttcaaacaggtttcaccttcagtttgcgtttctgtggagaaaacagactagaccactttttctgtgacgtcccagccctgatcaagatctcctgtgcggacacatctgtgaatgagattgtgctgtacattctctctgctctcatcatcatcaccaccacaactgtcattgtggtttcctatgcttacatcctgtccaccgtcctgaagatcccctcgacccatggcaggggtaagaccttctccacctgtggctcccatatagcagtggtgagtttattctatggggctgtattcttcatgtatgcccagcctggggctatctcctctccagagtcaaacaagattgtagctgtgctgtacacactggtaataccgatgctaaaccctctaatatacagtctgagaaacagagatgtgcaagaggctatgaaaagaat

SEQ ID NO: 2734 - protein, 307 aa, Felis catus
  MOD_RES (307)..(307): Any amino acid
MKSEPNRNYSEVTEFVLLGFITPPKVQILLFLVFLLIYMVTVVGNISMIIVIKVDSRLHMPMYFFLRNLSYLDLCYSTVIAPKTLANFLSKGKKISYNGCAAQFFFFALFVTTEGFLLAVMAFDRFSAICSPLLYPVHMSQKVCAQLVTGSYICGGINSMVQTGFTFSLRFCGENRLDHFFCDVPALIKISCADTSVNEIVLYILSALIIITTTTVIVVSYAYILSTVLKIPSTHGRGKTFSTCGSHIAVVSLFYGAVFFMYAQPGAISSPESNKIVAVLYTLVIPMLNPLIYSLRNRDVQEAMKRX

SEQ ID NO: 2735 - DNA, 831 bp, Felis catus
atgaagaaagagctgaataggaattactcagaactgacagagtttattctgctgggattcagaacatctccagatgtacagatttttttattcttattcttcttgcttatctacatggtcattgtggtgggaaatatcagcatgataattgtcattaaaatagactccagacttcatacgcctatgtatttctttctcagaaatttgtcctatttagatctctgctactccacagtcattgctcccaaaactctggctactttcttgtccacggacaagaaaatttcctacaatggctgtgcaacacaattctttttcttcgctctttttgttgggactgaaggctttcttctagccgtgatggcatatgatcgcttctcagccatttgctcgcccttcctctatactgtacatatgtctcagcaggcttgtattcgtttagtgtttggctcctatatctgtggaggcatcaactccatggtccaaacaggtttcaccttcagtttgcatttctgtggagaaaacagactagaccactttttctgtgacgtcccagccctgatcaagatctcatgtgctgacacgtctgtgaatgagattgtgctgtacattctctctgctctcatcatcatcaccaccacaactgtcattgtggtttcctatgcttacatcctgtccaccgtcctgaagatcccctcgacccatggcaggggtaagaccttctccacttgcagctctcacattactgtggtgagcttattctatgggacggtgttcttcatgtatgcccagcctggggccatctcctcaccacagaaaagcaagataata

SEQ ID NO: 2736 - protein, 277 aa, Felis catus
MKKELNRNYSELTEFILLGFRTSPDVQIFLFLFFLLIYMVIVVGNISMIIVIKIDSRLHTPMYFFLRNLSYLDLCYSTVIAPKTLATFLSTDKKISYNGCATQFFFFALFVGTEGFLLAVMAYDRFSAICSPFLYTVHMSQQACIRLVFGSYICGGINSMVQTGFTFSLHFCGENRLDHFFCDVPALIKISCADTSVNEIVLYILSALIIITTTTVIVVSYAYILSTVLKIPSTHGRGKTFSTCSSHITVVSLFYGTVFFMYAQPGAISSPQKSKII

SEQ ID NO: 2737 - DNA, 951 bp, Felis catus
atgatttgtgaaaatcacaccagagtcactgaatttcttcttctcggttttacaaataaccctgagatgcaagtttccctctttattttgttcctggtcatctatacagtcactttgttgggcaacttccttatcgtcacagttaccagtgtggatcctgctcttcaaacacccatgtacttctttctccgaaacctatcacttctcgaagtctgttttaccttggtcatggtgccgaagatgctggtagatctagtgtctccaaggaaagtcatctcttttgtaggctgtggtgcccagatgtactttttcttcttctttggcagctctgaatgttttcttctgtctatgatggcttatgatcgctttgtggccatctgtaaccctctccgttattcagtcataatgaataggtccctgtgcttgtggatggctgtcggctcttggatgtctggtgttcctgtctctatgctacaaacagcttggttgatggcccttcctttctgtggaccaaataccatagaccactttttttgtgatggtcctccggtgttgaaactagtcactcaggatacaagcatgtatgaaatgcaagcacttgcctccacactactgtttattatgtttcctttttccctcattttggtctcctacatccgcattatcacaactgtcctcaggatgccatctgctactggtcgccagaaggcattctccacctgttcgtcacacctcattgtggtatcccttttctatggaaccgccagcctgacctacctacggcccaaatccagccagtcccctgaaagcaagaagctagtgtcattgtcatacactgtcatcactcctatgttaaatccgatcatctacagcctaaggaacaatgaagtgaagggggctgtcaagaggacagtcactcaaaaagtcttgcagaagttagatgtgttttga

SEQ ID NO: 2738 - protein, 316 aa, Felis catus
MICENHTRVTEFLLLGFTNNPEMQVSLFILFLVIYTVTLLGNFLIVTVTSVDPALQTPMYFFLRNLSLLEVCFTLVMVPKMLVDLVSPRKVISFVGCGAQMYFFFFFGSSECFLLSMMAYDRFVAICNPLRYSVIMNRSLCLWMAVGSWMSGVPVSMLQTAWLMALPFCGPNTIDHFFCDGPPVLKLVTQDTSMYEMQALASTLLFIMFPFSLILVSYIRIITTVLRMPSATGRQKAFSTCSSHLIVVSLFYGTASLTYLRPKSSQSPESKKLVSLSYTVITPMLNPIIYSLRNNEVKGAVKRTVTQKVLQKLDVF

SEQ ID NO: 2739 - DNA, 937 bp, Felis catus
tgatgggcaaccagacatcagtgatagagttcattcttcttggactgacagctgacactgagcttcaggctgtgcttttcctttttctgctgctaacttacgtcttaagcatcgtgggaaacttgaccatcatcattctgaccacgctggattaccgcctccagactcctatgtatttcttcctccggaatttttccattctggaaatatcttttacctctgtctttgttcccaaaatgctagtcaacattggaactggagacaggactatctcctttgctgcttgtttcactcagtatttttttgccatccttctgggagcaaccgagttttatcttttagctgccatgtcctttgaccgctacgttgccatttgcaaacccctacactatacaactgtaatgagcaggagactctgcattcaacttgtcttgtgttcctggttctctggttttttggttgtcattgggcctcatataatgactctccagctgcctttctgtgcctccaacatcatcaatcattactgctgtgactgtactgtactgttgcatctagcttgttcagacacacatttcatagaagtgatggagttcatcttggctgcagtcaccctcatcttcaccttggtgctagtgatcctttcctacacgtacattatcaggacaattctgagaatcccctctgttcaacagagaaaaaagctttttctacatgtttctctcatatgattgtggtctcactttcttatggaagttgtatctttatgtacataaatccttctgttaaggatgcagaaacttttaataagggcgtggctgttttaaatacatcagttgcccctctgttgaaccctttcatctataccctcaggaataatcaagtgaaaatagccttcaaagatatggtcagcaaagtaacagctttttcaagaaaa

SEQ ID NO: 2740 - protein, 242 aa, Felis catus
MGNQTSVIEFILLGLTADTELQAVLFLFLLLTYVLSIVGNLTIIILTTLDYRLQTPMYFFLRNFSILEISFTSVFVPKMLVNIGTGDRTISFAACFTQYFFAILLGATEFYLLAAMSFDRYVAICKPLHYTTVMSRRLCIQLVLCSWFSGFLVVIGPHIMTLQLPFCASNIINHYCCDCTVLLHLACSDTHFIEVMEFILAAVTLIFTLVLVILSYTYIIRTILRIPSVQQRKKLFLHVSLI

SEQ ID NO: 2741 - DNA, 936 bp, Felis catus
ctacttggataaagacaggactctttgtagcaagttcttaaatgcttgcttcacctgttggttccttagagtgcaaataaaagggttcaaaagtggtgtgactgaggtattgagagttgctactcccttcattaaggatatcctctgtttgaccgagggtttaatgtacatgaagatgcagctgccatatgagagcgagatgacaatcatgtgagaagaacaagtggagaaagccttttttctctggttggcagaagggatttttaaaattgtcaggcaatatatgtgtacggtagaatcagtaatgccaaggtgaccagcagagtcaccaaagctaagatgaaactcataatttccaacacatgtgtatctgtgcaggagatctgcaggaggggagcagtgtcacagtagaaatgatcaatggtactggagtcacagaagtccaggcttctgtggactaaaatgagtcctggaaagattatgagggaaccagtgatccaagagcttaggatcagctggatacagattttgctgctcatgatggttgtataatgcaggggcttaaagatggcaacataacgatcataggacatgacaactaggagataaaattcggatgctccaagaaggaaggcaaaaaataactgagctgcacaacggttataggaaatggttttgtccccagttgccatgcttacaagcaatttgtaaatacacagttatataagaaatttctaagaaggaaaagttttgaagaaagaaatacataggggtcttgagatgagaacccagcaaagtaagggtaatgataattaagttgtctgagatgcttagcaagtaggtgagaagcaggaagacgaatagcacaatcttcacctttgggtcctctgtcaatcctgctaagataaatactgtcacagttgtacggttttccat

SEQ ID NO: 2742 - protein, 91 aa, Felis catus
MENRTTVTVFILAGLTEDPKVKIVLFVFLLLTYLLSISDNLIIITLTLLGSHLKTPMYFFLQNFSFLEISYITVYLQIACKHGNWGQNHFL

SEQ ID NO: 2743 - DNA, 938 bp, Felis catus
atgagaaaccacaccacggtaacaaccttcattcttcttggactgaccgataacccacaattacaagtggttatttttcttctccttttttcacctatatgttgagtgtcactgggaatctaaccataatcaccctcaccctgttggattctcatctaaagatacccatgtacttcttcctccgaagcttttcatttttagaaatcttattcacaactgtctgcatccccaaatttcttgtcagcatggcaacaggtgacaagaccatttcttacaacagttgtgcaacacagctgttttttactactgtcttgggtgcaatcgaattttttcttctggttgccatgtcttatgaccgctatgtagccatctgcaaacccttgcattacaccaccatcatgagtgacagagtctgcaacttgttggtctttgcttcatggttggccggttttatagtaattgtcccaccactccttgtgggtctccagctagacttctgtgcagccaacactgtaaatcatttcttctgtgattttactcctatattacagctctcttgcacagacacagctgtaatagaattaatggcatttctctcagccattttgacactcctggttacactggtattagtgattctctcctatgcaaacatcatcaggactattctgaagataccttcttctcaacagaggaagaaagccttttctacatgttcttctcacatggtggttgtgtccatttcttatggcagctgcatcttcatgtatgtgaagccttctacaaaggagagagtgtctttaaataaagggatagccttgctcagtacttctgttgcccccatgttgaatcccttcatttatacactgagaaacaaacaagtgcaagatgcttttaggcacatgctcaaaaagattaagattttctcaagtaagtga

SEQ ID NO: 2744 - protein, 279 aa, Felis catus
MLSVTGNLTIITLTLLDSHLKIPMYFFLRSFSFLEILFTTVCIPKFLVSMATGDKTISYNSCATQLFFTTVLGAIEFFLLVAMSYDRYVAICKPLHYTTIMSDRVCNLLVFASWLAGFIVIVPPLLVGLQLDFCAANTVNHFFCDFTPILQLSCTDTAVIELMAFLSAILTLLVTLVLVILSYANIIRTILKIPSSQQRKKAFSTCSSHMVVVSISYGSCIFMYVKPSTKERVSLNKGIALLSTSVAPMLNPFIYTLRNKQVQDAFRHMLKKIKIFSSK

SEQ ID NO: 2745 - DNA, 939 bp, Felis catus
atgggaaatcacacacaagtgacagtgtttatcctggcaggtttgactgatgatccacaattgaaagttgtgctatttgtcttcctgcttctcacctacctgctaagtgtcactggcaatctgctcatcatcacactcaccctggtggatatcaccctcaagacccccatgtattttttccttcggaatttttccttcctagaaatttcctatactaccacatgcattcccaaattgttggttgctatggcaactggaaacaaaaccatttcctttaattgttgtgttactcaagtgttttttgccttccttcttggtgcatctgaattttacttgctggcagccatgtcctatgaccgctatgttgccatctgtaagcccctgcactacacaaccatcatgagcagtaagatctgcatgcaacttgtcttctgttgttggcttgctgggttttttgtcatctttccacctctcctcttaggcataaaccttgacttctgtgcctccaacgttgttgatcatttctactgtgatacaactcccctgctgcagatctcctgctcagacacacagctcttagagaccatgggattcatttctgcatcagtgacacttgtggtcacgttggtaatggtgataatatcatacagctttattgcattaacaattctaaacatcccttcaactaatcaaaagaaaaaggctttttcaacatgttcctctcacatgattgtgatatctctttcttacggcagctgtatcttcatgtacgttaagccgtcagtcaaacaaagaatatctttttccaagggaattgcagtgctcaatacctccattgccccacttttaaatcctttcatttacactttacggaaccagcaagtgaaaaaagccttcatgaacatgatacaaagggttgtttctttctcaagcaaatga

SEQ ID NO: 2746 - protein, 312 aa, Felis catus
MGNHTQVTVFILAGLTDDPQLKVVLFVFLLLTYLLSVTGNLLIITLTLVDITLKTPMYFFLRNFSFLEISYTTTCIPKLLVAMATGNKTISFNCCVTQVFFAFLLGASEFYLLAAMSYDRYVAICKPLHYTTIMSSKICMQLVFCCWLAGFFVIFPPLLLGINLDFCASNVVDHFYCDTTPLLQISCSDTQLLETMGFISASVTLVVTLVMVIISYSFIALTILNIPSTNQKKKAFSTCSSHMIVISLSYGSCIFMYVKPSVKQRISFSKGIAVLNTSIAPLLNPFIYTLRNQQVKKAFMNMIQRVVSFSSK

SEQ ID NO: 2747 - DNA, 940 bp, Felis catus
ttacaattgtttttatgaaaagcacatcttttgtaacatatcccagaagacttcttttacctgctgtttccttagggtataaataaagggatttagtaaaggggcaactgaggtatacagcaaagctacagctttggataaagtcactctttctttggcaaatggtttaatatacataaagatgcaactcccataagtcatggagacaacaatcatatgggaagtataggtggaaaaagctttggtcctttgctgtgctgaagggaatttaataatggtcttaataatgcaagtgtaagacagaatcaccaacaccaatgtgatcataagtgtcacaacagcaaagataaaagacaccaattctaggacatgtgtatctgtgcaggatatctgcaggataggaggagtttcacacataaagtgatcaattattttggaagcacaaaaatccagcttgagtcccatgaccattggtggaaagatgattaggaatccagttacccaagaggagagtacaagttgatagcacactttgctgttcataatgattgggtaatgcaagggattacagatggcaacatagcggtcataggacatagcagccaaggtaaaactccataacccccagtaaaagaataaaaaataattgagctgcacaattgttatatgagatggttttttctctagccacaatggttatcaagtatctgggaatacatactgttgtgaatatgatttccaaaaatgagaaattatggagaaaaaaatgcattggtggcttgaggcgaggatctagcagggtaaggaggataatgattaagttccccaacaagctcaatatgtaattaagaaatagaaacatgaaaaccacaatttgcaattgtgggtcatctgtcaatccttggagaatgaaatctatttccatcgattgttttttcat

SEQ ID NO: 2748 - protein, 117 aa, Felis catus
MKKQSMEIDFILQGLTDDPQLQIVVFMFLFLNYILSLLGNLIIILLTLLDPRLKPPMHFFLHNFSFLEIIFTTVCIPRYLITIVAREKTISYNNCAAQLFFILLLGVMEFYLGCYVL

SEQ ID NO: 2749 - DNA, 938 bp, Felis catus
atgaggaatcagtcaagagagatggagttcattctcctaggactgaccgatgacccacaactgcaaattgtgatttttgtatttctctttctaaattatgtgttgagtgtaatggggaacttatccatcatccttcttaccttgctagatccccgcctcaagactcccatgtatttttcctccgaaatttctccttcttggaagcttcattgacaacagtctgtattcccagattcctgataagcattgtgactaaaaacaaaacaatatcctatgatagttgtgcatctcagttattctttttcctcttattagaaattacagaattttacctactggctgccatgtcttttgaccgttatgtagcaatctgcaaacccctacattatccagtgattatgaacaacaaagtgtgttaccaacttctattcagttcatggacatcaggctttctatttacatttccaccattggccttgggactgacactggaattctgtgcttccagagtaattgatcatttcatgtgtgacatttcccctgtgctgcagctttcttgcactgacactcatttcctggaattattttcatttgtcttagctattttaacactcctagtcacattgctgttagtgactctttcttacacatatattatcaagaccattctaaaaatcccctctgctcagaaaagaacaaaggctttttctacttgttcttctcatataattgtggtctcccttacttatggtagctgtatctttaattacataaaaccaacagcaaaggaaagggtaactttatccaaaggtgtaactgttatctatacctcagttgcccctttattaaaccctttcatttacactctaagaaaccagcaagtgaaacaagccttcaaagatatactccaaaagactttctcttttttcaaaaaatga

SEQ ID NO: 2750 - protein, 197 aa, Felis catus
MSFDRYVAICKPLHYPVIMNNKVCYQLLFSSWTSGFLFTFPPLALGLTLEFCASRVIDHFMCDISPVLQLSCTDTHFLELFSFVLAILTLLVTLLLVTLSYTYIIKTILKIPSAQKRTKAFSTCSSHIIVVSLTYGSCIFNYIKPTAKERVTLSKGVTVIYTSVAPLLNPFIYTLRNQQVKQAFKDILQKTFSFFKK

SEQ ID NO: 2751 - DNA, 928 bp, Felis catus
atgagaaaccacacagaaataacagagtttatcctcctgggattgtcagatgacccacagcttcaggtggtgatctttgtctctctgctcatcacctacatgctcagcatcactggcaacctgaccattatcacccttaccctgctggattcccacctccagacccccatgtatttcttcctcagaaacttctccttattagaggtttcattcacaactgtcagcatacccaagttcctgggcaccatgatgactggagataaaaccatttcctttaatgactgcattgctcagctatttttttcattctcttgggagtcactgaattttaccttctggccgccatgtcctatgaccgttacattgccatctgcaaacctctgcattacatgaccatcatgaatcacagagtctgcatactccttgtcttctcttcgtggctaacgtcattcttaatcatattccccgcactcatgttgctcctaaaccttaattactgtaggtctaatgttattgaccattttacctgtgattattttcccctgctgcaactttcctgttcagacacaaaattcttagaggcgctggggttttcctgcgctgtgttcactttaatgttcactttggccttgatatttctgtcttacacatatatcatcagaacaattttaagaattccttctactagtcagaggaaaaaggccttttccacatgttcatcccatatgattgtcatctccatctcctatggcagctgcattttcatgtacattaatccatcagcaaaagacacagtgtctctgagcaagggagttgctgtgctaaacacctcagtggcccccatgctgaacccctttatttacagcctaaggaatcagcaagtcaggcgagccttcatggacagggcaaggaagattgtatttttctc

SEQ ID NO: 2752 - protein, 195 aa, Felis catus
MSYDRYIAICKPLHYMTIMNHRVCILLVFSSWLTSFLIIFPALMLLLNLNYCRSNVIDHFTCDYFPLLQLSCSDTKFLEALGFSCAVFTLMFTLALIFLSYTYIIRTILRIPSTSQRKKAFSTCSSHMIVISISYGSCIFMYINPSAKDTVSLSKGVAVLNTSVAPMLNPFIYSLRNQQVRRAFMDRARKIVFFS

SEQ ID NO: 2753 - DNA, 931 bp, Felis catus
atgagaaaccacacagaaataacagagtttatcctcctgggattgtcagatgacccacagcttcaggtggtgatctttgtctctctgctcatcacctacatgctcagcatcactggcaacctgaccattatcacccttaccctgctggattcccacctccagacccccatgtacttcttcctcagaaacttctccttattagaggtttcattcacaactgtcagcatacccaagttcctgggcaccatgatgactggagataaaaccatttcctttaatgattgtatgattcagttattttttttcattctcttgggagtcactgaattttaccttttggccgccatgtcctatgaccgttacattgccatctgcaaacctctgcattacatgaccatcatgaatcacagagtctgcatactccttgtctttgcttcatggctggcttcattcttaatcatattcccatcacttatgctgttcatacaacttgattactgtaagtccaatgttatagaccattttacctgtgattattttcccttactacacctttcttgttcagacacaaaattcctagagatagtgggtttttcctgcgctgtgtttactctaatgttcactttggcgttaatagttctgtcctacatatatatcatcagaacaattttgaggattccttctgctagtcagaggacaaaggccttttccacctgttcttcccacatgatcgtcatctccatctcctatggcagctgcattttcatgtacattaatccatcagcaaaagacagagtgtctctgagcaagggagttgctgtgctaaacacctcagtggcccccatgctgaacccctttatttacagcctaaggaatcaacaagtcaagcaagccttcatggacagggcaaaaaagattgtatctttctcaa

SEQ ID NO: 2754 - protein, 311 aa, Felis catus
  MOD_RES (311)..(311): Any amino acid
MRNHTEITEFILLGLSDDPQLQVVIFVSLLITYMLSITGNLTIITLTLLDSHLQTPMYFFLRNFSLLEVSFTTVSIPKFLGTMMTGDKTISFNDCMIQLFFFILLGVTEFYLLAAMSYDRYIAICKPLHYMTIMNHRVCILLVFASWLASFLIIFPSLMLFIQLDYCKSNVIDHFTCDYFPLLHLSCSDTKFLEIVGFSCAVFTLMFTLALIVLSYIYIIRTILRIPSASQRTKAFSTCSSHMIVISISYGSCIFMYINPSAKDRVSLSKGVAVLNTSVAPMLNPFIYSLRNQQVKQAFMDRAKKIVSFSX

SEQ ID NO: 2755 - DNA, 938 bp, Felis catus
atgaaaaatcacacagtacccaaagaattcattcttctagggatatctgatgacccagagctccagactgtgatttttctctttttaattaccacatatatattaagtgtcactggaaatctgaccatcatcactctcaccttggtggattcccatctacagacccctatgtatttcttcctcaggaacttctctgtattagaaatatcctttacaactgtctgtattcctaggtttctgggcacaattatcaccagagacaaatctatttcatacaataattgtacagctcagttgtttttcttcatcttcatgggtataactgagttttatcttctcactgccatgtcctatgatcgctatgtagccatctgtaaacccctacattatgcaaccatcatgaacaaaagagtctgcattttacttgtcttttgtgcttggctggcaggattcttaaatatcttcccaccagttattctttttctccagttagattactgtggctccaatgtcatcgatcactttgtttgtgactattttcccctcttgcagttatcttgctcagacacatggctcctagaagtgattggcttttactctgcaatagtcatactgcttttcactttggcattaataattctatcctacatgttcatcatgagaacaattctgaaactgccttccgccagtcagagaaaaaaggcattttctacgtgttcctctcacatgattgtcatttccatctcttatggaagctgcatattcatgtatgccaacccttctgcaaacagaaggcatcattgaccaaaggagtagctattctgaatacctctgtggctcctatgatgaatccatttatatataccctgaggaaccagcaagtaaagcaagcctttaaggatactgtccaaaaggttttgtttttctccagtaattga

SEQ ID NO: 2756 - protein, 267 aa, Felis catus
MKNHTVPKEFILLGISDDPELQTVIFLFLITTYILSVTGNLTIITLTLVDSHLQTPMYFFLRNFSVLEISFTTVCIPRFLGTIITRDKSISYNNCTAQLFFFIFMGITEFYLLTAMSYDRYVAICKPLHYATIMNKRVCILLVFCAWLAGFLNIFPPVILFLQLDYCGSNVIDHFVCDYFPLLQLSCSDTWLLEVIGFYSAIVILLFTLALIILSYMFIMRTILKLPSASQRKKAFSTCSSHMIVISISYGSCIFMYANPSANRRHH

SEQ ID NO: 2757 - DNA, 939 bp, Felis catus
atgaaaaattacacctcagtaacagaatttattcttcttggattgacaaatgacccacagtggcaggttgtacttttcgtatttcttcttgctacctacatgctaagtgtgactgggaacctgatcattgtcaccctcaccctttcagatgcccacctgcagacgccaatgtatttcttccttcgaaacttctcattcctagaaatatcattcacgtctgtctgcattcccagattccttgtcacttttgtgacaagggacagaaccatttcctacaatggttgtgtgactcagctatttttcttcatcttcttgggggtgacagaattttaccttctggctgccatgtcctatgaccgctacgtggccatctgcaagcctctccattacatgaccatcatgagcaacagagtctgcacccttcttgtctttagctcgtggcttgcaggattcctgatcatctttccaccaatactgttgcttctacagttggatttctgtgcctccaatgtaattgatcattttatctgtgacgcttctccaattctacagctttcttgcacaaacactcgctttctagaactcatggcattttttttagcggtggtaacacttatggtcaccttaacgctagttattctgtcttacacatacatcatccgtacaattctgagaattccttccacaagtcaaaggaagaaagccttttccacttgctcctcccacatgatagtggtctccctctcttatggaagctgcattttcatgtacattaagcgttctgcaagggaaagggtgactttaagcaaaggagtagctgtgctcaatacctcagtggctcctctcttaaatcctttcatatatacactaaggaatcagcaggtgaagcaagcctttaagaatgtggtccagagaatggccttttactcaaataaatga

SEQ ID NO: 2758 - protein, 312 aa, Felis catus
MKNYTSVTEFILLGLTNDPQWQVVLFVFLLATYMLSVTGNLIIVTLTLSDAHLQTPMYFFLRNFSFLEISFTSVCIPRFLVTFVTRDRTISYNGCVTQLFFFIFLGVTEFYLLAAMSYDRYVAICKPLHYMTIMSNRVCTLLVFSSWLAGFLIIFPPILLLLQLDFCASNVIDHFICDASPILQLSCTNTRFLELMAFFLAVVTLMVTLTLVILSYTYIIRTILRIPSTSQRKKAFSTCSSHMIVVSLSYGSCIFMYIKRSARERVTLSKGVAVLNTSVAPLLNPFIYTLRNQQVKQAFKNVVQRMAFYSNK

SEQ ID NO: 2759 - DNA, 837 bp, Felis catus
ttcattcttcttggattaacaaatgacccaaagctaaatgttttgatttttctatttctatttttcacatatatactgagtataactggaaacctgacaattatcaccctcactctgatagatcctcaccttaaaactccgatgtatttcttccttaggaatttctcttttctagaaatcgcattcacaacagtttgcattcctagatttctggccagcattataacaggggatatgactatttcctataattcttgcatggtccaggtgtttttctttatactccttggctcgacagaattttttcttctgactgctatgtcttatgatcggtatatagctatctgtaagccattgcattacacaacaataatgaacagcagaatttgcaaccagcttgtaattagctcttggctggctggatttctcattatctttccacctgtcatgatgggacttcaactggatttctgtgactccaacatcattgaccatttcacctgtgactcttctcctatgctgttgatctcctgcacggacacagcattcctagagctcctgggattcttcctagcagtattcacactcatggtgaccttaatattagtgactctttcctatgtattcatccttaaaacaattctgagaatcccctcgcctgagcaaaggaaaaaggccttttccacttgttcctcacacatgattgtagtttccatttcttatggaagttgcattttcatgtacatcaaaacttcagcaaaagaaggagtggctttgaccaagggtatagcagtgctcaatacttctgttgccccaatgctaaatccttttatttac

SEQ ID NO: 2760 - protein, 279 aa, Felis catus
FILLGLTNDPKLNVLIFLFLFFTYILSITGNLTIITLTLIDPHLKTPMYFFLRNFSFLEIAFTTVCIPRFLASIITGDMTISYNSCMVQVFFFILLGSTEFFLLTAMSYDRYIAICKPLHYTTIMNSRICNQLVISSWLAGFLIIFPPVMMGLQLDFCDSNIIDHFTCDSSPMLLISCTDTAFLELLGFFLAVFTLMVTLILVTLSYVFILKTILRIPSPEQRKKAFSTCSSHMIVVSISYGSCIFMYIKTSAKEGVALTKGIAVLNTSVAPMLNPFIY

SEQ ID NO: 2761 - DNA, 892 bp, Felis catus
aaggtttgtttaacttactggtttctcagagtataaatgaatggattcaacaaaggggcaactgaagtattgagcacagctactcctttgcttgaagtaactcatttgcagatggctttatgtacatgaatatacaactaccataactgatggatacaataatcatgtgagaagaacaggtagaaagggcttttttcttttgcttaattgaagggaattttagaattttcttgatgatataagagtaagaaaggattactaagaacaatgtgacagtaaggatcatcacagctaagaaaaaagcaatcaggtctaggaaatgtgtgtctgagcaagaaagttgcaggacaggagaaatgtcacaaatgaaatgatcaatgatgtttgaggcacagaaatccaggttaagaattaagatcagtggagggaaaatcaccaggaattcagttacccaagaactgagtacaagctaatgacaaattctgctgttcatgatagatgtataatgcaaaggtttacagatggcaacatagcggtcataggacatagctgccagaaggaaaaattctataatccccaataatatgcagaaaaataactgagatatacaatcattataggaaatggtcttttctctggttacaatggtgattaggaatctggggaaacaagcacttgtgaatgaaatttccaggaaagagaaattacataggaagaaatacattggggtcttgagatgagaatccagtagtgtgagggcaatgatggttaagtttcctatcatactcaacatgtaatttagaagtagaaataaaaaaattacaatctttaactgagaataatctgtcagtcccagaaggataaactttatctgttttgtatggtgcttcat

SEQ ID NO: 2762 - protein, 140 aa, Felis catus
MKHHTKQIKFILLGLTDYSQLKIVIFLFLLLNYMLSMIGNLTIIALTLLDSHLKTPMYFFLCNFSFLEISFTSACFPRFLITIVTREKTISYNDCISQLFFCILLGIIEFFLLAAMSYDRYVAICKPLHYTSIMNSRICH

SEQ ID NO: 2763 - DNA, 932 bp, Felis catus
atgagaaatcacacagcaataacaacattcatcctgttgggacttacagaggacccacagctgcaagttctcctttttatcttcttatttctcacctatgtgctgagcatgactggaaatctgaccattatcattcttacattcatggattttcatcttaaaacacctatgtatgtttttcttcgaaatttctccattttagaaatcttattcacaacggtatgtattcccaggttcttgtacagcttatcaactggagataaaacgattacttataatgcttgtgttagtcaagtattttttattggggttttgggggccacagaattttttctcctggcagccatgtcctatgaccgctacgtggccatctgcaaaccccttcattacatgaccatcatgaacaacaaattatgtaccatctttgtcttctgttgctggatctctgggttgatgatcatcgtcacaccactcagtatgggcctccagctggaattctgtgactccaatgccattgaccattttggctgcgacccatttcctctttttaagatttcatgctcagatacgtggcttatagaacagacagttataatctgtgcagtattgatattcattattacactgattggtgtcattctttcctacatatatatcatcaggacaattctaagattcccttctgcttcccaaaggaaaaaagctttctccacttgttcatctcacatgattgttatttccatcacatatggcagctgtattttcatctatatcaagccttcagccaaagaacaggtgggcatcaataaaggggtatccgtgcttactacatctgttgctcctttgttgaacccgttcatttatactttgaggaacaagcaagtgaaacaagctttcaatgacacaataaaaaaaattgcatttaccttaca

SEQ ID NO: 2764 - protein, 311 aa, Felis catus
  MOD_RES (311)..(311): Any amino acid
MRNHTAITTFILLGLTEDPQLQVLLFIFLFLTYVLSMTGNLTIIILTFMDFHLKTPMYVFLRNFSILEILFTTVCIPRFLYSLSTGDKTITYNACVSQVFFIGVLGATEFFLLAAMSYDRYVAICKPLHYMTIMNNKLCTIFVFCCWISGLMIIVTPLSMGLQLEFCDSNAIDHFGCDPFPLFKISCSDTWLIEQTVIICAVLIFIITLIGVILSYIYIIRTILRFPSASQRKKAFSTCSSHMIVISITYGSCIFIYIKPSAKEQVGINKGVSVLTTSVAPLLNPFIYTLRNKQVKQAFNDTIKKIAFTLX

SEQ ID NO: 2765 - DNA, 961 bp, Felis catus
atgagaaaccaaaccacgcttacgactttcatcttgctgggactgacagatgacactcgactgaaaattttgctttttatctttctatttctttcctacatattgagtgcatctggaaacctaaccatcatcaccctcactctgattgattctcaccttaaaacaccgatgtatcttttcctccaaaatttctccttcttagaaatttcattcacaactgcttgtatccccaggttcttatatagcatatcatctggtgacaagtccattacctataatgcttgtgtcagtcaactgttgtttacagacctctttgcagtaacagagttttttctcctggccaccatgtcctatgatcgctatgtggccatctgcaaaccactgcattacatgaccattatgaacagcagagtctgcaagaacttcatcctcttctgttgggtagcagcactgatcatcattctcccaccactcagtctaggtttggacctggaattctgtgattcaaacatcattgatcatttttgctgtgatccatctcctatcctgaagatctcttgctcagatacatggttgatagagcagatggttatagtatgtgctgtgtttacattcatcatcaccctcatgtgtgtagttctttcctacatatatatcatcaggagcattctaaagttttcctctgcccaacaaagaaaaaaggccttttccacttgttcttcccacatgattgttgtttccattacttatggtagctgcatcttcatttatgtcaaaccttcagccaaggatgaggtggctattaataaagggatttcactccttattacttctatctcaccaatgctgaatccctttatttacacactgagaaacaagcaagtgaagcaagcttttcatgactcaattaaaaaaattgcattcctctcaaagatgtaaaggagaaatgagtcaatgaatc

SEQ ID NO: 2766 - protein, 312 aa, Felis catus
MRNQTTLTTFILLGLTDDTRLKILLFIFLFLSYILSASGNLTIITLTLIDSHLKTPMYLFLQNFSFLEISFTTACIPRFLYSISSGDKSITYNACVSQLLFTDLFAVTEFFLLATMSYDRYVAICKPLHYMTIMNSRVCKNFILFCWVAALIIILPPLSLGLDLEFCDSNIIDHFCCDPSPILKISCSDTWLIEQMVIVCAVFTFIITLMCVVLSYIYIIRSILKFSSAQQRKKAFSTCSSHMIVVSITYGSCIFIYVKPSAKDEVAINKGISLLITSISPMLNPFIYTLRNKQVKQAFHDSIKKIAFLSKM

SEQ ID NO: 2767 - DNA, 891 bp, Felis catus
tacagtaacaacattcattttctgggacagatgaccctgagctgcaagttctgatttttatctttctattttttacctacaagctgagtgtaacgggaccatcatcacactcacttttgtggatccctaccttaaaacacccatgtactttttttttttttttttttacaaaatttctccttcttggagatctcattcaccactgcctgtatttccaggtacttgtataacatagcaacaggtgacaaggtcattacctataatgctcatgtcatccaagtgttttttactgacctctttgcagtaacagaatttttcttgctggccatcatgtcctatgaccattatgtggccatctgcaaacccttgcattgggtaaccatcatgagcagaggagtctgcagcagtcttattttttcctgcttgttggctggattgttggtcataacctcccccacttagtctggggctagatctgaaattctgtgactcaaattttattgatcattttctctgtgatgcttctcccctcctaaagatagcatgttcagacacatggctcatgaaacaaactgttttaatctgtgctgacccccattttgacctttatatatgtagttctatcttatattatcaaaacaattttaggatttccatctgttcagcaaagaaaaaaggccttttacacctgttcttcccacatgactgtagttttcatcacctatggcatatgcatgttcatttatatgactcctacagcaaaagagaaagggactactaataaagcagtttcactactcactttttctgtttcacctacattaaatccatttatttatacactgagaaataagtaaaaaaaagcctcagtgactcaatcaaaagagttgc

SEQ ID NO: 2768 - protein, 19 aa, Felis catus
ATLLIESLRLFFTYFSVYK

SEQ ID NO: 2769 - DNA, 938 bp, Felis catus
atgagaaaccacacagtaacaacttttatcctactgggactaactgatgatccacaactgaagattatgattttcatctttctatttctcacctacatgttgagtataactgggaacctgataatcatctcccttactttcatagattctcaccttaaaaatgctatgtactttttcctacaaaatttctccttcttagaaatctcatttacctctgcttgtattcccagatatttgtacaacttatcaacaggagacaagacaatcacatatgacaactgtgtcactcaaatgtttttactgatctttttggtgtaacagaattttttctccttgccaccatgtcctatgatcggtatgtggccatctgcaaacccctgcattatgtgaccatcatgaacaacagggtctgtagaagactcatcgtttggtgctggacaactggcttcttggtcataatcccaccgctcagcctgggcctaaagctggaattctgtgactctaatgttattgaccattttttctgtgatgtatccccccttctaaagatatcatgctcagaaacatggctcatagagcagatggtcatagtctgtgctgtgttgacctttattatgacccttatatgtgtagttctatcttacatatacatcatcaaggccattctacaattctcttctgcccaccaaagaaaaaaggcattttctacatgttcttcccacatgattgtggtctccatcacctatggaagttgcattttcatctatgttaagccttcagcaaaggaattagtggctagtaacaagggtgtggtagtcctcattacatccattgctcctatgctgaaccccttcatttacaccttgagaaacaagcaagtaaaacaagctctcaaagactcaatcaagagaattgcattattctcaagaagtaatgga

SEQ ID NO: 2770 - protein, 199 aa, Felis catus
MSYDRYVAICKPLHYVTIMNNRVCRRLIVWCWTTGFLVIIPPLSLGLKLEFCDSNVIDHFFCDVSPLLKISCSETWLIEQMVIVCAVLTFIMTLICVVLSYIYIIKAILQFSSAHQRKKAFSTCSSHMIVVSITYGSCIFIYVKPSAKELVASNKGVVVLITSIAPMLNPFIYTLRNKQVKQALKDSIKRIALFSRSNG

SEQ ID NO: 2771 - DNA, 920 bp, Felis catus
atgaaaaatcatacagtaacaatcttcatcctattgggcctgacagacgaccctcaacttcaaattccaatttttatgtttctatttctcacttacatattgagtataactgggaatctgaccatcatatccctcactttagtagactctcaccttaaaacacccatgtactttttcctacagaattttgccttattagaaatttcttttacatctgcttgtatccctagatatttatacaacatagcaacaggtgacaggtcaattacatataatatttgtgttattcaagtgttttttaccgatgtttttggagtaacagaattttttctcttggctgccatgtcttatgaccgctatgtggccatctgcaaacccctgcagtatgtaaccatcatgaacaacagagtgtgcaagaggctcgtcctctgctgttggatggctggcttgttgatcatactcccgccacttactttgttcctcaatttgaaattctgtgattcaaatgtcattgattattttttctgtgatgcatctccaatcttgaagatttcatgttcagacacatggctcatagagcagttggttattgtctgtgctgtgctgaccttcattctgacccttgtgtgtgttcttcaatcttacatttctatcatcaagaccattctacaattcccctctacccaacaaaggaaaagagccttttccacctgttcttctcacatgattgtggtttccatcacctatggaagttgtatcttcatctatgtcaatccttcagcaaaggaatcagtgacaattaataagggtgtgacagtgctaatgacgtccatagctcccatgttgaacccattcatttacactctgagaaacaagcaagtgagacaagctttcagtgattctttcaaaaaaattgcatt

SEQ ID NO: 2772 - protein, 307 aa, Felis catus
  MOD_RES (307)..(307): Any amino acid
MKNHTVTIFILLGLTDDPQLQIPIFMFLFLTYILSITGNLTIISLTLVDSHLKTPMYFFLQNFALLEISFTSACIPRYLYNIATGDRSITYNICVIQVFFTDVFGVTEFFLLAAMSYDRYVAICKPLQYVTIMNNRVCKRLVLCCWMAGLLIILPPLTLFLNLKFCDSNVIDYFFCDASPILKISCSDTWLIEQLVIVCAVLTFILTLVCVLQSYISIIKTILQFPSTQQRKRAFSTCSSHMIVVSITYGSCIFIYVNPSAKESVTINKGVTVLMTSIAPMLNPFIYTLRNKQVRQAFSDSFKKIAX

SEQ ID NO: 2773 - DNA, 936 bp, Felis catus
atgagcaaccagacaataacaaccttcattctcctcggactgacagatgaccctcaatttcagattccaatttttatgtttctatttctcacttacatgttaagtataactgggaatctgaccattatattcctcactttgctcgactcccaccttaaaacacccatgtactttttcctacagaattttgccttattagaaatttcatttacatctgcttgtattcctagatatttatacaacatagcaacaggtgatagatcaataacttacaatatttgtgtcactcaagtgttttttattgatgcatttggggtaacagaattttatcttttggccatcatgtcttatgatcgctatgtggccatctgcaaacccctgcattatgtaaccatcatcaacaacaaagtttgcagaaggtttgtcctctgctgctggacagctggtgtgttgatcatactcgcaccacttatcatgatagtaaatctagaattctgtgactcgaatgtcattgattatttcttctgtgattcatatcctatattgaagatatcatgctcagacacctggcttttagagcagatggtgataacctgtgctgtactggccttcatcacaacccttctgtgtgttgttctgtcctatatctgcattatcaagactattctacaattcccctctgcccagcaaagaaaaagggccttttctacctgttcttctcacatgattgttgtttccattacatatggaagctgtattttcatctatgttaaaccttcagcaaaggaatcagtggctattaataagagtgtgacagtgctaatgacatccatagctcccatgttgaacccattcatttacactctgagaaacaaacaagtgagacaagctttcagtgactcattcaaaagaattgcattaccctcaaagaagtaa

SEQ ID NO: 2774 - protein, 311 aa, Felis catus
MSNQTITTFILLGLTDDPQFQIPIFMFLFLTYMLSITGNLTIIFLTLLDSHLKTPMYFFLQNFALLEISFTSACIPRYLYNIATGDRSITYNICVTQVFFIDAFGVTEFYLLAIMSYDRYVAICKPLHYVTIINNKVCRRFVLCCWTAGVLIILAPLIMIVNLEFCDSNVIDYFFCDSYPILKISCSDTWLLEQMVITCAVLAFITTLLCVVLSYICIIKTILQFPSAQQRKRAFSTCSSHMIVVSITYGSCIFIYVKPSAKESVAINKSVTVLMTSIAPMLNPFIYTLRNKQVRQAFSDSFKRIALPSKK

SEQ ID NO: 2775 - DNA, 882 bp, Felis catus
attcttttgggtctgacaaatgaccctgtactgcaggttgtaattttcctctttctattttttacctacttgttgagtgtgacaggaaacttaaccatcatcactctcactctgctggattcccacctaaagataccaatgtacttcttcctacggaatttctcctttttagaaatctcattcacaactgtttgtattccaaggttcctggtgagccttgtgacaaaggacaggactatttcctacatgagctgtatgactcagttattttttgtatctttttgggagtaactgaattttaccttctggctgctatgtccttcgaccgttatgtggctatatgtaaacctctgcattacaccaccatcatgagcaacaaagtttgctaccaacttgtactcagctcttgggtaactggattcttggtcatctttcctccaataatcttgggactcaagttggaattttgtgcttccaatgtcattgatcactttatttgtgattcttctcccatcctgcagatctcttgttcagatacacatttcctagagctaatgtcatttttcttggccgtgatgacactaatggtcacactgatgttagtgattctctcctacggctacatcatcaagacaattctcaaattcccttctgttcagcaaaggactaaagccttttctacctgttcctcccacatgattgtagtttccatctcttatggtagctgcatcttcatgtacataaaaccatcagcaaatgacagagtgactttaagcaaaggagtagctgtgctcaatacctcagttgcccccttattgaatcccttcatttatacactaagaaaccaacaagtgaaacaggcctttaaggatatggtccaga

SEQ ID NO: 2776 - protein, 190 aa, Felis catus
  MOD_RES (190)..(190): Any amino acid
MSFDRYVAICKPLHYTTIMSNKVCYQLVLSSWVTGFLVIFPPIILGLKLEFCASNVIDHFICDSSPILQISCSDTHFLELMSFFLAVMTLMVTLMLVILSYGYIIKTILKFPSVQQRTKAFSTCSSHMIVVSISYGSCIFMYIKPSANDRVTLSKGVAVLNTSVAPLLNPFIYTLRNQQVKQAFKDMVQX

SEQ ID NO: 2777 - DNA, 928 bp, Felis catus
atgaaaaatcattctgcaataacattcattctactaggattgacagataacccactactacaggtttttctttcagtatttctgtttttcacctacattttcactgttactggaaatctaatcattattctcctcactctggttgactctcacctcaaaacacccatgtactttttcctttggaatttttccattttagaaataatatttacaactgcctgtgttcctagattcctgtacagcctgacaactggggacaaaagtgttacctataatgcttgtgccatccaattcttttttgccatcctcatcggagcaacagaattttttcttctaactgtatgtgctatgatcactatgtggccatctgcaaacccctgcactacagtaccatcatgagtgaaagagtatgcatcatgtttgtcctttgttgttggctgattgggttgtcatactcccaccgcttagcctgggagtccagctagatttcagtaactctaatctcattgaccattttggctgtgatgcatctcctcttctgaagattgtatgctcagacaccaatttgtagagcaacttattttaatcatggctgtgctgaccctcatagtcacattattctgtgtaattatgtcctacacatacatcatcaagactattttaagactcccttcagctcagcaaagaaaaaagcctttcttcacttgttcttcccacatgatcatagtctccatctgcctatggaagatgcatcttcatctatatcagaccagcaaaggaaggagttgccattaataaggtggtgtcattgctcaaaacctcagttatcccattgataaactctttcatttacacactacagaataagcaagtcaaacaagccttcaaatactcaattaaaaagatggcatttctttcaaaggattag

SEQ ID NO: 2778 - protein, 132 aa, Felis catus
MKNHSAITFILLGLTDNPLLQVFLSVFLFFTYIFTVTGNLIIILLTLVDSHLKTPMYFFLWNFSILEIIFTTACVPRFLYSLTTGDKSVTYNACAIQFFFAILIGATEFFLLTVCAMITMWPSANPCTTVPS

SEQ ID NO: 2779 - DNA, 939 bp, Felis catus
atgagaaattgcacagcagtaacaacattcatccttctgggattaacagatgaccccaaaatacaagttctgctttttgtatttttgtttctcacctacatgttgagtgtggctggaaacctcatcattatcaccctcacacttttggattcccatcttaaaactcctatgtatcttttcctccggaatttctctttcttagaagtctcattcaccactgtctgtattcccagattcctgtatatgatgacaactggagacaatactgttacctacaatgcttgcgccacccaattattttttattgtcctctttggagcaacagaattttttctccttgctgccatgtcgtatgaccgctatgtggccatttgtaagcccctgcactacacaaccatcatgaacaacagagtctgtactaccctcattctctgctgttggttcgctggcctgttaatcatcctcccacctcttggcatgggcctccagctggaattctgtgactcaaatgtgattgatcattttggttgtgatgcatctcctattttgcagataacctgctcagacacagtgttaatagagagaattgttttgagttttgctgtgctgacactcattattactttagtgtgtgtagtcctctcctacacatacatcattaagaccattctacaattcccttctgcccaacaaaggaaaaaggccttttccacctgctcttcccatatgattgtggtttccatcacttatggcagctgtatcttcatctacatcaaaccttcagcaaaggaaggggtagctactaataaagtagtgtctgtgctcactacttcagttgcccctttgcttaacccattcatttatacacttcgaaacaaacaagtgaaagatgccttcaaagacacagtaaaacggattgtatttctcaccaagaagtaa

SEQ ID NO: 2780 - protein, 312 aa, Felis catus
MRNCTAVTTFILLGLTDDPKIQVLLFVFLFLTYMLSVAGNLIIITLTLLDSHLKTPMYLFLRNFSFLEVSFTTVCIPRFLYMMTTGDNTVTYNACATQLFFIVLFGATEFFLLAAMSYDRYVAICKPLHYTTIMNNRVCTTLILCCWFAGLLIILPPLGMGLQLEFCDSNVIDHFGCDASPILQITCSDTVLIERIVLSFAVLTLIITLVCVVLSYTYIIKTILQFPSAQQRKKAFSTCSSHMIVVSITYGSCIFIYIKPSAKEGVATNKVVSVLTTSVAPLLNPFIYTLRNKQVKDAFKDTVKRIVFLTKK

SEQ ID NO: 2781 - DNA, 938 bp, Felis catus
atgaaaaattatacagcaataacaacattcatcctggtgggactaacagatgacccaaatctacagattctgctttttatttttttgtttctaatttacttgttaagtgttgtagggaatctgaccatcatcactctcaccttagtggattcccaccttaaaagtcccatgtattttttcctctggaatttctccatcttggaagtgtcatttacaactgtttgtattcccagattcctctacacaatggcatctgaggacaataacgttacctacagtgcatgtgccactcaattattttttgttactgtcttgggtgtaactgagttttttctcctgacagccatgtcctatgactgctatgttgccatctgcaaactcctgcattacataaccttcatgaataacagggtctgcatcaagttcctgattggaacctgcatcattgctctgatcattgtcatcccaccatttggcatgggcttgagctcaagttttgtgactccaatgtcatatatcactttggctatgatgctacttccatcctgaagattaccggctcagacacagagtttatagagcaatttgtcttggtcctggctgtgctgacactcattttcaccttggtgtgtgtaattatgtcctacacatacatcatcaggaccattctcagattcccttctgcccagcaaaggaaaaaggctttttctacttgttctccccatataattgtggtttctattacttatggaagatgcatctttatctatatcaaacctcatgcaaaagaaggggttgctattaataagctggtgtcagtgcttaccacctccattgccccagtgatgaatcccttcatttatactctgaggaacaagcaagtagtacaagctttcaaagacatgatctgaaaggttacatctatctcaaataactaa

SEQ ID NO: 2782 - protein, 182 aa, Felis catus
MKNYTAITTFILVGLTDDPNLQILLFIFLFLIYLLSVVGNLTIITLTLVDSHLKSPMYFFLWNFSILEVSFTTVCIPRFLYTMASEDNNVTYSACATQLFFVTVLGVTEFFLLTAMSYDCYVAICKLLHYITFMNNRVCIKFLIGTCIIALIIVIPPFGMGLSSSFVTPMSYITLAMMLLPS

SEQ ID NO: 2783 - DNA, 932 bp, Felis catus
ttctttgaaagaaatgcaagtcttttaaggatgtcatggaaagaccgccttacttgtgtatttctcagagtataaatgaaggggttcaacaaaggggcaacagatgtagtgagcagagaaactgccttattaatggccacttcatccttagctgaaggtttgatatacataaaaatgcagctgccataggtgacagaaaccacaatcatgtgggaagaacaggtggaaaaggcttttttcttttgctgggcagaaggtaatcttagaattgtcctaatgatgtatatgtaggacagaactatacacacaagggtcattatgaaggtcaacacagcacagactatgaccagctgctctatgaaccatgtatctgaacatgaatttttcagtatcggagaagcatcacagacaaaatggtcaatatcagagtcacagaattccagatggaggctcaaaccaaggggtggaaagataatcaataagccagacacccaacaagacaggataagattccaacagactctgttgttcatgatggtcacgtaatgcaggggtttgcagatggccacatagcggtcgtaggacatcacagccaagaggaaaaattctgtagctccaaagagaacaataaaaaagatttggctgaagcaggccttgatggtgatggttttgtccccacttgatatcatgtacaggtatgtggggacacaggcagttgtgaatgagatttctaagaaggagaaattttgaagaaaaagatacatagctgtttttaaatgagaatccaccaagatgagagaaattatggtcagattcccaattacacttatcatatatgtgataaacagaaagataaaaaccagaatctctagttgtgggtcatttgtcaaacccagtatgatgaacattgttattgccgaatggtttctcat

SEQ ID NO: 2784 - protein, 311 aa, Felis catus
  MOD_RES (311)..(311): Any amino acid
MRNHSAITMFIILGLTNDPQLEILVFIFLFITYMISVIGNLTIISLILVDSHLKTAMYLFLQNFSFLEISFTTACVPTYLYMISSGDKTITIKACFSQIFFIVLFGATEFFLLAVMSYDRYVAICKPLHYVTIMNNRVCWNLILSCWVSGLLIIFPPLGLSLHLEFCDSDIDHFVCDASPILKNSCSDTWFIEQLVIVCAVLTFIMTLVCIVLSYIYIIRTILRLPSAQQKKKAFSTCSSHMIVVSVTYGSCIFMYIKPSAKDEVAINKAVSLLTTSVAPLLNPFIYTLRNTQVRRSFHDILKRLAFLSKX

SEQ ID NO: 2785 - DNA, 920 bp, Felis catus
caatgaaaaataaaccaggttgactgaatgtatcctgctgggtctaacagatgtccctgaactccaggtggtggttttcacctttatgttccttgcttatttactcagcatcatcagaaatctgactatcctcatcctcaccttgctggactcccaccttcagactcccatgtatttctttctctggaacttctctttattagaaatgtccttcacaaacattttcattcccagggtcctgatcagcatcacaacagggaataagagtatcagtttagctggctgcttcactcagtatttctttgcaatattccttggggcaacagagttttatcttctggctgccatgtcctatgaccgctatgtgaccatatgcaaacccctgcattacatggccattatgagcagcagagtttgtacccaaatggttctctactcttggctggctgggttactggttattataccactaatccctctgatgagtcaacaggacttttgtgcatccaacaggctgaatcattatttctgtgactatgagcccctttggaaactctcctgttcagacacaagcctcatcaagaaggttgtctttcttgtggcatctgtgaccctactggtcactctgactgctgactctctcctatatgttcataatcaggattattctgaagctcccctcagggagcaaaggacaaaagccttttccacctgttcttcccatatgaccatgatctctccctcctatggaagctgcttcttcacattcattaacccctcagcaaaaaaaaaaggacacagttaacaagggagtagctctactcattactacagtcacacctttattgaaccccttcatttatgccctaaggaaccaacaggtaaacaagctttcaaggatatagtcaaaaagcttgtga

SEQ ID NO: 2786 - protein, 20 aa, Felis catus
TSFLTISLKACLPVGSLGHK

SEQ ID NO: 2787 - DNA, 935 bp, Felis catus
gttagcaatgaaaaaccaaacctttctgacagaattcattcttctgggactatcagacatcccggagatccaacttgtaatctttatatttctcttcctcacctacatattcagcatcattggaaacctgacaatcatcacccttactctactggattcccacctccagactcccatgtatttcttcctccggaacttctccttcttagaaatttcctttacaaccacttttactcccaggctgctgttcagcatcacaactggaaacaagagcatcagctttgctggctgcttcacacagtatttctttgccatcttctttggagccacagagttttaccttctggctgccatgtcctttgaccgctatgtggccatatgcaaacccctgcattacatgaccattatgagcagcagagtctgcatccagctggtcctctgctcttggttggctggattcctaatcatcatatccccaatcatcctgaccagtcagctggatttctgtgcctccaacatgctgaatcattattactgtgactatggacccctcctagaaatatcttgctcagacacaagattcctggagctggttgactttatcttagcagttgtgaccttggtggtcactctgatgctagtgattctctcctacacaaacatcatctggaccattctcaagatcccctcagctcagcaaaggaaaaaggctttttccacgtgtttttcccacatgattgtcatctccctctcttatggcagctgcatcttcatgtacataaaaccctcagctaaagaaggagttgccttcaataagggggtagctgtgctcaataactcagttgcccctttattgaacccattcatttacaccttaaggaacaaacaagtaaaacaagccttcaaggatgtggccagaaagattatgagtattt

SEQ ID NO: 2788 - protein, 310 aa, Felis catus
  MOD_RES (310)..(310): Any amino acid
MKNQTFLTEFILLGLSDIPEIQLVIFIFLFLTYIFSIIGNLTIITLTLLDSHLQTPMYFFLRNFSFLEISFTTTFTPRLLFSITTGNKSISFAGCFTQYFFAIFFGATEFYLLAAMSFDRYVAICKPLHYMTIMSSRVCIQLVLCSWLAGFLIIISPIILTSQLDFCASNMLNHYYCDYGPLLEISCSDTRFLELVDFILAVVTLVVTLMLVILSYTNIIWTILKIPSAQQRKKAFSTCFSHMIVISLSYGSCIFMYIKPSAKEGVAFNKGVAVLNNSVAPLLNPFIYTLRNKQVKQAFKDVARKIMSIX

SEQ ID NO: 2789 - DNA, 927 bp, Felis catus
atgaaaaataggacgtttagtgagttcatcctgttgggcttcacaaatcaacctgaggtccaagttgtgatattcatctttctgctcctcacgtatgtgataagtgtcctaggaaatctgactatcatcattctcactcgggtacaccctcacctccagacccccatgtatttcttcctccggaatttctccttcttagaaatttccttcacatccatttttattcccagatttctgaccagcgtgacaacaggaaataaagtcatcagttttgctggatgcttcattcaatatttttttgctatattccttggggcaacagagttttacctcttggcttctatgtcctatgaccgctatgttgctatctgcaaacccctgcattacctgaccatcatgagcaacagagtctgcatacaacttgtgttctgctcctggctggggggattgctagctatcttacccccaatcaccttgatgagccaggtggatttctgtgcctccaatgttctgaatcactattactgtgactatgggccccttctggagcttgcctgctcagacacaagcctcctagaacagatggtcatctttgtggcggttgtgactctggtggttaccctggtgctggtgacattttcttatacatacattatcaagaccattttgaggatcccttctgcccagcaaaggacaaaggctttttccacttgttcttcccacatgattgtcatctccctctcttatggcagctgcatgtttatgtacatcaatccatcagcaaaagaagaaggcgctttcaacaaaggaatagctgtgctcattacctcaattactcccttattaaaccccttcatttacactctaagaaatcagcaagtgaagcaagcattcaaggacaccatcaagaagattatgaagctttaa

SEQ ID NO: 2790 - protein, 308 aa, Felis catus
MKNRTFSEFILLGFTNQPEVQVVIFIFLLLTYVISVLGNLTIIILTRVHPHLQTPMYFFLRNFSFLEISFTSIFIPRFLTSVTTGNKVISFAGCFIQYFFAIFLGATEFYLLASMSYDRYVAICKPLHYLTIMSNRVCIQLVFCSWLGGLLAILPPITLMSQVDFCASNVLNHYYCDYGPLLELACSDTSLLEQMVIFVAVVTLVVTLVLVTFSYTYIIKTILRIPSAQQRTKAFSTCSSHMIVISLSYGSCMFMYINPSAKEEGAFNKGIAVLITSITPLLNPFIYTLRNQQVKQAFKDTIKKIMKL

SEQ ID NO: 2791 - DNA, 699 bp, Felis catus
accgtcatcgtgcccaagatgttgctcaacattgccacagggaccaagaccatcagttttgctggctgcattactcaggactttttccacatcttcctgggggctacagagttcctcctcctcacagccatggcctatgaccggtatattgccatctgccagcccctccactaccccatcctcatgagcaacagagtctgcacacagcttatcctcacctgctggctggcaggattcttcttcatcatagtgcctgtcatcctgaccagtcagcttccattctgtgacacccacatcaaccacttcttctgcgactatacgcctctaatggaggtggtgtgcagtgggccacaggtgttagagatggtggattttaccctggccgtggtggcactgatcagcactctagtgctgatcaccatatcctatgtccagatcatccggacaattgtcaggatcccctcggtccaggagagaaagaaagctttctccacctgttcctcccatatcattgtggtcaccctgtgctatggcagctgcttcttcatgtatgtgaagccctctcctggcaagggggttgatttcaacaaaggagtgtccctaatcaatacaattattgcccccctcttgaatccctttatctacactctcaggaaccaacaagttaagcaagtagtgaaagacctgatcaggaaaatg

SEQ ID NO: 2792 - protein, 233 aa, Felis catus
TVIVPKMLLNIATGTKTISFAGCITQDFFHIFLGATEFLLLTAMAYDRYIAICQPLHYPILMSNRVCTQLILTCWLAGFFFIIVPVILTSQLPFCDTHINHFFCDYTPLMEVVCSGPQVLEMVDFTLAVVALISTLVLITISYVQIIRTIVRIPSVQERKKAFSTCSSHIIVVTLCYGSCFFMYVKPSPGKGVDFNKGVSLINTIIAPLLNPFIYTLRNQQVKQVVKDLIRKM

SEQ ID NO: 2793 - DNA, 960 bp, Felis catus
atgacaccacttgaaatgaacaatcagacagatgtcactgaattcatcttcttgggattttccaaccaccccaaactacagggcttgtttttcctggttttcttgctcatttacctgacaacactcctggggaacatgctcattataacagccactagaatcagtcctgctctccacactccaatgtattatttcctcagcaacctgagtttcttggacatctgttatacatccaccaccatccccgtcatgctggtgaacttcttccgggagaagaagaccatctcatatgagggctgcctctcccagattttcttcctcgtcacatgtgctggcactgaatgtgtcttattggccgctatggcttatgatcgctatgtagccatttgccaccctcttcaatatcccgtcctcatgcgtgtgaaggtctgtatttttttggtggctgggtcctggctgtgtgggctggtgaattctgtgacacacacagtgctggcagccacactgactctctgtgggcccaaccaaatcagccactttctctgtgacattcctctgctcctgaagctctcctgttcagacacctctctcaatgagtctgtgcttcatgtggccagtgccaccattggcctgagcccctgtctgtttactggagtgtcctacatactcatcatttcttccattcttaggattccctctgctcagggcaggagcaaagccttctctacctgcgcatcccacctcactgtggtggtggtcttttatggaacagccaactttaactatgacagacccagagaaggttactccctagacatggatattctggtttctgtgctcttctgtgttatgactcccatgttgaaccccatcatatacagcctgagaaacaaggaggtcaagggtgctctgaggaagctggctggagggtatatgatccctggcaatattagtgtctag

SEQ ID NO: 2794 - protein, 319 aa, Felis catus
MTPLEMNNQTDVTEFIFLGFSNHPKLQGLFFLVFLLIYLTTLLGNMLIITATRISPALHTPMYYFLSNLSFLDICYTSTTIPVMLVNFFREKKTISYEGCLSQIFFLVTCAGTECVLLAAMAYDRYVAICHPLQYPVLMRVKVCIFLVAGSWLCGLVNSVTHTVLAATLTLCGPNQISHFLCDIPLLLKLSCSDTSLNESVLHVASATIGLSPCLFTGVSYILIISSILRIPSAQGRSKAFSTCASHLTVVVVFYGTANFNYDRPREGYSLDMDILVSVLFCVMTPMLNPIIYSLRNKEVKGALRKLAGGYMIPGNISV

SEQ ID NO: 2795 - DNA, 938 bp, Felis catus
ctaccgtgaaaatcgacctagcccaagacctttttcaaggcagccttaaattctttgttcctcaggcagtagatcaaggggttgattattggggtgaggaccgtgtacacagcagagacgagcttgttggagctccgggagtcaatggcctggggccggacgtacatgaaaagcaaggccgtatagaagatggtgaccacggtgaggtgggacgcacaggtggagaaggccctccagcggccagtggccgaggggatgcgcaggacggccagggcgatgtgcccgtacgacagcacggtggccacgagcggcagcaccaggatgacaaaggccacgacgaagtccaccagctctgcggtcgagaagtctgtgcaggccagtttgaggatgggggagatgtcacagaagaagtggttcaggacattggagccacagaacgtggcgctggagataaagtacaccttgatcacggagacggagaagccgcacgcgaaggagaaggccaccagccggacgcagagccccgtggtcatgatggcgtggtagcgcagggggtggcagatggccacgtggcggtcataggccatggaggccaggagcacgcactcggtgcataccaaggagctgaagaaatagagctgggtcatgcatccgacaaaggagatgcacttccgctgcaggaggagaccgtccagcatcttggggacgatggcagacacgtagcagatctccagggcggacagggcgcccaggaagtagtacatgggcctgtgcagggaggagctgctccggacggcgagcaggacggccaggttctccgccaggacgaagaggtaggtgagcaggaagaggaggaacagcacaggctgcagcccaggggccgtggggaagcccagcaggacgaacgcgctgaccgtgctgccgttctgtcccctcat

SEQ ID NO: 2796 - protein, 312 aa, Felis catus
TVKIDLAQDLFQGSLKFFVPQAVDQGVDYWGEDRVHSRDELVGAPGVNGLGPDVHEKQGRIEDGDHGEVGRTGGEGPPAASGRGDAQDGQGDVPVRQHGGHERQHQDDKGHDEVHQLCGREVCAGQFEDGGDVTEEVVQDIGATERGAGDKVHLDHGDGEAAREGEGHQPDAEPRGHDGVVAQGVADGHVAVIGHGGQEHALGAYQGAEEIELGHASDKGDALPLQEETVQHLGDDGRHVADLQGGQGAQEVVHGPVQGGAAPDGEQDGQVLRQDEEVGEQEEEEQHRLQPRGRGEAQQDERADRAAVLSPH

SEQ ID NO: 2797 - DNA, 727 bp, Felis catus
ctcatctgtcattgcccccagtgccccggccaacttcttctccccacccaaggtcatcacctttgctgtgccacccagttattcttcatctccttactggtcaccactgaaggcttcctcctgggcgtcatggcctgtgaccatttcatggccatctgcagccccccgtgctaccccatcaccatgtgccactctgtctacactcacctggtgctgggcacctactgtggaggctgcctcaactctgttgtgcagaccagtctcacattccgcctcccattctgcagctccaactgcatcaaccacttcttctgtgacgtgtcccctctgctccagcttgcctgtggcagcacagccatcaacgaacttctcgtttggcatctgtgggctcatcattgtgggtgtgacatttgtagtcctcatctcctatggctacatcacagtgaccatcctgaggatgcgctcaggagctgggagacgcaaggtcttctccacctgtggctcccacgtgactgtagtgactctctttgttgggactgtctttgtcatgtatgcccagccaggagccattgagtccatggagcagggcaaggtggtctctgtcttctacacgttggtcatcccaatgctcaatcctctcatctacagtcttcgaaacaaggatgtgaaggaggccctgcagaggctgggccagagacacatggtcacatgaaggatgtgctggtgg

SEQ ID NO: 2798 - protein, 236 aa, Felis catus
SSVIAPSAPANFFSPPKVITFAVPPSYSSSPYWSPLKASSWASWPVTISWPSAAPRATPSPCATLSTLTWCWAPTVEAASTLLCRPVSHSASHSAAPTASTTSSVTCPLCSSLPVAAQPSTNFSFGICGLIIVGVTFVVLISYGYITVTILRMRSGAGRRKVFSTCGSHVTVVTLFVGTVFVMYAQPGAIESMEQGKVVSVFYTLVIPMLNPLIYSLRNKDVKEALQRLGQRHMVT

SEQ ID NO: 2799 - DNA, 946 bp, Felis catus
actcagaggccttccttgaacctgttaacttgaggaaagccctcttcacatctttgtttctaaggctgtagatgatgggattgagaaaggcagagataatattgtagaacagagccagtttcttgtcccgctctggggaggcattggcccctgggttcatgtacataaacatggcaggtccacagaacatggtgaccacagtgatgtgggaggcacaggtggagaaggccttgagtcgaccctgagctgagcggatcttcaagattgtggcaaagatgcggacataagaagccagaatgaaggagaggggaaccaggagaaggatgaagcccaggataaaatctacttggtcattgagggatgtgtctgcacaggccagcttcagaacagcagggacctcacagaagaagtgattgatctcattggggccacagtagggcaggcgcattgtgaagacagtgtagactagggaacagctgataccccacagtccacaaaagatggccattgccccacacagccatggggtcatgataaccttgtatctgagtggataacagatggccacatatctatcataggccataacagagaacagccagccctcagtgatgcccaacaccagaaagatgtacatctgggccacacacccaacataggagatagttttcttctggcagatcagatgcaccaacatctgaggcacagtagtggtgacatagctcatgtccagaatggagaggacactgaggaagaagtacatgggtgtgtggaggcgggagtccaagtgaatcaaggtgacaatgagtccattgcccacaagtgtagagaggtagagaaagaggaagatgttgaagaggattgtattaatttgggaatccctggagaagcccagaaggatgaattcagacacagagctgtggttgtcccagggaaagttctgcat

SEQ ID NO: 2800 - protein, 316 aa, Felis catus
  MOD_RES (316)..(316): Any amino acid
MQNFPWDNHSSVSEFILLGFSRDSQINTILFNIFLFLYLSTLVGNGLIVTLIHLDSRLHTPMYFFLSVLSILDMSYVTTTVPQMLVHLICQKKTISYVGCVAQMYIFLVLGITEGWLFSVMAYDRYVAICYPLRYKVIMTPWLCGAMAIFCGLWGISCSLVYTVFTMRLPYCGPNEINHFFCEVPAVLKLACADTSLNDQVDFILGFILLLVPLSFILASYVRIFATILKIRSAQGRLKAFSTCASHITVVTMFCGPAMFMYMNPGANASPERDKKLALFYNIISAFLNPIIYSLRNKDVKRAFLKLTGSRKASEX

SEQ ID NO: 2801 - DNA, 933 bp, Felis catus
ggccctgccccagcctgtcaccttgaggaaagccctctgtatgtccttgttccggaggctatagatgatggggttgaggaaagcagagataacattgtagaacagggccaacttcttgtcctcttccagggaagcctcagagccaggcttcatgtacatgaccatggctggcacacagaacatagtgaccacagtgatgtgggaggcacaagtggagaaggccttcagtcgcccctgggctgaacggatcctcaagatggcaatgaagatgttggcataaatgacaagaatgagggagagtgggaccaggatgacagtaaagccaagaatgaagtctactcggtcattgactgaggtgtctgcgcaagccagctttaagactgcaggaacttcacagaagaagtggttgatcttgttggagccacagtatggcagacgcatggcaaaaacagtgtagataagagcagaaatgacaccccagagtccacagaaaataaccattactccacataaccatgggctcatgatgaccttgtacctgagtgggtggcagatggccacatacctgtctatagacataatggcaaagagccacgactccatgatgcctaacaccaagaaaatgtacatttgggccacacagctggcaaaagagatggtcttcttctggctggctagatgtgccaacatctgaggcacagttgtagtggtatagcccacatccaatatggaaaggatgccaataaagaagtacatgggtgtgtggaggtgtgaatccaggcagatgaggatggtgattaagccatttcccagaataatcagcaggtaggtgatcaggaaggctgagaagagcagaggagtggtgctggggttgaaggagaagcccagaaggatgaattcagccacaaaggactggttagtctcctgcatcat

SEQ ID NO: 2802 - protein, 311 aa, Felis catus
MMQETNQSFVAEFILLGFSFNPSTTPLLFSAFLITYLLIILGNGLITILICLDSHLHTPMYFFIGILSILDVGYTTTTVPQMLAHLASQKKTISFASCVAQMYIFLVLGIMESWLFAIMSIDRYVAICHPLRYKVIMSPWLCGVMVIFCGLWGVISALIYTVFAMRLPYCGSNKINHFFCEVPAVLKLACADTSVNDRVDFILGFTVILVPLSLILVIYANIFIAILRIRSAQGRLKAFSTCASHITVVTMFCVPAMVMYMKPGSEASLEEDKKLALFYNVISAFLNPIIYSLRNKDIQRAFLKVTGWGRA

SEQ ID NO: 2803 - DNA, 948 bp, Felis catus
atgcagagcctcggcaaggagaaccacagctttgtatctgagttcatcctccttggcttctccagtgagtcacaggtcagaatagccctgttctccttcttccttctcctctacctcatcattcttctgggcaatggactcatcatcaccctgatctacatggactcacacctccacacacccatgtacttctttctcagcatcctctccttggtggacatgagctatgtcactaccaccatgccccagatgttgattaatatggtgtgtccaaagaaaaccatctcctggggagcttgtgtagcccaaatgttcatcttcttggtcctgggcattgctgagtgtgtgctctatgccattatggcctatgacaggtatgtggccatttgcttcccccttcactatcccttgctcatgggccgctccatttgtatcaagatggtcacaggctgttgggccattagcatagctggggccctgatctacactgtcttcaccatgcgtctgccttattgtggcccctacaagataaaccacttcttttgtgaggtccctgctgtcctaaagttggcctgtgcagacacatccttcaatgaccatttggacttcatcttgggtttcaccctgctcttggttccattctccctcatcctggtctcttatgtctgcatctttgcctccatcttaagaatccactcatcccacgggaggctcaagtctttctccacatgtgcctcccacattactgtggtcattatgttctatgggccagccatgataatgtacatgaggcctggctcctggtatgacccaaagcgggacaagaagctagctctgttctacaatgttgtctctgccttcctcaaccccatcatctacagcctccggaacaaagatgtaaagggggcctttctgaatgtatttggtaacagaagggcatctcagtga

SEQ ID NO: 2804 - protein, 315 aa, Felis catus
MQSLGKENHSFVSEFILLGFSSESQVRIALFSFFLLLYLIILLGNGLIITLIYMDSHLHTPMYFFLSILSLVDMSYVTTTMPQMLINMVCPKKTISWGACVAQMFIFLVLGIAECVLYAIMAYDRYVAICFPLHYPLLMGRSICIKMVTGCWAISIAGALIYTVFTMRLPYCGPYKINHFFCEVPAVLKLACADTSFNDHLDFILGFTLLLVPFSLILVSYVCIFASILRIHSSHGRLKSFSTCASHITVVIMFYGPAMIMYMRPGSWYDPKRDKKLALFYNVVSAFLNPIIYSLRNKDVKGAFLNVFGNRRASQ

SEQ ID NO: 2805 - DNA, 939 bp, Felis catus
atgcaagaactcaaccagtcctctgtgacagaattcattctattgggttttgctcccaaccctaggaccaaccctctgctcttcaccttctttctcaccttttacctgctaatcctcataagcaacagcctcctcatcacccttattcaccaggattctcgtctccacacacccatgtactttttcatcagtgtcctctccacgctggacgtgtgctacacaaccactaccgtgccccagatgcttgtgcatattctcagtgagaagaggaccatctcttttgctagatgtgtggcccagatgtacatcttcctcctctttggggtcactgagtcgtggcttttctctatcatgtctgtggacaggtacgtggccatctgccatcctctccggtataagatcatcatgagccattggatgtgcctcctcatggtgggcatctgtgcagcctatggtgtggtgggtggcctgtgctataccttctttgctatgaatctgccctactgtggccctaatgaaattgaccactacttctgtgaggtccctgctgtcctaaagctggcctgtgcagacacatccctcaatgacttggtggacttcatcacgggcttcaatgtcattgtggtcccactgtccctggttgtcatagtctatgccaatatctttgctaccatcatgaagatccgctcagcccagggacgagtcaaagccttctccacctgtgcctcccacatcactgtggtcaccatgttcgccattccatgcatcattatgtacatgagccctggctctgactctttgtcaaacaatggcaagaaaatggcccttttttataacattgccacggccttcctcaaccctgtcatctacagtctgaggaacaaggacgtgaaaaaggctttcctcaaattgatgggatggagcagggccccacagtga

SEQ ID NO: 2806 - protein, 312 aa, Felis catus
MQELNQSSVTEFILLGFAPNPRTNPLLFTFFLTFYLLILISNSLLITLIHQDSRLHTPMYFFISVLSTLDVCYTTTTVPQMLVHILSEKRTISFARCVAQMYIFLLFGVTESWLFSIMSVDRYVAICHPLRYKIIMSHWMCLLMVGICAAYGVVGGLCYTFFAMNLPYCGPNEIDHYFCEVPAVLKLACADTSLNDLVDFITGFNVIVVPLSLVVIVYANIFATIMKIRSAQGRVKAFSTCASHITVVTMFAIPCIIMYMSPGSDSLSNNGKKMALFYNIATAFLNPVIYSLRNKDVKKAFLKLMGWSRAPQ

SEQ ID NO: 2807 - DNA, 842 bp, Felis catus
ccccagcctgtcactttgaggaaagctctcttcacatctttgttcctaagactatagatgataggattgaggaaggcagagatgatgttgtagaatagagccaacttcttatcttcttctggggaagattcagaaccaggtctcatgtacataaccatacatggtatagagaacatagtgacaacagtaatgtgggaggcacaggtggaaaaggccttgagctgcccttgggctgagcgaattctcaagatggcagcaaaaatattgatatagacaatgatgatgagggagagtgggaccaacagaagaatgaagcccaagatgaagtccacctgatcattgagagatgtgtctgcacaggccaacttcaagactgcaggtacttcacagaagaagtgattgatctcattaggaccacaatagggaaggatcatagtagaggcagtgtatatcagggcacagctgataccccagaatccacagaaggccaccattgacccacatagcaaagggctcataatgactttatacctcaggggatggcaaatggccacatacctgtcataagccatgattgcaaaaagccaagactcagtgattcctagcatcaggaagatgtacatctgcgccacacatccaatgtaggagatggtcttctccttgcaaaccaggtgtaccagcatctggggcactgtggtggtgacatagcccatatccataatggataggacactgaggaaaaagtacatgggtgtgtggaggcgggagtccatgcgtatcaaggtgataataagtccattgcccagaagagtgatgaggtagaggaagaggaagacactgaa

SEQ ID NO: 2808 - protein, 281 aa, Felis catus
FSVFLFLYLITLLGNGLIITLIRMDSRLHTPMYFFLSVLSIMDMGYVTTTVPQMLVHLVCKEKTISYIGCVAQMYIFLMLGITESWLFAIMAYDRYVAICHPLRYKVIMSPLLCGSMVAFCGFWGISCALIYTASTMILPYCGPNEINHFFCEVPAVLKLACADTSLNDQVDFILGFILLLVPLSLIIIVYINIFAAILRIRSAQGQLKAFSTCASHITVVTMFSIPCMVMYMRPGSESSPEEDKKLALFYNIISAFLNPIIYSLRNKDVKRAFLKVTGWG

SEQ ID NO: 2809 - DNA, 954 bp, Felis catus
atggtgatcccaccctgggaaaaccaaacaaccatagcagaatttgtgcttcgaggattttcctccatccgacagctaaatattttcctctttatgatgtttttagttttctacatcttaatcatttctggaaacatcctcattgttctgctagtttttttcagccatcacctccacacccccatgtacttcttcctggtgaacttgtcctttctagagatctggtatacctccaacatcgtccccaagatgttgctgatcatcatagctgagcagaagactatctctgtggctgggtgcctggcacagttctacttctttggatccctggctgcaacggagtgtctcttgcttgctgtgatgtcctatgaccggtatctggccatctgccaacctctccactatcccatcctcatgactggccccctttgcattaagctggcttccagttcttggctctgctgcttcctcctcacagcaattactatggtcctactgtctagactaaccttctgtggacccaatgaaattgatcacttcttctgcgacttcacgcctctggtccatctttcctgcatggacacttcactgaccgagaccattgcttatgccacctcttctgcagtgactctggttccatttctcctcatcacagcctcctactcctgcattcttgttgccatcctaagaattccatctggcacagggcggagaaaggctttctccacctgctcctcccacctcactgtggtcacggtgttttatgggacactgattgccacgtacctcgtgccttcagccaattcttcacagctcttgcgcaaaggattctctctgctctataccatcctgacacccatgttcaaccccatcatctacagcctgagaaacagagacatccacgaagccctgaagatgtgcttgagtaagaagccaagtttcctccttggatga

SEQ ID NO: 2810 - protein, 317 aa, Felis catus
MVIPPWENQTTIAEFVLRGFSSIRQLNIFLFMMFLVFYILIISGNILIVLLVFFSHHLHTPMYFFLVNLSFLEIWYTSNIVPKMLLIIIAEQKTISVAGCLAQFYFFGSLAATECLLLAVMSYDRYLAICQPLHYPILMTGPLCIKLASSSWLCCFLLTAITMVLLSRLTFCGPNEIDHFFCDFTPLVHLSCMDTSLTETIAYATSSAVTLVPFLLITASYSCILVAILRIPSGTGRRKAFSTCSSHLTVVTVFYGTLIATYLVPSANSSQLLRKGFSLLYTILTPMFNPIIYSLRNRDIHEALKMCLSKKPSFLLG

SEQ ID NO: 2811 - DNA, 916 bp, Felis catus
atggaggcaaacaagacgcaggtgacggagtttgttctcacaggactgacagatcgtccagggatgcaggttcccctgttcctggtgttcttggtcatctatctcaccaccatggtgggcaacctcggactgattttcctcatctggaaggaccctcatcttcacactcccatgtacttattccttggcagtttggcctttgcagatgcttgttcctcatcctctgtgactcccaggatgtttgtcagcatcttacacaaaagtcaagtgatatctttgagtgcatggcccagtattatttttttggttccagtgccaccacagagtgtttcctcttggtagtgatggcctatgaccgctacgcagccatatgcaaccccttgctttatccagtggtgatgtccaaccgactctgtaccttgttgataagtgtgtcatatgcgattggttttctgcatcccatcattcatgtgggattattgtttagattaaccttctgcaggtccaatataatacctcatttctactgtgaaattttgtcactatatacaatttcttgcactgacccatctcttaatgcattggtgatttttatttttgctgcttgtatacaagcttttacttttacgaccatcatggtgtcttatacccgtgtcctctttgccatcctgagaaagaagtctgaaaagggcaggagcagagccttctccacgtgcagcgcccacctgctctctgtctctttgttctatggcactctcttcttcatgtatgtgcgtcctgggtctgggccagatcaatatcaggataaaatgtattcattgttctacacggttataatccccctgctaaacccctttatttatagcctaagaaacaaggaagttttaggtgcattgagaaaagtgataaagaaata

SEQ ID NO: 2812 - protein, 305 aa, Felis catus
  MOD_RES (305)..(305): Any amino acid
GGKQDAGDGVCSHRTDRSSRDAGSPVPGVLGHLSHHHGGQPRTDFPHLEGPSSSHSHVLIPWQFGLCRCLFLILCDSQDVCQHLTQKSSDIFECMAQYYFFGSSATTECFLLVVMAYDRYAAICNPLLYPVVMSNRLCTLLISVSYAIGFLHPIIHVGLLFRLTFCRSNIIPHFYCEILSLYTISCTDPSLNALVIFIFAACIQAFTFTTIMVSYTRVLFAILRKKSEKGRSRAFSTCSAHLLSVSLFYGTLFFMYVRPGSGPDQYQDKMYSLFYTVIIPLLNPFIYSLRNKEVLGALRKVIKKX

SEQ ID NO: 2813 - DNA, 924 bp, Felis catus
atggcagaagaaaataagacacaggtgacggagtttgttctcatgggacttacagatcttccagggctgcaggtccccctgttcctggtgttcttgatcatctatctcaccaccatggtgggcaaccttggtctggttgttctcatctggaaggacacccaccttcacaaccccatgtacttattcctcggcagtttggcctttgcagatgcctgtacttcatcctctgtaactcccaggatgcttgtaaattttttatccaagaatcatgcgatatctctttctgactgtctggctcagttttacatttttggttccagtgccaccacagagtgcttcctcctggtagtgatggcctatgaccgctatgtagccatttgcaaccctttgctttatccagtcatgatgtccaataacctctgtactcagttcattggtgtttcatattttattggttttctacattcagcaattcatgtgggtttgttatttagattaactttctgcaggtccaatgaaatacattgtttctactgtgaaattatacaacttttcaaaatttcttgcactgatcctacagttaatacacttctggtgttagtcttttcggccttcgtacaagccttcacttttacgaccatcatggtgtcttatacccgtgtcctctttgccatcctgaaaaagaagtctgaaaagggcaggagcagagccttctccacgtgcagcgcccacctgctctctgtttccttgttctatggcactctcttcttcatgtatgtgcgtcctgggtctggctacactgaagatcatgataaaatttattctttattttacacaataataattcctctgctaaatccttttatttacagcttgaggaacaaagaggttataggtgccttgagaagaataatgaagaaataa

SEQ ID NO: 2814 - protein, 307 aa, Felis catus
MAEENKTQVTEFVLMGLTDLPGLQVPLFLVFLIIYLTTMVGNLGLVVLIWKDTHLHNPMYLFLGSLAFADACTSSSVTPRMLVNFLSKNHAISLSDCLAQFYIFGSSATTECFLLVVMAYDRYVAICNPLLYPVMMSNNLCTQFIGVSYFIGFLHSAIHVGLLFRLTFCRSNEIHCFYCEIIQLFKISCTDPTVNTLLVLVFSAFVQAFTFTTIMVSYTRVLFAILKKKSEKGRSRAFSTCSAHLLSVSLFYGTLFFMYVRPGSGYTEDHDKIYSLFYTIIIPLLNPFIYSLRNKEVIGALRRIMKK

SEQ ID NO: 2815 - DNA, 981 bp, Felis catus
atgactctgtttttcacttattcttccatttcagtgatcaacttgagtgagtctgatggaaacaaaacacaggtgatggagtttgttctcatgggacttacagatcttccagggctgcagatccccctgttcctggtgttcttggtcatctacctcactaccatggtgggcaacctcggactgatttttctcatctggaaggacccccatcttcatacccccatgtacttactccttggcagtttggcctttgcagatgcttgttcctctacctctgtgactcccaagatgctgatgaattttttatccaacaatcacttgatatccctggttgaatgcatcacccaattttatatttttgcttccagtgcaaacactgaatgtttccttctggtagtgatggcctatgatcgctatgtagctatatgtaatcctttgctttatccagtggtgatgtccaatatcttttgcattcggttattaggtgtttcatatattatagggtttcttcatcctatgatgcacaccagtttgttatttagattaactttctgcaagtccaatgtaatacattatttctactgtgaaattttacaactgtttaagatttcctgtactgaccctagagttaatatgctcttaatatttatattttcagtctttatacaatctttcacctttatgactattatcatctcttactcccatgtcctctttgccatcctgaaaaagaggtctgaaaagggcaggagcaaggccttttccacatgcagtgcccacttgctctctgtttctttgttctatggcactctcttcttcatgtatgtgcgtcctgggtctggcccagctgaaaatcaagataaaatgtattctgtattttacacaatcataattcccctgctaaatccttttatttacagtttgagaaacaaagaggttataaatgccttgaggagaataataaaatataaatagttctta

SEQ ID NO: 2816 - protein, 324 aa, Felis catus
MTLFFTYSSISVINLSESDGNKTQVMEFVLMGLTDLPGLQIPLFLVFLVIYLTTMVGNLGLIFLIWKDPHLHTPMYLLLGSLAFADACSSTSVTPKMLMNFLSNNHLISLVECITQFYIFASSANTECFLLVVMAYDRYVAICNPLLYPVVMSNIFCIRLLGVSYIIGFLHPMMHTSLLFRLTFCKSNVIHYFYCEILQLFKISCTDPRVNMLLIFIFSVFIQSFTFMTIIISYSHVLFAILKKRSEKGRSKAFSTCSAHLLSVSLFYGTLFFMYVRPGSGPAENQDKMYSVFYTIIIPLLNPFIYSLRNKEVINALRRIIKYK

SEQ ID NO: 2817 - DNA, 928 bp, Felis catus
atgggaactaaaaatacaacagagctaaaagagtttgttctcatgggacttacatatcaaccagagtggcaaattcctttgttcctggtattcctagttatatatctcatcaccattgtggcaaaccttggtctgatttctctcatatgcaatgagcctcagcttcacatccccatgtactttttccttgggaatctggcatttgtggatgtttggatatcatccacggtgacccccaagatgttggtcaacttctttgccaagggcaagatgatctctctctctgaatgcatgatacaatttttttcctttgtaatgagtgccaccacagaatgttttctgctggcaacaatggcatatgatcgatatgtggccatctgcaagcctttactttatccagtaattatgaccagtagactatccatgcagctattagtttcatcatttgtaggtggacttcttcatgccataattcatacaggctttttattcagattaacgttctgtaattctaacataatacatcacttttactgtgacatcatgccattatttaaaatttcttgtactgatccttctattaatgttctgatagtatttattttttctggatcaattcagatgttcaccattctgactgttcttgtctcttacacatcagttctctttacaatcttaaaaaagaagtctctacaagacataaggaaagccttctccacctgtggaacccatctcttatctgtctgtttgtactatggtcctcttctcttcatgtatgtgcgccctggatctgcacaggcagatgatcaagatatgatggactctctattttacactgtcataattcctgtgttaaatccaattatctatagcttgagaaataagaaagtcatagattcactgagaaaaatgttaaagaggaaagctt

SEQ ID NO: 2818 - protein, 310 aa, Felis catus
  MOD_RES (310)..(310): Any amino acid
MGTKNTTELKEFVLMGLTYQPEWQIPLFLVFLVIYLITIVANLGLISLICNEPQLHIPMYFFLGNLAFVDVWISSTVTPKMLVNFFAKGKMISLSECMIQFFSFVMSATTECFLLATMAYDRYVAICKPLLYPVIMTSRLSMQLLVSSFVGGLLHAIIHTGFLFRLTFCNSNIIHHFYCDIMPLFKISCTDPSINVLIVFIFSGSIQMFTILTVLVSYTSVLFTILKKKSLQDIRKAFSTCGTHLLSVCLYYGPLLFMYVRPGSAQADDQDMMDSLFYTVIIPVLNPIIYSLRNKKVIDSLRKMLKRKAX

SEQ ID NO: 2819 - DNA, 929 bp, Felis catus
atgggaaaggaaaatacaacattgctgacagagttaattctcacaggactcacatatgaaccacagtggcaaatccccctattcctggtgttcttggttatctatcttctcaccattgtggggaaccttggtctgattgctctcatatggaatgaacctcagcttcacatccccatgtactttttccttggaagtttggcatttgtggatgcttggatatcatctacagtgacccccaagatgctggtcaacttctttgccaagagtaagatgatctctctctctgaatgcatggtacaattttttcctttgcaatcagtgcaaccacagaatgttttctgctggcaacaatggcttatgatcgctatgtggccatatgcaaaccattactttacccagtgattatgtccaatacactatgcatccggctgttagttttgtcattttcaggtggccttcttcatgccataattcacaatgctttgttattcagattaaccttctgtgattccatcatagtacatcacttttactgtgacattatgccattgtttaagatttcttgtactgacccttctattaattttctgatggtatttattttctctgggtcaatacaagtattcaccattttgactgttcttgtctcttacacactagttctttttacaatattaaaaaagaagtctctacaaggcataaggaaagctttctccacttgtggagcccatcttttatccgtatctttatactatggcccccttctcttcatgtacgtgcgccctggatctgcacaggcagatgatcaagatatgatggactctctattttatactgtcataattcctgtgttaaatccaattatctatagcctgagaaataagaaagtcatagattcattgagtaaaatgttaaagagaaatgcttag

SEQ ID NO: 2820 - protein, 213 aa, Felis catus
MHGTIFSFAISATTECFLLATMAYDRYVAICKPLLYPVIMSNTLCIRLLVLSFSGGLLHAIIHNALLFRLTFCDSIIVHHFYCDIMPLFKISCTDPSINFLMVFIFSGSIQVFTILTVLVSYTLVLFTILKKKSLQGIRKAFSTCGAHLLSVSLYYGPLLFMYVRPGSAQADDQDMMDSLFYTVIIPVLNPIIYSLRNKKVIDSLSKMLKRNA

SEQ ID NO: 2821 - DNA, 930 bp, Felis catus
atggaaaaagataatgcaacactactgacagagttaattctcacaggactcacatatgaaccacagtggcaaatccccctattcctggtgttcttggttatctatcttctcaccattatggggaaccttggtctgattgccctcatatggaatgaacctcagcttcatatcccgatgtactttttccttggaagtttggcatttgtggatgcttgggtatcatccacagtgacccccaagatgctggtcaacttctttgccaagagcaaaatgatatctcttcctgaatgcatgatacagtttttttccttggcaatcagtataaccacggaatgttttctgctggcaacaatggcttatgatcgatatgtggccatatgcaaaccattactttatccagtgattatgtccaatacactatgcatccagctgttagttttgtcattttcaggtggccttcttcatgccataattcacaatgctttgttattcagattaaccttctgcaattccatcatagtacatcacttttactgtgacattatgccattgtttaagatttcttgtactgacccttctattaattttctgatagtatttatttttgctgggtcaatacagatgttcaccattctgatagttcttgtctcctatacactagttctcttttcaatcttaaaaaagaagtcactacaaggcataagaaaagccttctccacctgtggagcccatctcttatctgtctgtttgtactatggccctcttgtcttaatgtatatgcgccctgtatctgcacaatcagatgatcaagatatgatggactctctattttatactatcataattcctttattaaatccaattatctacagcttgagaaataagaaagtcatagattcatttggaaaaatattaaagagaatttcttag

SEQ ID NO: 2822 - protein, 309 aa, Felis catus
MEKDNATLLTELILTGLTYEPQWQIPLFLVFLVIYLLTIMGNLGLIALIWNEPQLHIPMYFFLGSLAFVDAWVSSTVTPKMLVNFFAKSKMISLPECMIQFFSLAISITTECFLLATMAYDRYVAICKPLLYPVIMSNTLCIQLLVLSFSGGLLHAIIHNALLFRLTFCNSIIVHHFYCDIMPLFKISCTDPSINFLIVFIFAGSIQMFTILIVLVSYTLVLFSILKKKSLQGIRKAFSTCGAHLLSVCLYYGPLVLMYMRPVSAQSDDQDMMDSLFYTIIIPLLNPIIYSLRNKKVIDSFGKILKRIS

SEQ ID NO: 2823 - DNA, 930 bp, Felis catus
atggatactaagaatgcaacaatgttgacaaaatttgttctcacaggaatcacatatcaaccagagtggcaaatccctctgtttctgatgttcttggtgatatacatcatcactattgtgggaaaccttggactaactgctctcatctacaatgacccccaccttcacattcccatgtactttctccttgggagtttagcctttgtggatgcttggatatcatctacagtgaccccaaagatgctggtcaacttcctagccaagagtaagatgataactctttctgaatgtgtgacacaattgttttcctttgcatttggtgccaccacagaatgttttctcttggcaacaatggcatatgatcgctatgtagccatatgcaaaccattactttatccagtaattatgacctatagactttgcatctggctgttagtttcatcatttgtaagtggatttattcattctgtagttcatataggttttttatttagattaaccttttgtaattctaacataatatatcatttttactgtgacatcatgccattgtttaagatttcctgtactgatccttcaattaatattctgatgatttttattttctctgggtcaatacaggtatttaccattctgattgttctggtttcttatacacttattcttttcatgatcttaaaaaagaagtctctgcaaggcataaaaaaagccttctccacctgtggagcccatctcttatctgtttctttatactatggccctcttctattcatgtatgtgcacccaggatccgcacaatcacctgatcaggatatgatggactctctattttacactgtcataattcctttgttaaatccaattatctatagtctaagaaataaaaaagtcatagattcactaagaaaaatgttaaaaagaaatgtttag

SEQ ID NO: 2824 - protein, 309 aa, Felis catus
MDTKNATMLTKFVLTGITYQPEWQIPLFLMFLVIYIITIVGNLGLTALIYNDPHLHIPMYFLLGSLAFVDAWISSTVTPKMLVNFLAKSKMITLSECVTQLFSFAFGATTECFLLATMAYDRYVAICKPLLYPVIMTYRLCIWLLVSSFVSGFIHSVVHIGFLFRLTFCNSNIIYHFYCDIMPLFKISCTDPSINILMIFIFSGSIQVFTILIVLVSYTLILFMILKKKSLQGIKKAFSTCGAHLLSVSLYYGPLLFMYVHPGSAQSPDQDMMDSLFYTVIIPLLNPIIYSLRNKKVIDSLRKMLKRNV

SEQ ID NO: 2825 - DNA, 930 bp, Felis catus
atggctaaggaaaataactctttgacaactgagtttatcctcataggatttacagatcatccagtgctgaatattctcctgtttttggtgttctttgccatctatctaatcaccatggtgggaaatcttggcctggtggcactgatttctatggagcatcgtcttcacacaccaatgtacatctttctgggcaacttggctctaatggattcctgttgttcctgtgccatcatccccaagatgttagagaacttcttttctgagggaaaaatgatttccctttatgaatgcatggcacaattttattttctctgccttgctgaaactgcagactgctttcttctggcagcaatggcttatgattgctatgtggccatttgcagcccactacagtaccataccatgatgtcaaagaaactctgcattcagatgacaatagggaccttcatagctagtaacctgcattccatgatccatgtagggcttctgttaaggttaactttctgcaggtctaatcaaattgaccactttttttgtgatattcttccactctatagactctcctgtactgacccttatatcaacgaactaatgatctatattttttcaatgccaattcaaatcttcaccattgccactgtcttgttctcttatatttgcatccttttcacaatttttaaaatgacatcaaaagaggggcgaggtaaagccttttctacctgtgcatcccactttctatctgtctcaatattctacatttgtcttctcatgtatattagaccatttgaagaaggggataaagacataccagtggcaattttttatacaattgtaattcctttattaaatccttttatttatagcttaagaaataaggaagtgataaatggtcttaaaaaatgtatgaagaattataatattgttaaataa

SEQ ID NO: 2826 - protein, 309 aa, Felis catus
MAKENNSLTTEFILIGFTDHPVLNILLFLVFFAIYLITMVGNLGLVALISMEHRLHTPMYIFLGNLALMDSCCSCAIIPKMLENFFSEGKMISLYECMAQFYFLCLAETADCFLLAAMAYDCYVAICSPLQYHTMMSKKLCIQMTIGTFIASNLHSMIHVGLLLRLTFCRSNQIDHFFCDILPLYRLSCTDPYINELMIYIFSMPIQIFTIATVLFSYICILFTIFKMTSKEGRGKAFSTCASHFLSVSIFYICLLMYIRPFEEGDKDIPVAIFYTIVIPLLNPFIYSLRNKEVINGLKKCMKNYNIVK

SEQ ID NO: 2827 - DNA, 930 bp, Felis catus
atgattgaggataaccactccttgacaactgagtttatcctcataggatttacagattacccagaattgaagagcctactctttgtggtgtttcttactatctatctgatcactatggtggggaaccttggcctggtggcattgatttttacagagtgtcgtcttcacacaccaatgtacatctttctgggcaacctagctctaatggattcctgttgttcttgtgccattaccccaaagatgttagagaacttcttttctaaggacagaatgatttccctttatgaatgcatggcacaattttattttctctgccttgctgaaactgcagactgctttcttctggcagcaatggcttatgatcgctatgtggccatttgcagcccactacagtaccacaccatgatgtcaaagaaactctgcattcagatgaccacaggggcctacatagctggaaacttgcattctgtgattcatatagggtttctctttaggttaactttctgtgggtctcatcaaattaatcactttttttgtgatgttcttccattatacagactctcttgtgttgacccttctatcaatgaattgatgatatttatcttttcagggtcaattcaagtcttctctattatcgtagttctaatctcttatctctgcatcctcttcacgattttcaaaatgaagtccaaagaaggaagaggcaaagctttatctacttgtgcatcccactttctctctgtctcaatattctatggttctcttctttttgtgtacattagaccaaattcagttaaagaagaggataaagatatacctgttgctattttttatactctagtaattcctttattaaacccctttatctatagtctaagaaataaggaagtattaaatgttatgaaaaaaattatgaagaaagttttataa

SEQ ID NO: 2828 - protein, 309 aa, Felis catus
MIEDNHSLTTEFILIGFTDYPELKSLLFVVFLTIYLITMVGNLGLVALIFTECRLHTPMYIFLGNLALMDSCCSCAITPKMLENFFSKDRMISLYECMAQFYFLCLAETADCFLLAAMAYDRYVAICSPLQYHTMMSKKLCIQMTTGAYIAGNLHSVIHIGFLFRLTFCGSHQINHFFCDVLPLYRLSCVDPSINELMIFIFSGSIQVFSIIVVLISYLCILFTIFKMKSKEGRGKALSTCASHFLSVSIFYGSLLFVYIRPNSVKEEDKDIPVAIFYTLVIPLLNPFIYSLRNKEVLNVMKKIMKKVL

SEQ ID NO: 2829 - DNA, 971 bp, Felis catus
atggctgaagaaaatcataccatgaaaagtgagtttatcctgacaggatttacagatcacccagaattgaagacgcttcttttcttggtgttccttgtcatctatctgatcaccatggtagggaaccttggcctggtgatattgatttcaaaagagcctcatcttcacatgccaatgtacatctttctgggcaacctcgctcttgtggattcttgctgtgcctgtgccattactcctaagatgttagggaacttcttttctgagaacagaatgatttctctctatgaatgcatggcacaattttattttctttgcaccgttgaaactgcagactgctttcttctggcagcaatggcctatgaccgctatgtggccatatgtagcccactacagtaccacaccatgatgtcaaagaaactctgcattcagatgaccacaggagccttcatagctggaaatctacattccatgattcatgtagggcttctatttaggttagctttctgtggatctaatcacatcaaccacttttactgtgatattcttcctttatacagactctcctgtgttgacccttatgtcaatgagctggtactatttatcttttcagggtcaattcaagtcttcaccataagcagtgtcttaatatcttacctgtacattctctttactattttcaaaatgaaatccaaagaaggaaggaccaaagccttttctacttgtgcatcccactttttgtctgtttcattattctatggatctctttttttcatgtacattagaccaaatttgctcgaagagggggataaagatataccagctgctattctgtttacaattgtagttcccttactaaatccttttatttatagcctgaggaataaggaagtaataactgtcctgagaaaaattatgaagaaaaaaaaaaatctcatgaaaattggaaacaaatgacatctactgtagcttag

SEQ ID NO: 2830 - protein, 317 aa, Felis catus
MAEENHTMKSEFILTGFTDHPELKTLLFLVFLVIYLITMVGNLGLVILISKEPHLHMPMYIFLGNLALVDSCCACAITPKMLGNFFSENRMISLYECMAQFYFLCTVETADCFLLAAMAYDRYVAICSPLQYHTMMSKKLCIQMTTGAFIAGNLHSMIHVGLLFRLAFCGSNHINHFYCDILPLYRLSCVDPYVNELVLFIFSGSIQVFTISSVLISYLYILFTIFKMKSKEGRTKAFSTCASHFLSVSLFYGSLFFMYIRPNLLEEGDKDIPAAILFTIVVPLLNPFIYSLRNKEVITVLRKIMKKKKNLMKIGNK

SEQ ID NO: 2831 - DNA, 883 bp, Felis catus
tctttatgccctctgtactaacactcattgggattcctggactacagtcagtccagtgctggattgggattccattctgtgtcatgtatgtcatcgctgtgactgggaattccctaatcttgggtatcatcagatatgaacgcagcctccataagcccatgtacatatttttggccatgctgggggccacagacattgcacttagcacctgtattcttcccaaaatgttaggcatcttctggtttcatttgccagagatttcctttgcagcctgcctgctacaaatgtggcttatccattcgttccaggcaatcgaatcaggcatcctactggcaatggccctagatcgctatgtggccatctgtgaccccttgagacacaccaccatcttctcccagcaactcttgactcacattggagttggggtgacactccgggctgccattcttataggaccatccattatgctcatcaaatgtcgtctgaaactctaccgaactacggtcatctctcactcttactgtgagcacatggccgttgtgaagctagctattgaagatgtccagatcaacaagatatatggtctatttgttgccttcagtatcttaggttttgacataatcttcatcaccttgtcttatgttcaaatctttctcactgtgtttcaattgccccagaaggaggcacgattcaaggcctttaatacctgcattgcccacatctgtgtcttcctccagttctacctccttgctttcttctctttcttcacacatcggtttggttctcacataccaccatatgttcatatcctcctatcaaacctttacctgttagtcccaccttttctcaaccccattgtctatggtgtgaagaccaaacaaat

SEQ ID NO: 2832 - protein, 294 aa, Felis catus
  MOD_RES (294)..(294): Any amino acid
FMPSVLTLIGIPGLQSVQCWIGIPFCVMYVIAVTGNSLILGIIRYERSLHKPMYIFLAMLGATDIALSTCILPKMLGIFWFHLPEISFAACLLQMWLIHSFQAIESGILLAMALDRYVAICDPLRHTTIFSQQLLTHIGVGVTLRAAILIGPSIMLIKCRLKLYRTTVISHSYCEHMAVVKLAIEDVQINKIYGLFVAFSILGFDIIFITLSYVQIFLTVFQLPQKEARFKAFNTCIAHICVFLQFYLLAFFSFFTHRFGSHIPPYVHILLSNLYLLVPPFLNPIVYGVKTKQX

SEQ ID NO: 2833 - DNA, 920 bp, Felis catus
tttccaaaggattttttcagagccctctttatgtctctgttcctcaggctgtagatgaaggggttcagcatgggcgtgaccaccgtgtacatcaccgaggccgtggcacccgagtaggagctctgggtagcagtggagctaaggtacacacctaggcttgtacagtaaaataagaagaccacagaaaggtgggatgcacaggtggaaaatgctttatacttgccctgagttgatgagatcccacatatggaagaaactatcttagaataagagtaaacgatcccagcaagggggcccccacccagcaacccagctccaaaatacatcaccatgtcattaagaaaggtgtcagaacaggcaagttggaccacctgtttaatttcacagaagaagtgagggatttccaagtctgtacagaaggacagtcgcagcaccactgaggtttgtaacaaggaatgcaggacactcatgatccaagacaccagagccagcagcccacagagccgggggttcatgacgaccgtgtagtgcagggggtgacagatggccaaaaatcggtcataggccatcacggtcaggatgtagttgtccaatcctgcgaagagtaggaaaaaatacatctgggtgatgcagtcctcataggttatgactttgctctgggtctggatgttccagagcatctttgggacggtggtggaggtgaagcaaatgtctacaaaggacaggttggccaggaagaagtacatgggcgtgtggaggtgggagtcagagctgatggccaggatgatgagcagattcccaaacacagtgatcaggtacatggagaggaaaagcccaaatatgaggggctggaatgctggttcctctgaaaatcccagaagaagaaattctgaaatggctgtaaggttccttggctccat

SEQ ID NO: 2834 - protein, 307 aa, Felis catus
  MOD_RES (307)..(307): Any amino acid
MEPRNLTAISEFLLLGFSEEPAFQPLIFGLFLSMYLITVFGNLLIILAISSDSHLHTPMYFFLANLSFVDICFTSTTVPKMLWNIQTQSKVITYEDCITQMYFFLLFAGLDNYILTVMAYDRFLAICHPLHYTVVMNPRLCGLLALVSWIMSVLHSLLQTSVVLRLSFCTDLEIPHFFCEIKQVVQLACSDTFLNDMVMYFGAGLLGGGPLAGIVYSYSKIVSSICGISSTQGKYKAFSTCASHLSVVFLFYCTSLGVYLSSTATQSSYSGATASVMYTVVTPMLNPFIYSLRNRDIKRALKKSFGX

SEQ ID NO: 2835 - DNA, 1111 bp, Felis catus
ttaagaggtgatgactgacttgtttccagcaacccttttggaaactggtacaatgcaggctataccagccccactaagcttcacaccagagtccctcttatttctgtcgaacaacctcccgacccacagtcttttcatggcatttttcacctctgtgtttctcagggtgtagatcagagggtttaacatgggtgtgatgatggtgtaaaacacagccaccatcttgtcctcagtaaaagtggtggaaggccttaggtagatgaagaggcaggggacaaagaacaagatcaccactgtgatgtgggaagcacacgtagacagggccttgcgcctcccctctgacgagcgggtcttaaaggaaagcaagatgacaatgtaagagcccataagaatgacaaagcagctcagtgaaatcatgccactgttagctatcacaatgagccccaccatgtatgtctctgtgcaagccagcttcagtaaagggtggacatcacagaagtagtggtcaatcaggttggggccacagaacggcagttgtacagtgaggatggtctggatgaaggaatgcacaaaccctcctaaccaacaggttaccaccagtatagagcagaccttccggtccatgatggtcatatagcgcagaggcttacagatagccacgtacctgtcataggccatcactgtgagaataaagatctctgtgcagccaaacagatgggagaaaaagagctggaccatacaaccaacaaaggagatgctcttgactttagcttgggaatcaataatcagcttgggggctgtaacagaggagtagcagatgtcgacaaaggataggaagctgaggaagaagtacattggagagttgagattgggactcctttgaatagtcattataatgagaaaatttccagtcatgagtgtcatgtaaaagagtaagaacagaaagaagcatagttgctgcactttctcattttgggaaagacccatgaagataaattctgtaacattattttccatggaaactaggaagctcacaagagggaaatacagtgtgactttacctataggaaaaaagtatgaaacacaattagatttgggcacatggtaccat

SEQ ID NO: 2836 - protein, 338 aa, Felis catus
MENNVTEFIFMGLSQNEKVQQLCFFLFLLFYMTLMTGNFLIIMTIQRSPNLNSPMYFFLSFLSFVDICYSSVTAPKLIIDSQAKVKSISFVGCMVQLFFSHLFGCTEIFILTVMAYDRYVAICKPLRYMTIMDRKVCSILVVTCWLGGFVHSFIQTILTVQLPFCGPNLIDHYFCDVHPLLKLACTETYMVGLIVIANSGMISLSCFVILMGSYIVILLSFKTRSSEGRRKALSTCASHITVVILFFVPCLFIYLRPSTTFTEDKMVAVFYTIITPMLNPLIYTLRNTEVKNAMKRLWVGRLFDRNKRDSGVKLSGAGIACIVPVSKRVAGNKSVITS

SEQ ID NO: 2837 - DNA, 927 bp, Felis catus
atggccattacaaataatgtgactgagttaattttcactggcctgtttcaggatccagaggttcagagagcatgctttgtggtgtttcttcctgtgtacctggccacagtggtgggcaatggtctcattgttctgacagtcaatgtcagtaagagtctgtgttcccccatgtacttcttccttagctacttgtccctggtggagatcgcttactcctctactgttgtccctaaattcatcacagacttacttgccaagattaaaaccatctctctggagggctgtgtggctcagatattcttcttccacttctttggggtcactgagatccttttgcttgtggtgatggcctatgaccgctatgtggccatctgcaagcctcttcagtatatgaacattatgagccgccaactatgtcatgtactggtggctggctcctggcttgggggctttttccactccattatacagattctcattaccgtccagttgcccttctgtggtcccaatgtgattgaccactacttctgtgatcttcagccattattcaagcttgcctgcactgacacctttgtggagggggttattgtgttggccaacagtggcttaattgctctgtgctccttcctcattttggtgtcctcctatattatcatccttgtcaacttgaggaaccattctgcagaggggaggcgcaaagccctctctacctgtgcctctcacatcacagtggtcctcttgttctttggacctgccatcttcctctacatgcgaccctcctccaccttcactgaggacaaactggtggccgtgttctacacagttgtcacccccatgctgaaccccatcatctacacactcagaaatgcagaggtgaaaattgccatgaggaggttgtggggcaaaaagaacttagggatggaataa

SEQ ID NO: 2838 - protein, 308 aa, Felis catus
MAITNNVTELIFTGLFQDPEVQRACFVVFLPVYLATVVGNGLIVLTVNVSKSLCSPMYFFLSYLSLVEIAYSSTVVPKFITDLLAKIKTISLEGCVAQIFFFHFFGVTEILLLVVMAYDRYVAICKPLQYMNIMSRQLCHVLVAGSWLGGFFHSIIQILITVQLPFCGPNVIDHYFCDLQPLFKLACTDTFVEGVIVLANSGLIALCSFLILVSSYIIILVNLRNHSAEGRRKALSTCASHITVVLLFFGPAIFLYMRPSSTFTEDKLVAVFYTVVTPMLNPIIYTLRNAEVKIAMRRLWGKKNLGME

SEQ ID NO: 2839 - DNA, 930 bp, Felis catus
atggcgagtacaaataacgtgaccaagttaattatcgtcggtcttttccaggatccagaggtgcagagagggtgctttgtggtgtttcttctggtgtacttggccacagtggtgggcaatggtctcattgttctgacagtcaatgtcagtaagagtctgcgttcccccatgtacttcttccttagctacttgtccctggtggagatcacttactcctccactgttgtccctaaattcatcacagacttacttgccaagattaaaaccatctccctggagggctgtgtggctcagatattcttcttccacttctttggagttactgagatcttcctgctgacggtaatggcctatgaccgctacgtggccatttgcaaaccccttcactacacaactatcatgagccggtctgtgtgtcgccttctggtggctggatcctggctcgggggcttttttcattccatggtccagattattatcactctccagttgtctttctgtggtcccaatgtgattgaccactacttctgtgacctccatccgttattcaagctttcctgcactgacacttctgtggagggggttattgtgttggccaacagtggattattttctatcttctccttcctcctcctggtgtcctcctatattgtcatcctgtacaacctgaggaaccattctgcagaggggaggcgcaaagccctctccacctgtgcctctcacatcactgtggtcctcttgttctttggacctgccatcttcctctacatgcggcctccctctactttcactgaggacaaactggtggccgtgttctacacagttgtcacccccatgctgaaccccatcatctacacactcaggaatgcagaggtgaaaaatgccatgaggaagctgtgggggaagagaatgaattcagggagggactaa

SEQ ID NO: 2840 - protein, 309 aa, Felis catus
MASTNNVTKLIIVGLFQDPEVQRGCFVVFLLVYLATVVGNGLIVLTVNVSKSLRSPMYFFLSYLSLVEITYSSTVVPKFITDLLAKIKTISLEGCVAQIFFFHFFGVTEIFLLTVMAYDRYVAICKPLHYTTIMSRSVCRLLVAGSWLGGFFHSMVQIIITLQLSFCGPNVIDHYFCDLHPLFKLSCTDTSVEGVIVLANSGLFSIFSFLLLVSSYIVILYNLRNHSAEGRRKALSTCASHITVVLLFFGPAIFLYMRPPSTFTEDKLVAVFYTVVTPMLNPIIYTLRNAEVKNAMRKLWGKRMNSGRD

SEQ ID NO: 2841 - DNA, 919 bp, Felis catus
acacaatgtgactgaattcattttcctaggactttctcccagccgggaggcgcagaaagtttgttttgtgctatttctgcttttgtacacagcagttgtgctggggaactccctcattgtgctcactgtcatgaccagcagaagtcttggttctcccatgtacttcttcctcagctgcctctcctttgtggagatctgctactcctctactacagcccccaaactcatctcagatttgctggctgaaaggaaagcaatatcactgtggggctgcatgacacagcttttctttatgcacttctttggtggtgctgagatcttcctgctcactgtgatggcctatgaccgctatgtggccatctgtaggcccctcaactacaggactatcatgaaccggcaagtgtgtgctgtcctggtgggagtagcatgggtggggggctttgtgcattcctttgcccaaatcctcctgctcttccacttgcccttctgtggccccaatgtgattgaccactatttctgtgacctgcttcccctgctcaaacttgcctgctctgacaccttcctcgtcggtctgctgattgttgccaacggggggaccttgtctgtgatcagctttgggatcatcttagcctcctatgtggtcattttactccatctgaggactcgaagctctgaggggcggagtaaggccctctccacctgtgggtcccacatcaccgtggttaccttattctttgggccctgcatcttcatctatatgaggccttccaccaccttgtctgtagacaagatggtggccgtgttctacaccgtcatcacgccgctcctcaaccctgtcatctactccctgagaaatgctcaagtgaagaaggccatgaagaaactgtggatcaggacaatgaagctagatgagaaatag

SEQ ID NO: 2842 - protein, 305 aa, Felis catus
HNVTEFIFLGLSPSREAQKVCFVLFLLLYTAVVLGNSLIVLTVMTSRSLGSPMYFFLSCLSFVEICYSSTTAPKLISDLLAERKAISLWGCMTQLFFMHFFGGAEIFLLTVMAYDRYVAICRPLNYRTIMNRQVCAVLVGVAWVGGFVHSFAQILLLFHLPFCGPNVIDHYFCDLLPLLKLACSDTFLVGLLIVANGGTLSVISFGIILASYVVILLHLRTRSSEGRSKALSTCGSHITVVTLFFGPCIFIYMRPSTTLSVDKMVAVFYTVITPLLNPVIYSLRNAQVKKAMKKLWIRTMKLDEK

SEQ ID NO: 2843 - DNA, 934 bp, Felis catus
atggcaactacgaacaatgtgactgaactcattctcttggggttctcccccaatcgggatgtgcagaagaccatttctgtgatgtttctcctcatgtacacggccattgtgctggggaacggcctcattgtggtgacaatcatgggcagcaaagggctcacctcccccatgtatttcttcctcggctacttgtcctttgtggagatctgttactgctctgtcacagcccccaagctcatccttgactcttttattgaaaggaaaatcatttccctcaaaggctgcatcacacagatctttttcctccatttctttggtggcactgagatctttctcctgacagtgatggcctatgaccgctatgtggccatctgcaagcccctgcactacactgtcatcatgaaccggcgtgcttgtggcctcctggtgggggcagcttggggtgggggcttgctgcattctgtcgggcaaacattccttatttcccagctgcccttctgtggccccaaggtccttgaccactacttctgtgatgtccaccctgtgctgaagctggcctgctcagacaccttcctcactggtgtgctaatcatcgccaatggtggctccatttcagtgatcagcttcacggtactgcttgcttcctacgtggtcatcctgcacgccctgagcacccagacctcagaaggtcggcgcaaagctctgtccacctgtgcctctcatgttgcagttgtgggcctgttcttcataccctgttcctttgtctacatgaggccctgtgtcaccctccctgcagacaagatagtcgctgtgttttacacagtggtcacacctctcttaaaccccatcatttactccttcaggaatgctgaagtgaaaaatgccatgaggagactgatagggaggaaagtgatctgggaagagaaatagatga

SEQ ID NO: 2844 - protein, 309 aa, Felis catus
MATTNNVTELILLGFSPNRDVQKTISVMFLLMYTAIVLGNGLIVVTIMGSKGLTSPMYFFLGYLSFVEICYCSVTAPKLILDSFIERKIISLKGCITQIFFLHFFGGTEIFLLTVMAYDRYVAICKPLHYTVIMNRRACGLLVGAAWGGGLLHSVGQTFLISQLPFCGPKVLDHYFCDVHPVLKLACSDTFLTGVLIIANGGSISVISFTVLLASYVVILHALSTQTSEGRRKALSTCASHVAVVGLFFIPCSFVYMRPCVTLPADKIVAVFYTVVTPLLNPIIYSFRNAEVKNAMRRLIGRKVIWEEK

SEQ ID NO: 2845 - DNA, 930 bp, Felis catus
atgggaaccaagaacaacgtgactgaatttgtgttgttcggccttttccagagcagggagatgcagtatgtgtgcttcgtggtcttctccctcttccatgtactcactatcctggggaaccttctggtcatcatcaccatcaatgcaagcaagaccctgaaggctcccatgtatttcttcctcagccacctctcttttgccgacatgtgctatccatctgctaccacacccaagatgatcgcagacacttttgtggagcgaaagaccatctccttcaatggctgcatgacccagctcttttctgcccacttcttcggtggcactgagatattcctcctcacagccatggcctatgaccgctatgtggccatctgtagacccctgcactacacaaccatcatgggtcagtggaagtgtggcttgctggccggggcctcctgggtggctggcttcctgcattccatcctacagacactcctgacagtccagctgcccttttgtgggcccaatgagattgacaacttcttctgtgatgttcatcccttgctgaagctggcctgtgcagacacctatgtggtggggctcattgtggtggccaacagtggcatgatctctttggtgtcctttatcatccttatcatctcctatgtggtcatcttgttgaacctgagacgccagtcatctgagggccggcgcaaggctctgtccacatgtggctcacacatcatcacggtcattttggtcctcgtgccccccatgttcatgtacattcgtccctccaccaccctggctgctgacaaacttgtcatcctctttaacatcgtcatgccacctttgctgaaccctctgatctacacgttgaggaataatgaggtgaaaaatgccatgaggaaactgtttagggtacaagggagtacaggggagaagtga

SEQ ID NO: 2846 - protein, 309 aa, Felis catus
MGTKNNVTEFVLFGLFQSREMQYVCFVVFSLFHVLTILGNLLVIITINASKTLKAPMYFFLSHLSFADMCYPSATTPKMIADTFVERKTISFNGCMTQLFSAHFFGGTEIFLLTAMAYDRYVAICRPLHYTTIMGQWKCGLLAGASWVAGFLHSILQTLLTVQLPFCGPNEIDNFFCDVHPLLKLACADTYVVGLIVVANSGMISLVSFIILIISYVVILLNLRRQSSEGRRKALSTCGSHIITVILVLVPPMFMYIRPSTTLAADKLVILFNIVMPPLLNPLIYTLRNNEVKNAMRKLFRVQGSTGEK

SEQ ID NO: 2847 - DNA, 930 bp, Felis catus
atggcgagtacaaataatgtgaccgagttaattatcgtcggtcttttccaggatccagaagtgcagagggcatgctttgtgatgtttcttcctgtgtacctggcgacagtggtgggcaatggtctcattgttctgacagtcaatgtcagtaagagtctgcgttcccccatgtacttcttccttagctacttgtccctggtggagatcacttactcctccactgttgtccctaaattcatcacagacttacttgccaagattaaaaccatctccctggagggctgtgtggctcagatattcttcttccacttctttggagttactgagatcttcctgctgacggtaatggcctatgaccgctttgtggccatttgcaaacctcttcgctataccaccatcatgagccagtttgtgtgtcgtcttctggtggctgtttcctggctcgggggcataattcactccatggtccagatcgttgttactgttcagctgccgttctgtggtcccaatgtgattgaccactacttctgtgacctccatccgttattcaagcttgcctgcactgacacttctgtggagggggttattgtgttggccaacagtggattaatctccgtcttctccttcctcatcttggtgtcctcctatattgtcatcctgtacaacctgaggaaccattctgcagaggggaggcgcaaagccctctccacctgtgcctctcacatcacagtggtcctcttgttgtttggacctgccatcttcctctacatgcgaccctcctccaccttcactgaggacaaactggtggccgtgttctacacagttgtcacccccatgctgaaccccatcatctacacactcagaaatgcagaggtgaaaaatgccatgaggaagctgtgggagaagaaagtgaactcagaagtaggataa

SEQ ID NO: 2848 - protein, 309 aa, Felis catus
MASTNNVTELIIVGLFQDPEVQRACFVMFLPVYLATVVGNGLIVLTVNVSKSLRSPMYFFLSYLSLVEITYSSTVVPKFITDLLAKIKTISLEGCVAQIFFFHFFGVTEIFLLTVMAYDRFVAICKPLRYTTIMSQFVCRLLVAVSWLGGIIHSMVQIVVTVQLPFCGPNVIDHYFCDLHPLFKLACTDTSVEGVIVLANSGLISVFSFLILVSSYIVILYNLRNHSAEGRRKALSTCASHITVVLLLFGPAIFLYMRPSSTFTEDKLVAVFYTVVTPMLNPIIYTLRNAEVKNAMRKLWEKKVNSEVG

SEQ ID NO: 2849 - DNA, 909 bp, Felis catus
atggatagtccacgaaacatcacggaatttttcatgctgggactctcgcaaaactctgaagtgcagagagttttgtttgtgttctttttgattgtctaccttgtctctgttgggggcaacctacttatcatgatcaccattatcttcagtcccaccttgggctcccctatgtactttttcctctcatgtttgtcctttattgatacttgctattcctcatgtatgacccccaaactcattgcagactccttgtatgaggggagaaccatctcttttgagggctgtctgattcaattctttgttgcccatttactgggaggaactgaaatcattctgctcacggtcatggcctatgaccgctacgtggccatctgcaagcctctgcactacacgaccaccatgaccaagcatctctgtgccctgctggtgggggtggcttggctggggggcttcctgcattcactggttcagctcctcctggtccttcagctgcccttctgtgggcctaacgtgatcaatcactttgtctgcgacctgtaccccttgctggagctcgcctgcaccgacacatatgtcattggcatcctggtggtggccaacagtggtgtgatctgcctgttgaacttcctcatgctggctgcctcctacattgtcatcctgcattccttgaggtgccatggtgccgaggggaggcgcaaagccctctccacctgtggggcccacttcactgttgttgccctgttctttgtgccttgtatatttatttacatgcggccatcgtctactttgtccgtggacaaaatagtggctgtgttttattgtattttgacacccatgttcaaccccctgatttatacactgagaaacgcagaggtgaaaaatgccatgaaaaacctatggaaaaaatga

SEQ ID NO: 2850 - protein, 302 aa, Felis catus
MDSPRNITEFFMLGLSQNSEVQRVLFVFFLIVYLVSVGGNLLIMITIIFSPTLGSPMYFFLSCLSFIDTCYSSCMTPKLIADSLYEGRTISFEGCLIQFFVAHLLGGTEIILLTVMAYDRYVAICKPLHYTTTMTKHLCALLVGVAWLGGFLHSLVQLLLVLQLPFCGPNVINHFVCDLYPLLELACTDTYVIGILVVANSGVICLLNFLMLAASYIVILHSLRCHGAEGRRKALSTCGAHFTVVALFFVPCIFIYMRPSSTLSVDKIVAVFYCILTPMFNPLIYTLRNAEVKNAMKNLWKK

SEQ ID NO: 2851 - DNA, 909 bp, Felis catus
atggaaatgccacacaatatcacagagtttttcatgctgggactctcacagaagccagagatacagagagtcctctttgtggtttttttgatcatctatgtggtcaccgtgtgtggcaacatgctcattgtggtcaccattacctccagtcccaccctggcttcccccatgtattttttcttggccaatctgtcctttattgatacctgttattcttcctctatggcccctaaactcattgcggactccttgtgtgaggggagagccatctcttttgagggttgcatggctcagctctttggggcccatttcttgggaggtgttgagattattctgctcacggtcatggcctatgaccgctacgtggccatctgtaagcctctgcactacacgaccaccatgaccaagcatctctgtgccctgctggtgggggtggcttggctggggggcttcctgcattcactggttcagctcctcctggtccttcagctgcccttctgtgggcctaacgtgatcaatcactttgtctgcgacctgtaccccttgctggagctcgcctgcactgacacatatgtcattggcatcctggtggtggccaacagtggtgtgatctgcctgttgaacttcctcatgctggctgcctcctacattgtcatcctgcattccttgaggtgtcacggtgccgaggggaggcgcaaagccctctccacctgtggggcccacttcactgttgttgccctgttctttgtgccttgtatatttacttatatgcggccatcgtctacttggtccatggacaaaaacatggcagtattttatggtattctgacacctatgctgaatccactcatttacaccctgagaaatgaagacgtaaaaaatgccatgagaaagctcttcattcagtaa

SEQ ID NO: 2852 - protein, 302 aa, Felis catus
MEMPHNITEFFMLGLSQKPEIQRVLFVVFLIIYVVTVCGNMLIVVTITSSPTLASPMYFFLANLSFIDTCYSSSMAPKLIADSLCEGRAISFEGCMAQLFGAHFLGGVEIILLTVMAYDRYVAICKPLHYTTTMTKHLCALLVGVAWLGGFLHSLVQLLLVLQLPFCGPNVINHFVCDLYPLLELACTDTYVIGILVVANSGVICLLNFLMLAASYIVILHSLRCHGAEGRRKALSTCGAHFTVVALFFVPCIFTYMRPSSTWSMDKNMAVFYGILTPMLNPLIYTLRNEDVKNAMRKLFIQ

SEQ ID NO: 2853 - DNA, 1001 bp, Felis catus
ctagtcacatgaattgttacccaaggttaccgtatggctccagagtttcctcatggcgttttttacctccgaatttctgagggtgtagattaaggggtttaacataggtgttatcatagtgtaaaacacagccgctgttttgtcaatggggaaggtgatcgtgggccgcaggtacacaaatatacagggtacaaagaacaggacgactacagtaacatgggaggcacaggtggagagagccttacgctgtccttcagggctgtgggttctcagggagtaaaggatgaggaggtaggaggtgagaagaatagaaaaaatgagcagacacatcagcccgctgttggcggcaacaagaagtccatagatgtgggtgtcagagcaggagagtttcagcagagggaaaaggtcacagatgaaatggtcaatgacgttggggccacagaagggcaaccagactataaaaagaatttgaatcagagcgtgaagaaatcccccggcccaggccgtggccaccaggaggccacacgctcgcctgttcattgtgatcgtgtagtgcaggggcttgcagatggccacgtagcggtcataagccatgactgtgagcaggatgatctcgactcccccaaagaaatgctctgcaaagagctgagtcatgcacccaccggaggagatggttttcttttcggcgagtaagtcaaatatcattttgggagccatggcagaagagcagcagctgtctatgaaggacaagaaagacagaaaaaaatacatgggggagcccagggctcggctggtggtgattgtcacgacaatgagtaggttgcctgccatggtgagaaagtagatgactataaacacagcgaacaagagtttctgtgcgtctgggttctgtgtcaggccaagcaggatgaattccgtcacgttgttcattcgcccccgtgaatctacgtcggcgtctggacgattgatctgtctgtaaatagcacagggactgcaattgt

SEQ ID NO: 2854 - protein, 309 aa, Felis catus
MNNVTEFILLGLTQNPDAQKLLFAVFIVIYFLTMAGNLLIVVTITTSRALGSPMYFFLSFLSFIDSCCSSAMAPKMIFDLLAEKKTISSGGCMTQLFAEHFFGGVEIILLTVMAYDRYVAICKPLHYTITMNRRACGLLVATAWAGGFLHALIQILFIVWLPFCGPNVIDHFICDLFPLLKLSCSDTHIYGLLVAANSGLMCLLIFSILLTSYLLILYSLRTHSPEGQRKALSTCASHVTVVVLFFVPCIFVYLRPTITFPIDKTAAVFYTMITPMLNPLIYTLRNSEVKNAMRKLWSHTVTLGNNSCD

SEQ ID NO: 2855 - DNA, 930 bp, Felis catus
atggagaataaaagaaatgtgactgagtttattttaataggtcttacacagaaccccaagatgcagaatatagtgtttctgggatttttgattctatacatggtaacactctcaggcaacctgctcattgtggttaccattaccaccacccagactctgaactcccccatgtatttcttcctgactcatctttccttgatagacacaatttattcttcttcttcagctcctaagctgattgtggactcccttcacgagaagaaaattatctcctttaatgggtgtatggctcaggtttatgcagaacacatttttggtgctactgagatcatcctgctcacagtaatggcctatgatcgctatgtggccatctgcagacctctgcactatgcgactgtcatgagccacaggctgtgctttcttctgctgggagtggcctggactggaggatttctccatgcgaccattcagatactctttacagtctggctgcccttctgtggtcccaatgtcatagatcatttcatgtgtgatttgtaccctttattgaaacttgtctgcatggacactcacacccttggtctctttgttgctgtcaacagtgggttcatctgtcttttaaacttcctcctcttggtggtctcctacgtagtcattctatggtccctaaagagctatagcttggaagggaggcgcaaagccctttccacctgtgtctctcacatcacagtagttgtcttattttttgtgccctgtatatttgtgtatctgcgcccagtgaccactctgcccattgataaagctgttgctatcttttatactatggtggttccaatgttaaatcccttaatctataccctcagaaatgctgaggtaaaaaatgctatgaggaagctctggagaaaaaaagtgacttcagataatgattaa

SEQ ID NO: 2856 - protein, 309 aa, Felis catus
MENKRNVTEFILIGLTQNPKMQNIVFLGFLILYMVTLSGNLLIVVTITTTQTLNSPMYFFLTHLSLIDTIYSSSSAPKLIVDSLHEKKIISFNGCMAQVYAEHIFGATEIILLTVMAYDRYVAICRPLHYATVMSHRLCFLLLGVAWTGGFLHATIQILFTVWLPFCGPNVIDHFMCDLYPLLKLVCMDTHTLGLFVAVNSGFICLLNFLLLVVSYVVILWSLKSYSLEGRRKALSTCVSHITVVVLFFVPCIFVYLRPVTTLPIDKAVAIFYTMVVPMLNPLIYTLRNAEVKNAMRKLWRKKVTSDND

SEQ ID NO: 2857 - DNA, 930 bp, Felis catus
ttatttctcccctgaaatagctttcctgcggcacaatttactaatggcatttttcatctgggcatttctcaaagtatagattagcgggtttagcatgggagttataatagtgtagaacactgccactgctttatcaatagataaagtagctgcaggcctcatatacacaaatatgcagggcacaaagaataagacgaccaccgtgatgtgggaggcacaggtggagagggctttgcgccttgcctccaagctgtggttccttagggagcgcagaatgaccacataggagaccatcaagaggaggaagtttaacagacagatgaatccactgttggcagcaacgaagaggcctagagtgtgggtatcagtgcaggcaagattgagcaaagggttcagatcacacataaagtggtctatgacgttagggccacagaagggtaattggaagatgaagagtatctgtatagttgcgtgaagaaagcctcccacccacaccactcccattaacaggccacacacccgccgattcatgatggtcatgtagtgcaatggcttgcagatggccacatagcggtcataggccatcacagtaagcaggatgccttcagcacctccaaagaaatgttctccaaatatttgagtcatgcatccattgtatagggtagtcttctttttatggagggaatctatgatcagtttaggagtattaacagaggaatagcaggcatcaataaaggagaggtaggccaggaaaaagtacatgggagaccccaacaatgggctggcagtgatagtgaccacaatgagcatattacctactacagtgatggtgtagatgacaaaaaacacgacaaatataattttttgcatctttggattctctgtgagtcccagtagaacaaactctgtcacattgttcctcttctccat

SEQ ID NO: 2858 - protein, 309 aa, Felis catus
MEKRNNVTEFVLLGLTENPKMQKIIFVVFFVIYTITVVGNMLIVVTITASPLLGSPMYFFLAYLSFIDACYSSVNTPKLIIDSLHKKKTTLYNGCMTQIFGEHFFGGAEGILLTVMAYDRYVAICKPLHYMTIMNRRVCGLLMGVVWVGGFLHATIQILFIFQLPFCGPNVIDHFMCDLNPLLNLACTDTHTLGLFVAANSGFICLLNFLLLMVSYVVILRSLRNHSLEARRKALSTCASHITVVVLFFVPCIFVYMRPAATLSIDKAVAVFYTIITPMLNPLIYTLRNAQMKNAISKLCRRKAISGEK

SEQ ID NO: 2859 - DNA, 928 bp, Felis catus
gtcacttgtcacctaaactgaactgatgaagaagatgaacaatgtgacagaattcatcctcctgggcttgactcaaaacgtggaacttcagaaattctccttttttgtgtttttaattgtctacttggtcactttggcgggcaacttgctcatcatgatcaccatcagtaccagtagtgccctcgaaacccccatgtacttcttcctgtcttacttggcccttatagatggctgttgttcttcctccatgacccctaaaatgctcgctgacactcttactgtgagaaaaatcatctcttttacaggatgtatgactcaagtctttgctgaacatttttttggtgctgctgagattatccttctcacagtaatggcctatgaccgttatgtggccatctgcaaacccttgcattacacaaccatcatgagtcaccaggtgtgtggcctccttgtaggagtggcctgggctggagcctttgtccatgcaaccattcagatcctcttcacagtctggctgcctttctgtggccccaatgtcatagatcatttcatgtgtgatttgtaccctttattgaaacttgtctgcatggacactcatacccttggtctctttgttgctgccaatagtgggttcatctgtttgttaaacttccttcttttggtggtttcctatgtggtcatcttgctctccctaaagacctatagcttggaggggagacgcaaagccctctctacctgcgtctctcacatcaccgtggtcattttcttctttgtgccctgcttatttgtatatctgcgcccagtgatcaccttttccattgataaagctgtggctgtgttttataccatgataactcctatgttaaaccctttaatctatacgttgagaaattcagaggtgaaaagtgccataaagaagctccggatc

SEQ ID NO: 2860 - protein, 301 aa, Felis catus
MKKMNNVTEFILLGLTQNVELQKFSFFVFLIVYLVTLAGNLLIMITISTSSALETPMYFFLSYLALIDGCCSSSMTPKMLADTLTVRKIISFTGCMTQVFAEHFFGAAEIILLTVMAYDRYVAICKPLHYTTIMSHQVCGLLVGVAWAGAFVHATIQILFTVWLPFCGPNVIDHFMCDLYPLLKLVCMDTHTLGLFVAANSGFICLLNFLLLVVSYVVILLSLKTYSLEGRRKALSTCVSHITVVIFFFVPCLFVYLRPVITFSIDKAVAVFYTMITPMLNPLIYTLRNSEVKSAIKKLRI

SEQ ID NO: 2861 - DNA, 932 bp, Felis catus
aagtaaatggaaccaaagaacaatgtgactgactttgtcctcttgggcctcacacagaatccaaaggaacagaaagtactttttgttatgttcttgctcttctatattttgaccatggtgggcaacctgctcattgtcttgactgtttcttttagtaagaccctggactcacctatgtactttttcttgctagcttatcatttatggatgtcatttattcctcatctatttctcctgaactgatttcaaatttgttctttggggaaaataccatatccttccatgcttgtatgacccagctatttacagagcacttttttggtggatcagaggtctttcttctgctggtgatggcctatgaccgctatgtggccatctgtaagcccttgcattatttgattgtcatgaggcaatgggtgtgtgttgtgctcctggtagggtcctgggttgggggttttatgcattcagtaattcaacttagcactatttatgggctcccattctgcggtcccaatgtcattgatcattttttctgtgacatgtacccattactgaaactggtctgtactgacacccgtgtcattggcctgttagtggcggccaacggaggactgatctgcacaattgtgtttgtgctcttgctcatctcttatggtgtcatcttgcactctctaaagaaccttagtccggaagggaggcggaaagccctccagacctgtggttcccacatcactgtggtggtcttcttctttgtgccctgtattttcatgtacgtgagacctgctaagaccttccctattgacaaatcattgagtgtgttttatacagtcataacccccatgctgaaccccctgatctacactctgagaaattctgagatgacaaatgctatgaagaaactctggaggagaaatttcacatattgtagtaaa

SEQ ID NO: 2862 - protein, 243 aa, Felis catus
MDVIYSSSISPELISNLFFGENTISFHACMTQLFTEHFFGGSEVFLLLVMAYDRYVAICKPLHYLIVMRQWVCVVLLVGSWVGGFMHSVIQLSTIYGLPFCGPNVIDHFFCDMYPLLKLVCTDTRVIGLLVAANGGLICTIVFVLLLISYGVILHSLKNLSPEGRRKALQTCGSHITVVVFFFVPCIFMYVRPAKTFPIDKSLSVFYTVITPMLNPLIYTLRNSEMTNAMKKLWRRNFTYCSK

SEQ ID NO: 2863 - DNA, 938 bp, Felis catus
atgcagactagatggaaacaaggagcaatgtcacttactttgtcctcttgggtctcacacaggatccaaagggacagaaggtccttttggttatgttcttacacttctatattttgaccatggtgggcaatttgctcattgtcatgactataactgtcagtaggaccctggactcacctatgtacttttttcttgctagcttatcgtttatggatgtcatttattcctctactatttcccctagattgatttcagacttgttgtttgggaaaaacaccatatcctttcaatcttgtatgacccagctgtttacagagcacttttttggtggatcagaggtctttcttctgctggtgatggcctatgaccgctacgtggccatctgtaagcccttgcattatttggttatcatgagacagtgggtgtgtgttgtgctcctggtagggtcctgggttggaggttttctgcattcagccattcaagttagcactatttatagactcccattctgtggtcccaatgtcattgatcattttttgtgtgacatgtaccccttactgaaactggtctgtactgacacccatgttattggcctgttagtggtggccaacggaggactgatctgcacaattgtgtttgtgctcttgctcatctcttatggtgtcatcttgcactctctaaagaaccttagtccggaagggaagcggaaagccctccagacctgtggttcccacatcactgtggtggtcttcttctttgtgccatgtattttcatgtacgtgagacctgctaagaccttccctattgacaaatcattgagtgtgttctatacagtcataacccccatgctgaaccccctgatctacactctgagaaattctgagatgacaaatgctatgaggaagctctggaagagaaatatatctcttagtagataa

SEQ ID NO: 2864 - protein, 308 aa, Felis catus
METRSNVTYFVLLGLTQDPKGQKVLLVMFLHFYILTMVGNLLIVMTITVSRTLDSPMYFFLASLSFMDVIYSSTISPRLISDLLFGKNTISFQSCMTQLFTEHFFGGSEVFLLLVMAYDRYVAICKPLHYLVIMRQWVCVVLLVGSWVGGFLHSAIQVSTIYRLPFCGPNVIDHFLCDMYPLLKLVCTDTHVIGLLVVANGGLICTIVFVLLLISYGVILHSLKNLSPEGKRKALQTCGSHITVVVFFFVPCIFMYVRPAKTFPIDKSLSVFYTVITPMLNPLIYTLRNSEMTNAMRKLWKRNISLSR

SEQ ID NO: 2865 - DNA, 695 bp, Felis catus
cttgggtactgcttccgttttccgcctgcgtgacttatcccttctagaagtctgctgttcttcctccatgacccgtaaaatgctgcctggcacttttgctgtaagaaaaccatctctctgaggaagtacatgacttaagtctttgctgagcatccatgtggccatctgcaaaccccggtaccatgacatcatgaagagtgacagggatatggcttcctctttcaggtggcatgtgctagagactttgtcccagcagccattcaggtcctcttcacagtgtggctgtgtgtgtgtggccccaatgtcagagaccatttgtgtgtgatgtaaatccgtttttgaaagttgtctgcatggaaccaatcatacccttggtctctttgttgctgtcgacagtgggttcattgacctgttaacattttcttcttgatggtctcataggtggtcatcttctactattctctgaggacctatatctttgaggggagacgcaaagcagtgtccaactgtgtctctcacaccactgtggtgttcttagtattgtgtctgcatgtttatatatttgtaaccaatcaccaccttctccactgatcaagttgtggctatgttgtataccacagtgactccattgttaacttcttaaacctgagcaatcaggaatctggaggtaaaaaaatgccatgaggaagttctgg

SEQ ID NO: 2866 - protein, 105 aa, Felis catus
MVSDIGATHTQPHCEEDLNGCWDKVSSTCHLKEEAISLSLFMMSWYRGLQMATWMLSKDLSHVLPQRDGFLTAKVPGSILRVMEEEQQTSRRDKSRRRKTEAVPK

SEQ ID NO: 2867 - DNA, 924 bp, Felis catus
tttactacttgatgtgacatttttcctccagagcttcctcatagcattcgtcatctcagaatttctcagagtgtagatcagggggttcagcatgggggtaagactgtataaaacacactcactgatttgtcaatggggaaggtcttagcaggtctcacgtacatgaaaatacatggcacaaagaagaagaccaccacagtgatgtgggaaccacaggtctggagggctttccgcctcccttccggactaaggttctttagagagtgcaagatgacaccataagagatgagcaagagcacaaacgcaattgtgcagatcagtccttcatcgcccaccactaacaggccaatgatatgggcgtcagtacagaccagtttcagtaaggggtacatgtcacacaaaaaatgatcagtgaattgggaccacagaatgggagcccataaatagtgctaacttgaattactgaatgcagaaaacctccaacccaggaccctaccagcagcacaacacacaccctttgcctcatgatacacaaataatgcaggggtttacacatggccacatagaggtcataaacatcaccaagagaagaatgatctctgatccaccaaaaagctgctctgtaaacagctgggtcatacagtgttgaaatgacctggtattttccccacatatcaaatctgaaatcaatctgagggaaatagaagaggagtaaatgacatccataaaaggtaagttagcaagaaacaagtacataggtgagttcagggtcttactgacagttacagtcgccaaaatgaggaggttgcccaccacagtgaaaatatagaagagtgagaacacaaccaaaaggaccttctgttcctttggatcctgtgtgagacccaagaggataaaataagtgacattgctccttggttccat

SEQ ID NO: 2868 - protein, 133 aa, Felis catus
MEPRSNVTYFILLGLTQDPKEQKVLLVVFSLFYIFTVVGNLLILATVTVSKTLNSPMYLFLANLPFMDVIYSSSISLRLISDLICGENTRSFQHCMTQLFTEQLFGGSEIILLLVMFMTSMWPCVNPCIICVS

SEQ ID NO: 2869 - DNA, 918 bp, Felis catus
atggaatcaaagaacaacgtaactttctttgtcctcctgggcctcacacaggatggaaaagaacagaagtttctgtttgttatattcttgctcttctatattttgacggtggtgggcaacctgctcattgtggtgactatagctgtcagtaagaccctgggctcccctatgtacttgtttcttgctaacttatcctttatggatgtcacttattcgtcttgcatttcccccagattgatttcggacttgttctttggggaaaataccatatccttccaatcttgtatgacccagctatttacagagcaccttttcggtggatcagaggtcattcttctgctggtgatggcttatgaccgctatgtggccatctgtaagcccttgcgttatttggttgtcatgaggcaagaggtgtgtgttgtgctgctggtagggtcctgggttggaggttttctgcattcagccattcaagttagcacgatttatagtctcccattctgtggtcccaatgtcattgatcatttcatctgtgaaatgtaccccttactgagacttgcctgtactgacacatatgtcattggcctgttagtggtggccaacggagggatgatgtgcacaattgtgtttgtgctcttgctcatctcttacggtgtcatcttgcactctctaaagaaccttagtccggaagggaggcggaaagccctccagacctgtggttcccacatcactgtggtggtcttcttctttgtgccatgtattttcatgtacgtgagacctgctaagaccttccccattgacaaatcagtgagtgtgttttttacagttataacccctatgctgaaccccctgatctatactctgagaaattctgagatgacaaatgcgatgaagaagctctggatgagaaatgtcgtatct

SEQ ID NO: 2870 - protein, 306 aa, Felis catus
MESKNNVTFFVLLGLTQDGKEQKFLFVIFLLFYILTVVGNLLIVVTIAVSKTLGSPMYLFLANLSFMDVTYSSCISPRLISDLFFGENTISFQSCMTQLFTEHLFGGSEVILLLVMAYDRYVAICKPLRYLVVMRQEVCVVLLVGSWVGGFLHSAIQVSTIYSLPFCGPNVIDHFICEMYPLLRLACTDTYVIGLLVVANGGMMCTIVFVLLLISYGVILHSLKNLSPEGRRKALQTCGSHITVVVFFFVPCIFMYVRPAKTFPIDKSVSVFFTVITPMLNPLIYTLRNSEMTNAMKKLWMRNVVS

SEQ ID NO: 2871 - DNA, 919 bp, Felis catus
atggaacataggatcaatgtgactgagtttgtcctcttggggctcactcagagcctccaaggtcagaaaatattatttgttgtgttcttgctcatctacattgtgacaatggtgggcaacctcctcattgtggtgaccgtggtggtcagtccaacactggattcccctatgtatttctttcttggttacttatcttttatggatgctgtgtattctactacagtcactccaaatatgattatagacttactctgtgagaagaaaaccatttccttccaagcttgcatgtcccagctctttctagggcacttgtttggtggtgcagagattttactcctggtggccatggcctatgaccgctatgtggccatctgcaaacccttgcattatttgaccatcatgaatcaacgggtgtgtgttttgttgctgctgctggcctgggttggaggttttttgcatgctcttgttcaccttgtctttgtttacgaccttcccttctgtggtcccaatgtcattgaccacttcatctgcgacatgtacccattattaaaacttgcctgcactgacacttacattattggcctcactgtggttgccaatgatggggcaatctgtgtggtcatctttacggtcttgctcatctcctatggggtcattctgcactctctgaagaaccttagtcaggaagggaggcgcaaagccttatccacctgtggctcccacattacagtggtggtcctcttctttgtcccctgcatcttcatgtatgtgagacctccttctacattacccattgataaatccttgactgtattttacacagttatcactcctatgttgaaccccttaatctatactctgagaaatggagagatgaaaaatgccatggaagaagctctggaccagaagaagaaaatga

SEQ ID NO: 2872 - protein, 307 aa, Felis catus
  MOD_RES (307)..(307): Any amino acid
MEHRINVTEFVLLGLTQSLQGQKILFVVFLLIYIVTMVGNLLIVVTVVVSPTLDSPMYFFLGYLSFMDAVYSTTVTPNMIIDLLCEKKTISFQACMSQLFLGHLFGGAEILLLVAMAYDRYVAICKPLHYLTIMNQRVCVLLLLLAWVGGFLHALVHLVFVYDLPFCGPNVIDHFICDMYPLLKLACTDTYIIGLTVVANDGAICVVIFTVLLISYGVILHSLKNLSQEGRRKALSTCGSHITVVVLFFVPCIFMYVRPPSTLPIDKSLTVFYTVITPMLNPLIYTLRNGEMKNAMEEALDQKKKMX

SEQ ID NO: 2873 - DNA, 940 bp, Felis catus
tgcagattagatggaagcaagaaacaatgtaacttactttgtcctcttgggtctcacacaggatccaaaggaacagaaggtcctttttgttatgttcttgcttttctatattttcaccatggtgggaaatttgctcattgtcatgactgtaactgtcagtaagaccctgggctcgcctatgtacttgtttcttgctaacttatcatttatggatgtcacttattcgtcttgcatttccccaagattgatttcggacttgttctttggggaaaacaccatatccttccaatcttgtatgacccaactatttgtagagcacttttttggtggatcagaggtttttcttctgctggtgatggcctatgaccgctatgtggccatttgtaagcccttgcattatttggttatcatgagacagtgggtgtgtgttgtgctcctggtagggtcctgggttgggggttttatgcattcagtaattcaagttagcactatttatgggctcccattctgtggccctaatatcattgatcatttttcctgtgatatgtaccccttactgaaactggtctgtactgacacccatgtcattggcctgttagtggcggccaacggaggactgatttgcacaattgtgtttgtgctcttgctcatctcttatggtgtcatcttgcactctctaaagaaccttagtccagaagggaggcagaaagccctccagacctgtggtgcccacatcactgtggtggtcttcttcttcgtcccgtgtattttcatgtacatgagacctgccaagaccttccccgttgacaagttattgagtgtgttttatacagtcataacccccatgctgaaccccctgatctacactctgagaaattctgagatgacgaatgctatgaagaaactctggaggagaaatgttatatctttcagtagataa

SEQ ID NO: 2874 - protein, 309 aa, Felis catus
MEARNNVTYFVLLGLTQDPKEQKVLFVMFLLFYIFTMVGNLLIVMTVTVSKTLGSPMYLFLANLSFMDVTYSSCISPRLISDLFFGENTISFQSCMTQLFVEHFFGGSEVFLLLVMAYDRYVAICKPLHYLVIMRQWVCVVLLVGSWVGGFMHSVIQVSTIYGLPFCGPNIIDHFSCDMYPLLKLVCTDTHVIGLLVAANGGLICTIVFVLLLISYGVILHSLKNLSPEGRQKALQTCGAHITVVVFFFVPCIFMYMRPAKTFPVDKLLSVFYTVITPMLNPLIYTLRNSEMTNAMKKLWRRNVISFSR

SEQ ID NO: 2875 - DNA, 939 bp, Felis catus
atgggaaatagtaacaatgtgacagaatttgtcctccttggcctcacccgggatcctgaagggcaaaaagcattatttgtcatgattttactgacctacattgtgacaataatgagcaacctgctcattgtggtgactgtttttggcagcccctctctgggctcccccatgtacttcttcctcacctatctgtcactcatggatgttgtttattccactgtcatctctcccaaattgattatagacttactctgtgacaaaaagacaatttccttcccagcttgcatgggccagctcttcctagaacacttgtttgggggttctgaggtcttcctcctgattgtgatggcctatgatcgctatgtggccatctgtaggccgctgcattacttgactatcatgaatcgacaggtttgcattctgctgttggtggtggcctgggttggaggtcttatgcactctatggttcaacttctctttgtgtacagcctcccgttttgtggccccaatgtcattgatcacttcatctgtgacatgtacccattactggaacttgcctgcactgacacctacttaataggcctcactattgttgccaatggtggagccatctgcatggtcatctttatccttctgctcatctcgtatggagtcattctaaattctcttaaaagtcacagtccagaagggaggcgcaaagccctgtccacctgcagttcccacaccacagtggttgtcctcttttttgttccctgcattttcatgtatgttagacctgtttccaacttgtccattgataaatccataactctggtttatacagttatcactcccatgttaaatccgttaatatacaccttgagaaattcggagatgaaaaatgctatggaaaaattctggtgtaaaaatgtaaccaaaagtaaaataagcatgtgtcac

SEQ ID NO: 2876 - protein, 313 aa, Felis catus
MGNSNNVTEFVLLGLTRDPEGQKALFVMILLTYIVTIMSNLLIVVTVFGSPSLGSPMYFFLTYLSLMDVVYSTVISPKLIIDLLCDKKTISFPACMGQLFLEHLFGGSEVFLLIVMAYDRYVAICRPLHYLTIMNRQVCILLLVVAWVGGLMHSMVQLLFVYSLPFCGPNVIDHFICDMYPLLELACTDTYLIGLTIVANGGAICMVIFILLLISYGVILNSLKSHSPEGRRKALSTCSSHTTVVVLFFVPCIFMYVRPVSNLSIDKSITLVYTVITPMLNPLIYTLRNSEMKNAMEKFWCKNVTKSKISMCH

SEQ ID NO: 2877 - DNA, 954 bp, Felis catus
atggaaaatagaaacaatgtgacagagtttgtcctcctggggctcacacaggactctgaggggcaaaaagttctttttgtcccattcttactcatctatattgtgacaatagtgggcaatctgcttatcatggtgaccatcatggccagtccgtcactgggttctcccatgtactttttcctggcttatttatcatttatagatgctatctattctactgtcattgctcccaagatgattgtagacttgctctatgagaagaagactatttccttccaggcttgcatgactcaagtctttctggatcacttatttgctggtgctgaagtcattcttctggtggtgatggcctatgaccgatatgtagccatctgtaaaccacttcattatctaatcatcatgaataggagggtatgtgttcttatgctgctggtggcctggactggaggctttctgcactcgttggttcagttcatctttatttatcagctccctttctgtggccccaatgtcattgacaacttcttgtgtgatatgtatcccttattgaaacttgcttgcaccaatacctccctcattgggatttctatgatagctaatggaggagccattttcactgtcatcttcttcattctcctagtttcctatgcagtcatattacgctctcttaagactaatggtttggaagagaaacgcaaagccttctacacctgtgcatcccatataactgtggtcattttattctttgttccctgtatcttcctgtatgcaagggctaattctacctttcctattgataaattcatgactgtggttttaacattcataacccccatgctgaaccctttaatctataccctgagaaataaagaaataaaaaatgccatgaggaagctttggagtaaaaatctgacctttgctggaggaaggttgtactgctcgtgcagaacatga

SEQ ID NO: 2878 - protein, 317 aa, Felis catus
MENRNNVTEFVLLGLTQDSEGQKVLFVPFLLIYIVTIVGNLLIMVTIMASPSLGSPMYFFLAYLSFIDAIYSTVIAPKMIVDLLYEKKTISFQACMTQVFLDHLFAGAEVILLVVMAYDRYVAICKPLHYLIIMNRRVCVLMLLVAWTGGFLHSLVQFIFIYQLPFCGPNVIDNFLCDMYPLLKLACTNTSLIGISMIANGGAIFTVIFFILLVSYAVILRSLKTNGLEEKRKAFYTCASHITVVILFFVPCIFLYARANSTFPIDKFMTVVLTFITPMLNPLIYTLRNKEIKNAMRKLWSKNLTFAGGRLYCSCRT

SEQ ID NO: 2879 - DNA, 930 bp, Felis catus
aaagaagacaggatgaatgtgaccgaattcattctaatgggacttacccagaatcctcagatgcagagaattctatttttggtgttacttatcatctacattgtcactgtcacaggcaacctgctcattgtggtcactataatctgcagccagactttggactccccaatgtatttcttcctggcattcttgtctttgatagatgcatgctattcctcctccatagtccctaaaatgttagctgatctgctctctgattcaaaatcggtttctttcagtggctgcatgacacagctctttgtagaacatttcttaggagcttcagagattgtcctccttgtggtcatggcctatgaccgctatgtggccatctgtagacccctgcactacatgaccatcatgaaccaccacacatgtcgcctctttgtgggggtgtgttgggcagtgggttttctccactccattggacagattctagttactttctggctcccattctgtggtcccaacgtcatggatcacttcatgtgtgacattttccccctgttacaacttgcctgtactgacactttccttgtcggcctcttggttgttgccaatggtggagtaatttctgtgatcacctttgtgatgttattggtatcctatgtggtcatcctgtgctccctgaagactcacagctctgcagggaggaaaaaggccctctctacctgtggctcccacatcacagttgttgttttgttcttcgtgccctgtatttttatgtatctgagaccagtagctacttttcccatggataaagtcctaacattattctttgctcttattactcccatgttaaaccctgtcatctacacagtaaggaatacagaagtaaaaaatgccattagaatgttattaaacagcaatgccatttcagaaaataaatga

SEQ ID NO: 2880 - protein, 305 aa, Felis catus
MNVTEFILMGLTQNPQMQRILFLVLLIIYIVTVTGNLLIVVTIICSQTLDSPMYFFLAFLSLIDACYSSSIVPKMLADLLSDSKSVSFSGCMTQLFVEHFLGASEIVLLVVMAYDRYVAICRPLHYMTIMNHHTCRLFVGVCWAVGFLHSIGQILVTFWLPFCGPNVMDHFMCDIFPLLQLACTDTFLVGLLVVANGGVISVITFVMLLVSYVVILCSLKTHSSAGRKKALSTCGSHITVVVLFFVPCIFMYLRPVATFPMDKVLTLFFALITPMLNPVIYTVRNTEVKNAIRMLLNSNAISENK

SEQ ID NO: 2881 - DNA, 917 bp, Felis catus
atggatagcctcacacctccgaacaatgtgactgaattttttctcttgggactcacgcagaatccacgcttgcagaaaatactcttcgtggtctttttgttcatttttctatttactgtgcttgccaatctgctcgttgtcatcaccatctccctcagccccacactttccgctcccatgtatttctttcttacttacttgtcttttatagatgcctcctacacctctgtgaccacccccaaaatgatcatcgacctgctgtatcagaggagaaccatctccttgggtggctgcctgactcagctctttgtggagcacttcctgggaggatcagagatcatcctccttattgtcatggcctatgatcgctacgtggccatctgcaagcccctgcactacacaaccatcatgcgacaggggctctgccgcctcctgctggtggtggcctggctaggggggatcctgcatgccgctgtgcagacgcttttcatggtcagcttgcccttctgtggtcccaacgtcattgaccacttcatgtgcgatctcttccctctgctgaaacttgcctgcagcgacacctacaggttgggaatggtggtggcggccaacagtggggccatgtgcttgctcattttttccatgctactcgtctcgtacatagccattctgaggtccctgaattcccacggcgccgaaggacgacacaaagccctctcaacatgtggctcccactttgccgtagttgtacttttttttgtgccttgcatattcacctacatgcgtcctgtggtcacctaccctgtggataagctggtgaccgtgttctttgccgtcctcactcccatgttaaatcctatcatttatacagtgagaaacacagaggtgaaaaatgccatgaggagtctgtggaagaagag

SEQ ID NO: 2882 - protein, 306 aa, Felis catus
  MOD_RES (306)..(306): Any amino acid
MDSLTPPNNVTEFFLLGLTQNPRLQKILFVVFLFIFLFTVLANLLVVITISLSPTLSAPMYFFLTYLSFIDASYTSVTTPKMIIDLLYQRRTISLGGCLTQLFVEHFLGGSEIILLIVMAYDRYVAICKPLHYTTIMRQGLCRLLLVVAWLGGILHAAVQTLFMVSLPFCGPNVIDHFMCDLFPLLKLACSDTYRLGMVVAANSGAMCLLIFSMLLVSYIAILRSLNSHGAEGRHKALSTCGSHFAVVVLFFVPCIFTYMRPVVTYPVDKLVTVFFAVLTPMLNPIIYTVRNTEVKNAMRSLWKKX

SEQ ID NO: 2883 - DNA, 901 bp, Felis catus
atggagaatccaaacaatgcgactgaattcattcttttgggcatcacagagaacccagagctgcggaaaacgctctctgctgtgtttctaatcctgtacgtgtccacggttttggggaacctactcatggtggtaaccgtgatcacaagtcagagcctgaggtcacctatgtattttttcctcacttccttgtccctcatggacgccacctactgttctgtcattgcccccaagatgatcgtggactccttctccgagagaactaccatctcctttgaaggctgcatgacccaactctttgcggagcatttctttggtggtgtgggggtcatccttctcgtcgtgatggcctatgaccgctacgtggccatctgtaagcccctgcactacccgagcatcatgaaccctcaggtgtgccgcctgctgctgggaggcgcctgcgtgggggggtttatccacgcagcgatacagcttctcttcatgtatcaaatacccttctgtggtcccaatgtcatcgatcacttcatgtgtgatttgttcccattgctgaaactcgcctgcatggacacccacaccctgggtctcttagtcatcctcaacagtggggtgatgtgtgtgaccatcttccttatcctcgtggcctcctacgtggtcatcctctgctccctgaagtcttgcagctctgcggggcggcgcaaagccctgtcgacctgtggctcccacctcactgtggtcgtcttgttcttcgtgccctgcattttcctgtacgtgcggcctgtggccacttaccccatagacaaagcaatggctgtgtcctttaccattgttgcacccatgttaaaccccctgatctacaccttgaggaatgcagaggtgaaaaatgccatgaggaaattgtggg

SEQ ID NO: 2884 - protein, 301 aa, Felis catus
  MOD_RES (301)..(301): Any amino acid
MENPNNATEFILLGITENPELRKTLSAVFLILYVSTVLGNLLMVVTVITSQSLRSPMYFFLTSLSLMDATYCSVIAPKMIVDSFSERTTISFEGCMTQLFAEHFFGGVGVILLVVMAYDRYVAICKPLHYPSIMNPQVCRLLLGGACVGGFIHAAIQLLFMYQIPFCGPNVIDHFMCDLFPLLKLACMDTHTLGLLVILNSGVMCVTIFLILVASYVVILCSLKSCSSAGRRKALSTCGSHLTVVVLFFVPCIFLYVRPVATYPIDKAMAVSFTIVAPMLNPLIYTLRNAEVKNAMRKLWX

SEQ ID NO: 2885 - DNA, 936 bp, Felis catus
atgcgaaaccaaagctttgtaactgagttcgtcctcctggggctttcgcagaatcccagtgttcagaaaatagtatttgttgtattcttgttcagctacattgcaactgtcgggggcaacttgctaattgtggtgaccgtcagcagcagcccagcactcctgggctcccccatgtacttcttcttggctttcctgtccttcctcgatgcttgcttctccactgtcattgccccaaagatgattgtggactccctctatgagaggaaaaccatctcctttggaggttgcatgacccagctctttgctgaacacttctttgctggggtggaagtgattgtcctcacagccatggcctacgaccgctatgtggccatctgcaagcccctacgctacacaaccattatgaactggaggctctgtaccattctgatgggtgtagcctggacagggggttttctgcattccatgatacaaattctctttactttccagcttcccttctgcggccccaatgtcattgatcacttcatgtgtgatttgtacccgttattggagcttgcctgcactgacactcacatctttggccttttggtggttgccaatagtgggtctatctgcattataatcttctctctgttactcgtctcctatgttgtcatcttgctctctctgagaacccatagtcctgaagggcagcggaaagccctctccacgtgcggatctcacattgctattgtggtcttgttctttgtcccttgcatatttgtgtatgcacgacctccatctgctttctcttttgacaaaatggtggctatattttacaccatcctaactcccttgctcaatcctttgatttacactttcaggaacaaggaaatgaaaaatgccataaagaaaatgtggaacagaataatggtggtttgtagtgacaaataa

SEQ ID NO: 2886 - protein, 311 aa, Felis catus
MRNQSFVTEFVLLGLSQNPSVQKIVFVVFLFSYIATVGGNLLIVVTVSSSPALLGSPMYFFLAFLSFLDACFSTVIAPKMIVDSLYERKTISFGGCMTQLFAEHFFAGVEVIVLTAMAYDRYVAICKPLRYTTIMNWRLCTILMGVAWTGGFLHSMIQILFTFQLPFCGPNVIDHFMCDLYPLLELACTDTHIFGLLVVANSGSICIIIFSLLLVSYVVILLSLRTHSPEGQRKALSTCGSHIAIVVLFFVPCIFVYARPPSAFSFDKMVAIFYTILTPLLNPLIYTFRNKEMKNAIKKMWNRIMVVCSDK

SEQ ID NO: 2887 - DNA, 915 bp, Felis catus
atggagtcgaatagcagtgtgaatgagttcgttctctttgggttaacacagaatgttgtaaagggaaaagtagtgtttgtggtcttcttgtttctatacctcgcaacccttttggcaaatttacttattgtgatgaccataagatacagccggacacttgggagccccatgtacttcttccttttctacttatcctttgctgatgcctgcttctcaacaaccactgctcctaggttaatagtagattctgtatctgagaagaaagtcatctcctacaacgagtgcatgacccaggtttttgcagttcacttatttgggtgcatggagatcttggtgcttatcctcatgtcctttgatcgctatgtggccatttgtaagcccctgcgatacactatcatcatgagccggcatgtctgtggtacagtggtgagtctagcctgggtggtgtcttgtatccattcttctgcacagattttcttggctttgaaactacccttctgtggacccaatgttattgatcattatttctgtgatatgccacctttgttgaaactcgcatgcatggacacctatgtaatcaatttactcatagtttttaacagtggggctatctgtatggtgagtttcgtcgtcctgcttctctcttatattttcatcttacattctctgaataaccagagtgcagaaggaagaaagaaagccttctctacgtgcacatcccacatcatcgttgtcatcttattctttgttccatgtatattcacatatactcgccctgtaactacgtttccagtggataagatggtggctgtgttttacactattgggacacccttgctcaaccctctgatttatactctgagaaatgcagaagtgaagaatgcaatgaggaagttatggggcggcaaactctga

SEQ ID NO: 2888 - protein, 304 aa, Felis catus
MESNSSVNEFVLFGLTQNVVKGKVVFVVFLFLYLATLLANLLIVMTIRYSRTLGSPMYFFLFYLSFADACFSTTTAPRLIVDSVSEKKVISYNECMTQVFAVHLFGCMEILVLILMSFDRYVAICKPLRYTIIMSRHVCGTVVSLAWVVSCIHSSAQIFLALKLPFCGPNVIDHYFCDMPPLLKLACMDTYVINLLIVFNSGAICMVSFVVLLLSYIFILHSLNNQSAEGRKKAFSTCTSHIIVVILFFVPCIFTYTRPVTTFPVDKMVAVFYTIGTPLLNPLIYTLRNAEVKNAMRKLWGGKL

SEQ ID NO: 2889 - DNA, 911 bp, Felis catus
cgatgaatagcagtgtgactgaattcattctccttgggctgacacaggatccggtaaagcagaaggcagtattcggggtcttcttgatcttttaccttgcgacactgttggggaactttctcattgtagtgactatcaaaacaagcaggacccttgggactcccatgtacttcttcctattctatctgtcttttgctgacacctgcttctctacaaccacagcccccagattgattgtggatgccctttctcacaagaagaccatttcctacaatgagtgcatgattcaggtctttacattccatttctttgggtgcatggaaatcttggtgctcatcctcatggctttagatcgctatgtggccatttgtaagcccttgcgatacacaaccatcatgaaccggcaagtgtgcagcgttttggtgattctagtgtgggtggcatcttgtatccactctttggcacaaattttcctgactttgagattgcctttctgtggccccaacgtgattgaccactatttctgtgacttgcagcccttgttgaaacttgcctgcatggacacttatgtgacaaatttgctacttgtttctaacagtggaaccatatgcacggtgagtttcataatcctgcttacctcctatgttgtcatcttgtactctctgcgtaaccacagtgctgaaggaaggcgaaaagccctttccacctgcacctcccactttattgtggttgtcttattttttggtccatgcatattcatatacacacgccccccagctacatttccaatagacaaaatggtggctgtgttttatacaattgggacgcccctgctcaaccctctgatctatacactgaggaatatggaagtgaaaaaagccatgaagaaattatggtgtagcaaagaatga

SEQ ID NO: 2890 - protein, 302 aa, Felis catus
MNSSVTEFILLGLTQDPVKQKAVFGVFLIFYLATLLGNFLIVVTIKTSRTLGTPMYFFLFYLSFADTCFSTTTAPRLIVDALSHKKTISYNECMIQVFTFHFFGCMEILVLILMALDRYVAICKPLRYTTIMNRQVCSVLVILVWVASCIHSLAQIFLTLRLPFCGPNVIDHYFCDLQPLLKLACMDTYVTNLLLVSNSGTICTVSFIILLTSYVVILYSLRNHSAEGRRKALSTCTSHFIVVVLFFGPCIFIYTRPPATFPIDKMVAVFYTIGTPLLNPLIYTLRNMEVKKAMKKLWCSKE

SEQ ID NO: 2891 - DNA, 912 bp, Felis catus
gcgatgaatagcagtgtgactgaattcattctccttgggttgactcgggatgcaggaaagcagaaggcagtatttggtgtcttcttgattctttacctttcgacactgtcggggaactttctcattgtagtgactattaaaataagcaagacccttgggagtcccatgtacttcttcctgttctatctgtcttttgctgacgcctgcttctctacaaccacagcccccagattgattgtggatgcccttgctcagaagaagaccatttcctacaatgagtgcatgactcaggtctttgcagcccatttctttgggtgcatggaaatcttggtgctcatcctcatggcttttgatcgctatgtagctatttgtaagccattgcaatacacaaccatcatgaaccggcacgtgtgcagtgttttggtgattctagcctgggtgggatcttgtatccactcttcagcacaaattttcctggctttgagattgcctttctgtggccccaacgtgattgaccactatttctgtgacttgcagcccttgttgaaacttgcctgtatggacacttatgtgacaaatttgctagttgtttccaacagtggggccatatgcacggtgagtttcataatcctgcttacctcctatgttgtcatcttgtactctctgcgtaaccacagtgctgaaggaaggcgaaaagccctttccacctgcacctcccactttattgtggttgtcttattttttggtccatgcatattcatatacacacgcccaccaaccacatttccaatagacaagacagtggctgtgttttatacaattgggacacccttgctcaaccctctgatctataccctgaggaatatggaagtgaaaaaagccatgaagaaattatggtgtagcaaagtatga

SEQ ID NO: 2892 - protein, 302 aa, Felis catus
MNSSVTEFILLGLTRDAGKQKAVFGVFLILYLSTLSGNFLIVVTIKISKTLGSPMYFFLFYLSFADACFSTTTAPRLIVDALAQKKTISYNECMTQVFAAHFFGCMEILVLILMAFDRYVAICKPLQYTTIMNRHVCSVLVILAWVGSCIHSSAQIFLALRLPFCGPNVIDHYFCDLQPLLKLACMDTYVTNLLVVSNSGAICTVSFIILLTSYVVILYSLRNHSAEGRRKALSTCTSHFIVVVLFFGPCIFIYTRPPTTFPIDKTVAVFYTIGTPLLNPLIYTLRNMEVKKAMKKLWCSKV

SEQ ID NO: 2893 - DNA, 901 bp, Felis catus
cccacagtttccccatggcagttttcacctctgcgttcctcagggtgtagatcagggggtttaacatgggcgtgatgatggaatcagacacggccattgccttgtctatggggtaagtggccacaggccgcacgtacaggaaaatgcagggcacgaagaacaagatgaccacagtgaggtgggagccacaggtcgacagggctttgcgccgccccgcagagctgcaagacttcagggagcagaggatgaccacgtaggaggccacgaggataaggaagatggtcacacacatcaccccactgttgaggatgactaagagacccagggcatgggtgtccatgcaggcgagtttcagcaatgggaacaaatcacatatgaagtgatcgatgacattgggaccacagaagggtatttgatacatgaagagaagctgtatcgctgcgtggataaacccccccacgcaggcgcctcccagcagcaggcggcacacctgagggttcatgatgctcgggtagtgcaggggcttacagatggccacgtagcggtcataggccatcacgacgagaaggatgacccccacaccaccaaagaaatgctccgcaaagagctgggccatgcagccttcaaaggagatggtagttctctcggagaaggagtccacgatcatcttgggggcaatgacggaacagtaggtggcgtccatgagggacaaggaagtgagaaaaaaatacataggtgatctcaggctctgacttgtgatcacggttaccaccatgagtaggttccccaaaaccgtggacacgtacaggattagaaacacagcagagagcgttttccgcagctctgggttctctgtgatgcccaaaagaatgaattcagtcgcattgtttggattctccat

SEQ ID NO: 2894 - protein, 301 aa, Felis catus
  MOD_RES (301)..(301): Any amino acid
MENPNNATEFILLGITENPELRKTLSAVFLILYVSTVLGNLLMVVTVITSQSLRSPMYFFLTSLSLMDATYCSVIAPKMIVDSFSERTTISFEGCMAQLFAEHFFGGVGVILLVVMAYDRYVAICKPLHYPSIMNPQVCRLLLGGACVGGFIHAAIQLLFMYQIPFCGPNVIDHFICDLFPLLKLACMDTHALGLLVILNSGVMCVTIFLILVASYVVILCSLKSCSSAGRRKALSTCGSHLTVVILFFVPCIFLYVRPVATYPIDKAMAVSDSIITPMLNPLIYTLRNAEVKTAMGKLWX

SEQ ID NO: 2895 - DNA, 912 bp, Felis catus
gcgatgaatagcagtgtgactgaattcattctgtttgggttgacacaggatgcaggaaagcagaaggcagtatttggggtcttcttgattctttaccttgcaacactgttggggaactttctcattttggtgactattaaaacaagcaagacccttgggagtcccatgtacttcttcctattctatctgtcgttttctgatgcttgcctctctacaaccactgcccccagattgattgtgggtgccattactcagaagaataccatttcgtacaatgagtgcatgactcaggtctttgcagctcatttctttgggtgcctggaaatcttcgtgctcatcctcatggcttttgatcgctacatagctatttgtaagcccttgcgatacacaaccctcatgagccagcatgtctgcagtgtgctgatgattttgagctgggtgggatcctgtatccactcttcagcacaaattttcctggctttgagattgcctttctgtggccccaacgtgattgaccactatttctgtgactttcagcccttgttgaaacttgcctgtatggacacttacgtgataaatttgctacttgtttctaacagtggggccatatgcacggtgagtttcataatcctgcttacctcctatgttgtcatcttgtactctctgcgaaaccacagtgctgaaggaaggcgaaaagccctttccacctgcacctcccactttattgtggttgtcctattttttggtccatgtatattcatatacacacgcccaccaaccacatttccaatagacaagatggtggctgtgttttatacaattgggacgcccttgctcaaccctctgatctataccctgaggaatgttgaagtgaaaaatgccatgaaaaagttatggtgtagcaaagtatga

SEQ ID NO: 2896 - protein, 302 aa, Felis catus
MNSSVTEFILFGLTQDAGKQKAVFGVFLILYLATLLGNFLILVTIKTSKTLGSPMYFFLFYLSFSDACLSTTTAPRLIVGAITQKNTISYNECMTQVFAAHFFGCLEIFVLILMAFDRYIAICKPLRYTTLMSQHVCSVLMILSWVGSCIHSSAQIFLALRLPFCGPNVIDHYFCDFQPLLKLACMDTYVINLLLVSNSGAICTVSFIILLTSYVVILYSLRNHSAEGRRKALSTCTSHFIVVVLFFGPCIFIYTRPPTTFPIDKMVAVFYTIGTPLLNPLIYTLRNVEVKNAMKKLWCSKV

SEQ ID NO: 2897 - DNA, 927 bp, Felis catus
ctgaataataatgtgacagagttcattctccttgggttgacccaggatcctgttaggaagaaaatagtgtttgtcactttcttgcttttctatttggggacattgctgggtaactttctgatcattactactatcaagaccagccgggcccttgggagtccaatgtactttttccttttccacttgtccttatctgacacctgtttctgtagttccgtagcccctagaatgattgtggatgcctttttgaagaagagcactatctctttcagtgagtgcatgatacaggtcttctcattccatttctttggctgcctggagatcttcattcttatcctcatggccgctgaccgctatgtggccatctgtaagcccctgcactacacaaccatcatgagtcaacgggtctgtgctgtgctggtggctatggcctgggtggggtcctgtgtacattctttagctcagatttttctggccttgagtttacccttctgtggtcccaatgtgatcgatcactatttttgtgacttgcagccattgttgagactcgcctgtacagacacttacgtaatcaatctactcttggtgtccaatagcggggccatttgtaccctgagttttgtcatgctgatgtgctcctatgttaatatcttgtattctctgagaaaccacagtgctgaagggaggagaaaagccctctccacctgtgtctcccacatcattgtggtcatcttgttcttcggtccttgcatatttatatacacacgccctgcaaccaccttccccatggataagatgatagctgtattttatacacttggaacacctttgatcaatcctctgatttacacgctgaggaatgcagaagtgaaaaacgccatgaggaaattatggaagaagaagttaatcttaggtgacaaaagatga

SEQ ID NO: 2898 - protein, 308 aa, Felis catus
LNNNVTEFILLGLTQDPVRKKIVFVTFLLFYLGTLLGNFLIITTIKTSRALGSPMYFFLFHLSLSDTCFCSSVAPRMIVDAFLKKSTISFSECMIQVFSFHFFGCLEIFILILMAADRYVAICKPLHYTTIMSQRVCAVLVAMAWVGSCVHSLAQIFLALSLPFCGPNVIDHYFCDLQPLLRLACTDTYVINLLLVSNSGAICTLSFVMLMCSYVNILYSLRNHSAEGRRKALSTCVSHIIVVILFFGPCIFIYTRPATTFPMDKMIAVFYTLGTPLINPLIYTLRNAEVKNAMRKLWKKKLILGDKR

SEQ ID NO: 2899 - DNA, 927 bp, Felis catus
atgggacatgaaaacatcacagaatttatcctcctgggacttttcagtgatgaggatgcaaagattgcctgctttgtgctgttctcgctttgctatattgcaattctctccggaaacctgcttgttcttcttaccatcaggggcagccgcctcagtgaacagcccatgtactttttcctgagctacctgtctttcatggatgtctgcttcacctccacagtggcccccaaactgatcacagatctgctggcccggcggaagactatctcttacaacagctgcatggcccagatgttttatgcccacttctttggtgccactgagatcttcatcttggtggccatggcttatgaccgttatgcagccatctgcagaccccttcactatatggtcatcatgagcagaccggtgtgctatatcattgtgatggcctcgattatcggagcattcatccattcaatcctccacgtattgattattgtcgaacttcccttctgtggccccaatcggatagaccactatttctgtgatgttttccccttgctgaagctggcttgcatggacactagcctgttggttattgtgatcattaccaccacaggagtgatgtccattttgacctttgttgccttggtaatttcttacctcatcatcctgtccaccctgaggacccgctcatcccagggccgccgcaaagccctctctacctgcagctctcacgtcactgtcgtgttcctgttcttcctgcccctcatcttcacgtatgtccccgtggctgattctgtcagtaacgacaaggtttttgccctgttttacaccatgattgctcccatgttcaaccctctcatctacacgctgagaaacacagacatgaagaacgccatgaggaaagtgtggtgttggcacaaacggactgaagggaaatga

SEQ ID NO: 2900 - protein, 308 aa, Felis catus
MGHENITEFILLGLFSDEDAKIACFVLFSLCYIAILSGNLLVLLTIRGSRLSEQPMYFFLSYLSFMDVCFTSTVAPKLITDLLARRKTISYNSCMAQMFYAHFFGATEIFILVAMAYDRYAAICRPLHYMVIMSRPVCYIIVMASIIGAFIHSILHVLIIVELPFCGPNRIDHYFCDVFPLLKLACMDTSLLVIVIITTTGVMSILTFVALVISYLIILSTLRTRSSQGRRKALSTCSSHVTVVFLFFLPLIFTYVPVADSVSNDKVFALFYTMIAPMFNPLIYTLRNTDMKNAMRKVWCWHKRTEGK

SEQ ID NO: 2901 - DNA, 936 bp, Felis catus
ctacttaccattagcttctgggaaaaccttcctgccccacagtcttttcattgcattctttacttccgcatttctcagtgtataaatcaggggatttaacatgggggtgataatggtgtaaaatacagccaccatcttgtcctctgaaaaggtagtatcagggcgcatatacatgaaggtacagggaccaaaaaagatgatgaccacagcaatgtgggagccacaggtggagagtgctttgagcctgctttctgctgagtgctttctcagggacaccaggatgatggtataggaaatgatcaagataacaaagctccccagagcaatggtaccactgttggctgtcaccacaacaccaacgatgtatgtgtctgtgcaggcaagtttcagcacagggtggatatcacaaaagtagtgatcgatctcattgggtccacaaaagggtaacgggactaccagagccacttggataatggagtgtaagaacccccctatccacgtccccagcaacattttattgcatctgtcacagcccatgatggtcgtatagtgtaggggtttacagatagccacataacgatcataggccattacggtaaggatgaagatctcagtgcaaccaaagaaatgtaccccaaagagttgcaacatgcaccccacataggagatggttttgctcttggctaataggtcaacaatcatcttaggagctgtgaccgaagagtaacaaatatccacaaaagacaagtagctgaggaagaaatacataggagacttgaaaagcttgcccctataaatggtcagcatgatgaggaggtttcccagaagaatgaccgtgtagaagaaagaaaacaccacgaaacaaacctcttcaacttctaggttctgagaaagaccccagaaaatgaattcagttacattgtttattttttccat

SEQ ID NO: 2902 - protein, 311 aa, Felis catus
MEKINNVTEFIFWGLSQNLEVEEVCFVVFSFFYTVILLGNLLIMLTIYRGKLFKSPMYFFLSYLSFVDICYSSVTAPKMIVDLLAKSKTISYVGCMLQLFGVHFFGCTEIFILTVMAYDRYVAICKPLHYTTIMGCDRCNKMLLGTWIGGFLHSIIQVALVVPLPFCGPNEIDHYFCDIHPVLKLACTDTYIVGVVVTANSGTIALGSFVILIISYTIILVSLRKHSAESRLKALSTCGSHIAVVIIFFGPCTFMYMRPDTTFSEDKMVAVFYTIITPMLNPLIYTLRNAEVKNAMKRLWGRKVFPEANGK

SEQ ID NO: 2903 - DNA, 932 bp, Felis catus
tcattttttgttttctgaggtaattttgagatgccatagctttctcatggcatttttcacttctacatttctcagtgtgtagatgagtgggttgagaaatggtgtcccaatagtataaaatacggccaccaacttatccatggggaaagtggttggggggcgtgtataaataaatatacatggaccaaagaataagactactacaatgatgtgggaagtgcaagtagagagagctttttcctcccttctgcgctgtggtttctcagcgaatgcaagatgacaatgtatgagatcatcagtatcacaaaactgcttgagcaaatggccccgctgttagacaccaacagcgtgttgatcacgtaagtgtccatgcaagcaagtttcagcaagggctgcaaatcacagcagtaatgatcaatcaaattgggtccacagaaaggcaatctcaacgccaggataatctgggctatagaatgtataaaagaccctatccatgcaagaacaatcaggatggtgcagacctgccggctcatgatggttgggtaacgtaagggcttacagatggccacgtagcgatcaacagccatgaggatgaggacaaagatctccatgcagccaaataaatgtagtgaaaagacttgagtcatacactcattgtaagagatgattttttttgcagagagtgcatccacaattagtctgggggctgtagaagttgaaaaacaggaatcagcaagggacaaataaaataggaaaaagtacatggggctctcaagtgtccggctggacttgatggtcacaataataagcaaattccctaccacggttcccacataaaaaatgaagaagattacaaataccactttctgtctcataggatcttgggtcaatcctaatagtataaactcagttacgctgttattttgctgcat

SEQ ID NO: 2904 - protein, 243 aa, Felis catus
MQQNNSVTEFILLGLTQDPMRQKVVFVIFFIFYVGTVVGNLLIIVTIKSSRTLESPMYFFLFYLSLADSCFSTSTAPRLIVDALSAKKIISYNECMTQVFSLHLFGCMEIFVLILMAVDRYVAICKPLRYPTIMSRQVCTILIVLAWIGSFIHSIAQIILALRLPFCGPNLIDHYCCDLQPLLKLACMDTYVINTLLVSNSGAICSSSFVILMISYIVILHSLRNHSAEGRKKLSLLALPTSL

SEQ ID NO: 2905 - DNA, 893 bp, Felis catus
atggagagtcagaggaatgtctcagaattcattcttttgggactttcgtatgaccatcgcacgcaaatattttgctttgtgttcttcttattctgttatgctgctctcttggtaggaaaccttctgatccttatctctattcgatgcagccctcttttccaccaaccaatgtactatttcctcagccacttatcctgtatggacatctgcttcacctctagcattacacccaaattcattgctgacctcctagtgggaagaaaagccatctcctatggtaactgtatgttacaagtctttaccatgcacttcttcggaatgattgaagtcttaatcctcaccgtcatggcctttgatcgctacgctgccatctgcaaacctctccactacctgcttgtcatgaacagagcaaggtgcaatctcctcgtcttagctgcttgggctggtggggccgcgcactcctttcctcagttttttctggtaatcaggttgcccttctgtggtcctaatgagattgatcactatttttgcgacatttttcctttgctaaaagttgcctgtgctgacacgtatgtcaccggtgtccttttggttgccaattcaggaatggttaccttagtggcatttgtggtcttgtttttttcttatgtcattatattattcactttaagaaatcattcagccaaaggaaggcgcaaagccctctctacctgtgggtcgcatatcactgtgatagttttattttttgggccttcaatctttgcctaccttcggcctccaaccactttccctgaggataaggtatttgctctgttttacaccatcattgctccgatgttcaatcccttcatatacactctgaggaactcagagatgaaaaacgccatgagaaa

SEQ ID NO: 2906 - protein, 298 aa, Felis catus
  MOD_RES (298)..(298): Any amino acid
MESQRNVSEFILLGLSYDHRTQIFCFVFFLFCYAALLVGNLLILISIRCSPLFHQPMYYFLSHLSCMDICFTSSITPKFIADLLVGRKAISYGNCMLQVFTMHFFGMIEVLILTVMAFDRYAAICKPLHYLLVMNRARCNLLVLAAWAGGAAHSFPQFFLVIRLPFCGPNEIDHYFCDIFPLLKVACADTYVTGVLLVANSGMVTLVAFVVLFFSYVIILFTLRNHSAKGRRKALSTCGSHITVIVLFFGPSIFAYLRPPTTFPEDKVFALFYTIIAPMFNPFIYTLRNSEMKNAMRX

SEQ ID NO: 2907 - DNA, 934 bp, Felis catus
atgaaaagccagagaaacatctcagaattcattcttctgggactttcctacgaccagaacatacaagtattttgctttgtcctcttcttagtctgttacgtcgccttgttggcaggaaacctgctgatcctcgtctccgttcgatgcagccctctttttcaccaacccatgtactatttcctcagccacttatccttaatagacatctgctatacctctactgttacacccaagttaattgctgacctgctggtggaaagaaaaaccatttcctatagtaactgcatgttacaggtgtttacaatgcacttctttggaggcaccgagatcttcgttcttaccgccatggcctttgatcgctatgctgccatctgcaaacctctccactacgtgattgtcatgaacaggacaagatgcaatctgctagtcgtagctgcctgggctggtggggccgtccatgccttccctctcttttctaccgcgattggtttgcccttctgtggtcctaatgaaattgatcactacttttgtgatatttttcctttgctaaaagttgcctgcaccgacacctatgtcactggtatccttgtgattgccttttcaggtctggtcgccttagttacctttattgtcttatttgtttcttatggtattatcttattcactttaagaaatctctcagctgagggaagacgcaaagccctctccacctgttggtctcatatcactgtggtcgtcttattttttggaccagtaatctttatctaccttaggccgcctactacttttcctgaggacaaaatatttgctctattttacacgatcattgctcctatgtttaatcccttaatctacactctgagaaactcagagatgaaaaacatgatgaggaaagtttggtgtcacacattattttcaaaggaaacacacaatt

SEQ ID NO: 2908 - protein, 312 aa, Felis catus
  MOD_RES (312)..(312): Any amino acid
MKSQRNISEFILLGLSYDQNIQVFCFVLFLVCYVALLAGNLLILVSVRCSPLFHQPMYYFLSHLSLIDICYTSTVTPKLIADLLVERKTISYSNCMLQVFTMHFFGGTEIFVLTAMAFDRYAAICKPLHYVIVMNRTRCNLLVVAAWAGGAVHAFPLFSTAIGLPFCGPNEIDHYFCDIFPLLKVACTDTYVTGILVIAFSGLVALVTFIVLFVSYGIILFTLRNLSAEGRRKALSTCWSHITVVVLFFGPVIFIYLRPPTTFPEDKIFALFYTIIAPMFNPLIYTLRNSEMKNMMRKVWCHTLFSKETHNX

SEQ ID NO: 2909 - DNA, 930 bp, Felis catus
ttatttctcccctgaaatagctttcctactacacaatttcctaatggcatttttcatctggtcatttctcaaggtatagattagaggatttaacatgggagttatcatagtgtagaacactgccactgctttgtcgatagataaagtagctgcgggtctcatgtactcaaatatgcaaggcacaaagaaaaagacaaccactgtgatgtgagagacacaggtggagagggctttgcgccttgcctccaagctgtggttccttagggagcgcagaatgaccacataggagaccatcaagaggaggaagtttaagacacagatgaaaccactgttggcagcaacgaagagccctagagtgtgggtatctgtgcaggcaagtttgagcaaagggttcagatcacacataaagtggtctatgacgttagggccacagaagggtaatgggatgataaagaggatctgtatgattgcatgaagaaagccccccacccacaccactcccattaacaggccacacacccgtcgattcatgatggtcatgtagtgcaatggtttgcagatggccacatagcggtcataggccatcaccgtaagcaggatgacatcagcacctccaaagaagtgttccccaaagatttgggtcatacatgcattgaatagggtggtcttcttttcacggagtgaatctatgatcaatttggggttattgaccgaggaatagcaagcatcaatgaaggagagataggccaagaaaaagtacatgggggaccccaataatgggctggcagtgatagtgaccagagtgagcacgtttcctaccatagagacgatgtagatggccaaaaacacaacaaatatgactttctgcatctttggattctctgtgagccccagtagaacaaactccgtcacgttgttcctattctccat

SEQ ID NO: 2910 - protein, 309 aa, Felis catus
MENRNNVTEFVLLGLTENPKMQKVIFVVFLAIYIVSMVGNVLTLVTITASPLLGSPMYFFLAYLSFIDACYSSVNNPKLIIDSLREKKTTLFNACMTQIFGEHFFGGADVILLTVMAYDRYVAICKPLHYMTIMNRRVCGLLMGVVWVGGFLHAIIQILFIIPLPFCGPNVIDHFMCDLNPLLKLACTDTHTLGLFVAANSGFICVLNFLLLMVSYVVILRSLRNHSLEARRKALSTCVSHITVVVFFFVPCIFEYMRPAATLSIDKAVAVFYTMITPMLNPLIYTLRNDQMKNAIRKLCSRKAISGEK

SEQ ID NO: 2911 - DNA, 930 bp, Felis catus
atggaaaatcagaacaatgtcacagaatttgttttcatgggtctgtggggaaataagcaaatggagctcctgttctttttctggttcctgctctgttacctggctgtcttaatgggcaacgtcatcatcttgctcacaatcacctgcagccatctaatcgaacagccgatgtactactttctctgtcacctttccctcatggatctctgctacacctccaccgtggtccccaggctaatcagggacttaggcgccgcaagaagaaacatctcctataacaattgtatgacccagctcttcgctgcccacttgctggcgggtgtggagatattcatcttggtgtccatggcttttgaccgctatgttgccattgtcaagcccctgcactacacggtcctcatgaaccggcagaggtgtaacatgttgatcttcacggcctgggctgtgggtttttggcactccattgctctgttgctcatggtactcaacttacctttctgtggtcctaatcagatagatcactacgtatgtgatgtgaagcctcttttgaaactggtgtgcagagacattcatgttgttagtatcttagtgattgctaattcagggatggtggtggttgtcatttttcttgtcctggtggcttcttacatactcatattatataatcttaggacccgctcctccgcagggcgacgcaaagctctctccacctgcagctctcacgtaatggtggtggttttattctttgtgccctgtatctatacttacgttttacctgcagggagtgagaacaaggataaggaaatatccgtgttttacactgtgattgcccctatgctgaatcctctcatctataccctgagaaacacggagatgaaaaccgccatgcagaaggtatggtctaaaatggcacattcagaatgcaagtaa

SEQ ID NO: 2912 - protein, 309 aa, Felis catus
MENQNNVTEFVFMGLWGNKQMELLFFFWFLLCYLAVLMGNVIILLTITCSHLIEQPMYYFLCHLSLMDLCYTSTVVPRLIRDLGAARRNISYNNCMTQLFAAHLLAGVEIFILVSMAFDRYVAIVKPLHYTVLMNRQRCNMLIFTAWAVGFWHSIALLLMVLNLPFCGPNQIDHYVCDVKPLLKLVCRDIHVVSILVIANSGMVVVVIFLVLVASYILILYNLRTRSSAGRRKALSTCSSHVMVVVLFFVPCIYTYVLPAGSENKDKEISVFYTVIAPMLNPLIYTLRNTEMKTAMQKVWSKMAHSECK

SEQ ID NO: 2913 - DNA, 936 bp, Felis catus
atggagagccagagaaacacctcagaattcgttcttctaggactttcgtatgaccagaacgtacaaatattttgctttgtgctcttcttattctgttatgttgccctgttggcaggaaacctgctgatcctcgtctccattcgatgcagccctcttttccaccaacccatgtactatttcctcagccacttatcctgtatggacatctgctatacctctagtgttacacccaaattcattgctgacctacgaggggggacaaaaacgatctcctacggtaattgcatgttccaggtctttgctatgcacttctttgggagtactgaggtctttgtcctcacagtcatggcctttgatcgctacgtggctatctgtaaacctctccactacctgcttatcatgaacaggacaagatgcaatcttctagtcttggctgcttgggctggtggggctctccattctcttcctcaattatcgatgaccatccagttgccattttgtggacctaatgagattgatcactatttttgtgacatcttgcctttgttgaaagttgcctgtactgatacctacatcactggtgtccttgtggttgccaattcaggtctggtcgctttagtgaccttcgttgtcttatttgtttcttatgtcattatattgtttagtctaagacatcgttcggccgagggaagacacaaagccctctctacctgtgggtctcatattactgtggtcatcttattttttggaccttcaatctttgcctaccttcgacctccgaccacgttcccccaggacaaaatatttgctctattttacaccatcatcgctcctatgttcaatcccttaatctacaccctgagaaatacagagatgaaaagcgcgatgagaaaagtttggtgtcaaacattattttcgaaggaagcacacaattaa

SEQ ID NO: 2914 - protein, 311 aa, Felis catus
MESQRNTSEFVLLGLSYDQNVQIFCFVLFLFCYVALLAGNLLILVSIRCSPLFHQPMYYFLSHLSCMDICYTSSVTPKFIADLRGGTKTISYGNCMFQVFAMHFFGSTEVFVLTVMAFDRYVAICKPLHYLLIMNRTRCNLLVLAAWAGGALHSLPQLSMTIQLPFCGPNEIDHYFCDILPLLKVACTDTYITGVLVVANSGLVALVTFVVLFVSYVIILFSLRHRSAEGRHKALSTCGSHITVVILFFGPSIFAYLRPPTTFPQDKIFALFYTIIAPMFNPLIYTLRNTEMKSAMRKVWCQTLFSKEAHN

SEQ ID NO: 2915 - DNA, 767 bp, Felis catus
aatcacagctgtcatcttatccatggggaaggtggttgcagggcgtgcatatataaatatgcaaggaccgaagaacaaaatgaccacaatgatgtgggagacacaggtggagagggcttttctcctcccttcagcactgtggtttctcagagaatacaagatattaacataggagcacatcagcatgacaaaactcagggtacaaatggccccgctattggacaccaagagtagattgattacgtaagtgtctgtacaggcgagtcacaacaatggctgcaagtcacaaaaatagtgatcgatcacattgggaccacagaagggtaaactcaaggccagaaaaacctaagctaaagaatgtacacaggaccccacccaggccatagccaccagcacagcacagacccgtcgactcatgatggttgtgtagtgcaggggcttacagatggccacatagcggtcagcggccatgaggataagaatgaagatctccaggcagccaaagaaatggaatgggaagacctgtatcatgcactcactgaaagagatagtggtctttttttaaagggcatccacaatcattccaggggctacggaagtacagaagcaggtgtcagataaggatcggtgggctaggaagtagcacacgggactcctgagttccccggggggccttgacagtggtaatgatcagaacgttacccagcaacatgcccgaatagagaagcaagacaatgacaaacgctgttttcctcctaacaggatcc

SEQ ID NO: 2916 - protein, 77 aa, Felis catus
NHSCHLIHGEGGCRACIYKYARTEEQNDHNDVGDTGGEGFSPPFSTVVSQRIQDINIGAHQHDKTQGTNGPAIGHQE

SEQ ID NO: 2917 - DNA, 929 bp, Felis catus
atggatcaaagcaataatgtcactgtatttattctcttgggactttccaaaaacaagaacattgaaatcctttgttttgtgttatttttattttgctacattgctatttggataggaaactcactcgtaataatttccatcatgggcagtcagctaattgagcaacccatgtattttttccttaattacctctcactctccgacctttgctacacatccaccgtgacacccaaactaatgactgacttgttggcagagaggaagaccatttcctacagtagctgcatgacacaactctttagcacacatttatttggaggcatcgagatcttcatcctcacggggatggcctatgaccgctacgtggccatctgcaggcccctgcactacacggtcatcatgagcagacagaggtgtaacacaattatcacagcctgctgtactggggggtttgtacattctgccagccagttccttctcaccatcttcttacccttctgtggccccaatgagatagatcactacttctgcgacgtgtaccctttactgaaactagcctgttctaatacacacctcataggtctcctagtcattgccaattcaggcctaattgctttggtgaccttcgtcgtgctgatgttgtcttacttttttatactgtgcagtgtcagggcttactccgcagagagtcgcagcaaggctctttccacctgcagtgctcacatcacagttgtggctttgttttttgcacctgcactcttcatctatattagaccagccacaacatttccagaagacaaagtgtttgctcttttctataccatcattgcccccatgttcaaccctctgatctacacgttgagaaacacagagatgaagaaagccatgaagaaagtgtggtgtcgtcatatactcttggaaggaaagta

SEQ ID NO: 2918 - protein, 310 aa, Felis catus
  MOD_RES (310)..(310): Any amino acid
MDQSNNVTVFILLGLSKNKNIEILCFVLFLFCYIAIWIGNSLVIISIMGSQLIEQPMYFFLNYLSLSDLCYTSTVTPKLMTDLLAERKTISYSSCMTQLFSTHLFGGIEIFILTGMAYDRYVAICRPLHYTVIMSRQRCNTIITACCTGGFVHSASQFLLTIFLPFCGPNEIDHYFCDVYPLLKLACSNTHLIGLLVIANSGLIALVTFVVLMLSYFFILCSVRAYSAESRSKALSTCSAHITVVALFFAPALFIYIRPATTFPEDKVFALFYTIIAPMFNPLIYTLRNTEMKKAMKKVWCRHILLEGKX

SEQ ID NO: 2919 - DNA, 956 bp, Felis catus
atgggaagtcagaggaacatctcagaattcattcttttgggactttcctataaccagaacatacaaattttttgctttgtattcttcttgttttgttatgtttccattttggtgggaaatgtcttaattctcgtctccattcgatgcagtgcccttttttaccaaccaatgtactatttcctcggtcacttatcctttatggacatttgctacacctcctctgtgacacccaaactgataggtgatctgctgctgaccagaaaaaccatctcttatggtaattgcatgttacaggtcttttccttgcactttttgggaatgattgaaatcttcatccttacagtcatggcctttgatcgctacgctgccatctgcaaacctctccactacctgcttatcatgaatagagcaaggtgcaatctcctagtcttggctgcttgggctggtggggccgtccattctttttctcagttttctatgatattccagttgcctttctgtggccccaacgaaatcaatcactactattgtgatatcttccctttgctgaaagttgcttgtactgatacctacatcactggtgtccttgtggttgccaattcaggtctggtcgctttagtgacctttgttctcttgtttgggtcttatgttgtcatattattcactttaagacatcagtcggctgaaggaagacgcaaagccctctccacctgtgggtctcatatcactgtggtcatcttattttttgggccttcaatctttgcctaccttcgacctccgaccacgttccccgaggacaagatattcgctctattttacaccatcatcgctcctatgttcaatcccttaatctacaccctgagaaatacagagatgaaaagcgtgatgagaaaagtttggtttcaaatgatattttcaggagaaaaacacaattgatttgtcctattcaatatgct

SEQ ID NO: 2920 - protein, 311 aa, Felis catus
MGSQRNISEFILLGLSYNQNIQIFCFVFFLFCYVSILVGNVLILVSIRCSALFYQPMYYFLGHLSFMDICYTSSVTPKLIGDLLLTRKTISYGNCMLQVFSLHFLGMIEIFILTVMAFDRYAAICKPLHYLLIMNRARCNLLVLAAWAGGAVHSFSQFSMIFQLPFCGPNEINHYYCDIFPLLKVACTDTYITGVLVVANSGLVALVTFVLLFGSYVVILFTLRHQSAEGRRKALSTCGSHITVVILFFGPSIFAYLRPPTTFPEDKIFALFYTIIAPMFNPLIYTLRNTEMKSVMRKVWFQMIFSGEKHN

SEQ ID NO: 2921 - DNA, 982 bp, Felis catus
atgggaaatagaaacaacgtcaccgtgtttattctcttgggactctctcaaaacaagaacgttgaaatcctctgctttatattattttcattttgctacgttgccatttggatgggcaatctgctcgtaatgatttccatcacatgcagtccactcattaaccaacctatgtatttcttccttaattgtctctcactttctgaccttagctacacatcaacagtgacacccaaacttctgattgatttgctggcagagaggaagaccatttcctacagtaactgcatgacacagctctttatcctccactttctcggaggcatcgagatcttcatcctcacggggatggcctatgaccgctatgtggccatctgcaggcccctgcactacacggtcatcatgagcagacagaggtgcaacacaatcatcacagcctgctgcacgggggcatttctacactctgccagccagttccttctcaccatcttcttacccttctgtggccccaatgagatagatcactacttctgcgacgtgtatcctctcctgaaactggcctgcactgacacgtacagaattggcgtcttggtaattgtcgattcaggtctgattgccttactggcttttgtgattttgatggcgtcctattttctgattctgtacaccatcagggcttaccctgcagagagccgcgccaaagctctgtccacctgtagttcccatgtcacagttgtgattctgttctttgcgcctgttctcttcatttatattcgaccagccgcgacacttccagaagacaaagtgtttgctctcttctacaccatcattgcccccatgttcaaccctctgatctacacgctgagaaacatggagatgaaggatgccatgaagaaaatttggtttcgttatttgttcttggaagggaagtaacttctacgcaaagcgttctagaatttcacgttagagctccatcctgacccta

SEQ ID NO: 2922 - protein, 309 aa, Felis catus
MGNRNNVTVFILLGLSQNKNVEILCFILFSFCYVAIWMGNLLVMISITCSPLINQPMYFFLNCLSLSDLSYTSTVTPKLLIDLLAERKTISYSNCMTQLFILHFLGGIEIFILTGMAYDRYVAICRPLHYTVIMSRQRCNTIITACCTGAFLHSASQFLLTIFLPFCGPNEIDHYFCDVYPLLKLACTDTYRIGVLVIVDSGLIALLAFVILMASYFLILYTIRAYPAESRAKALSTCSSHVTVVILFFAPVLFIYIRPAATLPEDKVFALFYTIIAPMFNPLIYTLRNMEMKDAMKKIWFRYLFLEGK

SEQ ID NO: 2923 - DNA, 935 bp, Felis catus
atggaaaatatgaacaacgtcactgaatttgttctgttgggactttcccagaacaagaaaattaaaaacttgtgctttctactattcttattttgttacatagctatttggatgggaaacttgctcataatgatttctatcacatgcagcccgctaattgaccaacccatgtatttcttccttaataaccttgcgctctcagatctgtgttatacgtcaacagtgacacccaagctagtcaccgacttgctggcagaaagtaacatgatttcttatactagctgtatggcacagctttttgccatgcatttctttggggggattgaaatctttatcctcacagcgatggcctatgaccgctacgtggccatctgcaagcccctgcactataccatcatcatgaacaggcagaggtgttataccatagtcactgctagctgtaccggggcatttctgcattcttttttccagtgtctccttaccatcaatttacctttctgtggccccaatgaaatagatcactacttctgtgatgtgtatcctttgctgaaactggcctgcacagacacttaccgagttgggatcctagtggttgccaactcaggcatgatgggcttggtgacctttgtggtcttggtgctgtcttacttgttgatattgtacaccatcagggcttaccctgcagagagccgcaccaaagcactttccacctgtagttcccacatcacagttgttgttctgttctttgtgcctgttctcttcatttacattagaccaaccacaactttcccggaagacaaagtgtttgctctcttctacaccatcattgcccccatgtttaaccctctcatttacacattcagaaacgtggagatgaagactgccttgagaaaagtgtggtgccagaaactatgttttattggaaggcaaatcat

SEQ ID NO: 2924 - protein, 312 aa, Felis catus
  MOD_RES (312)..(312): Any amino acid
MENMNNVTEFVLLGLSQNKKIKNLCFLLFLFCYIAIWMGNLLIMISITCSPLIDQPMYFFLNNLALSDLCYTSTVTPKLVTDLLAESNMISYTSCMAQLFAMHFFGGIEIFILTAMAYDRYVAICKPLHYTIIMNRQRCYTIVTASCTGAFLHSFFQCLLTINLPFCGPNEIDHYFCDVYPLLKLACTDTYRVGILVVANSGMMGLVTFVVLVLSYLLILYTIRAYPAESRTKALSTCSSHITVVVLFFVPVLFIYIRPTTTFPEDKVFALFYTIIAPMFNPLIYTFRNVEMKTALRKVWCQKLCFIGRQIX

SEQ ID NO: 2925 - DNA, 939 bp, Felis catus
tcaaatcattgacttccctttccaaaaccttgcaccgcaccaaactttccttatggcatttttcatctctgtgtttctaagtgtgtagataagaggattgagcatggggacaataattgtgtagaagagtgtgaacactttatcttccggtaaagttgtggcaggtcgaatgtaaacaaagatgacaggtgcaaaaaacaggatcacaaccgtgatgtgggagctgcaggtggaaagggccttgtggcggttctctgcagaatatgctctcacattgcataatatcatgaagtaggaggccatcaaaaccacgaagatccccagtcccatcaggccggaattggcaatgactaagaaaccaattttgtgtgtatcagtgcaggccagtttcaacaaaggatatacatcgcagaaatagtgatctatttcattggggccacagaatggcagaaaaattgcaagaagaaacaggccaatggaatgcagaaacccacctgcacatgatgctccgagaattgagttacatcgttgtctactcatgaggatggcataatggagtggtttgcagatggccacatagcggtcgtaggccattcctgtgatgatgcagacctcgacccccccaaagaagtgtgtggtgaacaactgtgtcatgcagttatgataggaaatgaccttcttccctgtcagtaagtcagtcattagtttgggtgtcacagtggaggtgtagaggaggtctgagagggcaaggtaattaaggaagaagtacatgggctggttaattagctgactgtaggtgatagaagccataataatcagattccccaaccagatagcgaggtaacagagtaagaaaaataaaaagcagaggatctggactctcttactcttagaaagtcccaggagaataaattcagtaacattattcctattttccat

SEQ ID NO: 2926 - protein, 312 aa, Felis catus
MENRNNVTEFILLGLSKSKRVQILCFLFFLLCYLAIWLGNLIIMASITYSQLINQPMYFFLNYLALSDLLYTSTVTPKLMTDLLTGKKVISYHNCMTQLFTTHFFGGVEVCIITGMAYDRYVAICKPLHYAILMSRQRCNSILGASCAGGFLHSIGLFLLAIFLPFCGPNEIDHYFCDVYPLLKLACTDTHKIGFLVIANSGLMGLGIFVVLMASYFMILCNVRAYSAENRHKALSTCSSHITVVILFFAPVIFVYIRPATTLPEDKVFTLFYTIIVPMLNPLIYTLRNTEMKNAIRKVWCGARFWKGKSMI

SEQ ID NO: 2927 - DNA, 932 bp, Felis catus
tcagcttctgtcctcacttcccatgacatggccccagagtttctttacggcgttcttcatccccatgtttcttagtgcgtctatgagagggttgagcacgggggcaatgacagtatagaaaagagcaaacactttgtcctctggtaaggtcgttgctggtcgaatgtaaataaagactaaaggagcaaaaaagagaaccaccacgatgatgtgggaactgcatgtggaaagggctttgtggcgattctccgcggagtaggacctgacaatatataggatcatagcataggataccagcgagaccacgaaagtcaccagacccatcagtcctaagttggcaaccaccagggagaactattctgctcatgtccgtgcaggccatcttcagcaaaggatacacatcgcagaagacgtgatctatttcactggggtcacagtagggtaagacgatggcgaggagaaactgaccaaaaaggaatgtaggaacccacccgcacacgaagccgcgagcatggcattgcacttccactcatgatgactgcacagtgcaggggcctgcagatggccacgtgtcggtcataggccatcccggtgaggacaaagacctcgatttccccaaagaagtgcacggtgaagagctgtgtcgtacagccactgtaggaaatgaccttcttttctgtcagcaagtcaatgatgaacttgggggtcacagtggaggtgtagaaaaggtctgccagggataggaaactcgggaagaaatacacagggtggtcaataagttgactgcaggtgagagaaatcacgacaagaaggttgccaatcaagatggcaatgtaacaaaacaagaacagtaaaaagcagaagacttctatttcttttttctgagaaagtcctaaaagaataaattctgtgatgttattcctattttccat

SEQ ID NO: 2928 - protein, 166 aa, Felis catus
MENRNNITEFILLGLSQKKEIEVFCFLLFLFCYIAILIGNLLVVISLTCSQLIDHPVYFFPSFLSLADLFYTSTVTPKFIIDLLTEKKVISYSGCTTQLFTVHFFGEIEVFVLTGMAYDRHVAICRPLHCAVIMSGSAMPCSRLRVRVGSYIPFWSVSPRHRLTLL

SEQ ID NO: 2929 - DNA, 895 bp, Felis catus
cactttcattctcttgggcttttcagaatatccagaactccagatgcctctgttcctggtattcctgaccatctacacagtcactgttttgggaaatctgggcatgatcatgattatccagatcaatcccaaactccacacccccatgtatttttttctcagccatttatctttggttgatttctgttactctacagtagtcacacccaaactattagaaaacttggttgtggaagacagaaccatctccttcacaggctgcatcatgcaattcttctttgcgtgcatattcgtggtgacagaaaccttcatgttggccgtgatggcatatgaccgatttgtggcagtttgtaaccctcttctgtacatagttgtcatgtctcagaagctttgttccttgttggtgggtgcatcatactcctggggtatagtgtgttccctgactcttacttacttcctactgaaattatccttcaaaggaaataatatcataaataactttgtctgtgagcatgccgccatcatctctgtgtcctgctctgatccctacatgagccagaagattattttaatctctgccacattcaatgaaataagcagcctggtgatcattctgctctcctatgtttccgtttttatcactgtcatgaagatgccttccactggggggcgccacaaggccttctccacgtgtgcttcccacctgaccgctatcacaatcttccatgggaccattctcttcctgtactgtgttcccaactccaaaagttcatggctcatggtcaaggtggcttctgtcttttacactgtggtcattcccatgctgaacccactgatctatagcctcaggaacaaagatgtgaaggagacagtcaagaagttaatcaataccaaa

SEQ ID NO: 2930 - protein, 298 aa, Felis catus
TFILLGFSEYPELQMPLFLVFLTIYTVTVLGNLGMIMIIQINPKLHTPMYFFLSHLSLVDFCYSTVVTPKLLENLVVEDRTISFTGCIMQFFFACIFVVTETFMLAVMAYDRFVAVCNPLLYIVVMSQKLCSLLVGASYSWGIVCSLTLTYFLLKLSFKGNNIINNFVCEHAAIISVSCSDPYMSQKIILISATFNEISSLVIILLSYVSVFITVMKMPSTGGRHKAFSTCASHLTAITIFHGTILFLYCVPNSKSSWLMVKVASVFYTVVIPMLNPLIYSLRNKDVKETVKKLINTK

SEQ ID NO: 2931 - DNA, 885 bp, Felis catus
caccttcattctgttgggcttctcagaatatccagaactccagatgccacttttcctggtattcctgaccatctacatagtcactgttcttgggaatctgggtatgatcatgatcatcaggatcaatcccaaactccacacccccatgtacttttttctcagccatttatctttggttgatttctgttactctacagtagtcacacccaaactattagaaaacttggttgtggaagacagaaccatctccttcacaggctgcatcatgcaattcttctttgcgtgcatatttgtggtgacagaaaccttcatgttggccgtgatggcatatgaccgatttgtggcagtttgtaaccctcttctgtacacagttgtcatgtctcagaagctttgttccttgttggtgggagcatcatattcttggagtatagcctgctccttaacatacacatactttttgttgactttatccttttgtggaactagcttcataaacaactttgtctgtgagcattctgccattgtctctgtgtcctgctctgatccttacattagccagagggtcattttagtctctgccacattcaacgaaataagcagcctggtgatcattcttccctcctatgtttccatttttatcactgtcatgaagatgccttccactggggggcgccacaaggccttctccacgtgtgcttctcacctgaccgctgttacaattttccatgggaccatactgtttctgtattgtgttcccaactccaaaagttcatggctcatggtcaaagtagcttctgtcttttacactgtggtcattcccatgctgaacccactgatctacagcctcaggaacaaagatgtgaaagaggcagtcaagacgttaat

SEQ ID NO: 2932 - protein, 295 aa, Felis catus
  MOD_RES (295)..(295): Any amino acid
TFILLGFSEYPELQMPLFLVFLTIYIVTVLGNLGMIMIIRINPKLHTPMYFFLSHLSLVDFCYSTVVTPKLLENLVVEDRTISFTGCIMQFFFACIFVVTETFMLAVMAYDRFVAVCNPLLYTVVMSQKLCSLLVGASYSWSIACSLTYTYFLLTLSFCGTSFINNFVCEHSAIVSVSCSDPYISQRVILVSATFNEISSLVIILPSYVSIFITVMKMPSTGGRHKAFSTCASHLTAVTIFHGTILFLYCVPNSKSSWLMVKVASVFYTVVIPMLNPLIYSLRNKDVKEAVKTLX

SEQ ID NO: 2933 - DNA, 949 bp, Felis catus
atggcactggatgagggaaatcagagctctgtgactatatttatcctcctgggtttctcggagtacccatacctccaggcacccctcttcctcatgttcttgaccatctacacagtcactctggtgggaaacctgggcatcattgcggttgtaaggatcaaccccaaactccacacacccatgtactttttcctcagtcatctatcctttttggatatttgttattccagtgtatttacaccaaaactgctagagatcttggtcatggaagacagaagtatctccttcaaagcatgcatggtgcaatttttttttgtttgtgcatttgtgattacagaaatgttcatgttagcggttatggcctatgaccggtttgtggctgtttgcaaccccctgctctacacagtggctatgtctcggaaactctgtgccctcttggtagctggaacctatgtatggggtggaatatgttccctgacactcacatactctcttttggaactatccttctgtggtcccaacattatacatcactttggctgtgagtattctgccatcctttctttatcctgctctgacccctcctttagtcagaggatgtgtttagtcatttccacattcaatgaggcttgtagcctcctgattatcctcgcctcctatatttttatagttgtcaccatagtcaagatgccatctactggaggactccagaaagccttctccacctgtgcctcccacctgaccaccatcaccatcttccatgggatcatccttcttctctactgtgtgcccaactccaaaagctcgtggctcctggtcaaagtggccactgtgttttttactgtcatgatccccatgttgaaccctcttatttacagtcttaggaacaaagatgtgaaagacacagccagaaagttaattcataccaaactgctttctcactcaatgt

SEQ ID NO: 2934 - protein, 317 aa, Felis catus
  MOD_RES (317)..(317): Any amino acid
MALDEGNQSSVTIFILLGFSEYPYLQAPLFLMFLTIYTVTLVGNLGIIAVVRINPKLHTPMYFFLSHLSFLDICYSSVFTPKLLEILVMEDRSISFKACMVQFFFVCAFVITEMFMLAVMAYDRFVAVCNPLLYTVAMSRKLCALLVAGTYVWGGICSLTLTYSLLELSFCGPNIIHHFGCEYSAILSLSCSDPSFSQRMCLVISTFNEACSLLIILASYIFIVVTIVKMPSTGGLQKAFSTCASHLTTITIFHGIILLLYCVPNSKSSWLLVKVATVFFTVMIPMLNPLIYSLRNKDVKDTARKLIHTKLLSHSMX

SEQ ID NO: 2935 - DNA, 863 bp, Felis catus
gttccactcttcctggctttcttgtctatctatatggtcactgccgtgggcaacgtgggcatgattataatcatcaagatcaatctgaaattccacacgatcatgcactttttccttagtcacttgtcctttgtagatttctgttattccaccatagtgacgcctaaattgttgaagaacttgattgtgcaagacagaaccgtatctttctccggttgcattatgcagttctgctttgcttgcatatttggagtaacagaagcttttatgttagcagcaatggcctatgaccgttgtgtggcggtctgtaatcccttgctctatcttactattatgtctccaaagctctgtgctccgctggtggctgggtcatactcatggggtatagtgtgttccctgacacatattttctccttgcattatcctattgtgagtctaacatcataaataattttatctgtgaccactctgtaattgtttctgtcttctgttcggacccctatatcagccagatgtgctgttttattattgccatattcgatgaggtgagcagcttgatggttattctgaagtcctataccctcatttttgtcactgttatgaggatgtcttctgcaagtgggtgccggaaaaccctctccacctgtgcctcccacctgacagccattaccatcttccatgggaccatccttttcctctactgtatccctaatcctaaaacttcttggctcagagttaaagtggcatctgtgttttacacagtagtgattcccatgcggaaccccttaatctacagccttagaaacaaagatgtgaaggacacattgagattagttgttgcaaaattgctttgtccctcaata

SEQ ID NO: 2936 - protein, 162 aa, Felis catus
MGYSVFPDTYFLLALSYCESNIINNFICDHSVIVSVFCSDPYISQMCCFIIAIFDEVSSLMVILKSYTLIFVTVMRMSSASGCRKTLSTCASHLTAITIFHGTILFLYCIPNPKTSWLRVKVASVFYTVVIPMRNPLIYSLRNKDVKDTLRLVVAKLLCPSI

SEQ ID NO: 2937 - DNA, 930 bp, Felis catus
gaaggaaaccacagtactggagccacattcaccctcttgggcttctcagaatatccggatctgcagattcccttgttcctgctattcctgaccgtctacaccgtcactgtggtggggaacctgggcatgatcatgatcatcagggtcagtccccaactccacacccccatgtactttttcctgagccacttgtcctttgtcgacttctgttactccactacagttacccccaaactgttggagaacttggttgtggaagacagaaccatctctttcataggctgcatagtgcaattcctgttggcttgtatatttgcagtgtcagaaacattcatgttggcagtgatggcctatgaccgctttgtggcagtttgtaaccctctactctacaaagctgtcatgtcccaaaagctgtgtgcatcgttagtggcggggccctacacatggggtgtagtctcttccttgacactcacctattttctcctgacattgtccttctgtggctctaacatcataaataattttgtctgcgagcactctgtcattgtctctgtgtcctgctctgacacctacatcagccaagtgctttgttttgccatcgccatgttcaatgaggtgagcagcctggtaatcatcctcactacttatatttttatttttgtcactgtcataaaaatgccttctgctggtgggcgccaaaaagccttctccacttgtgcatcccacctgactgccatcaccatcttccatgggaccgtcttgttcctttactgtgtacccaactccaaaaactcatggctcataatcaaagtaggttctttattttataccgtggtgatccccatgctgaaccctctaatctatagcctcagaaacaaagatgtgaaagagagtgtcaggaaattaattaatcactcaatgcaattttgt

SEQ ID NO: 2938 - protein, 310 aa, Felis catus
EGNHSTGATFTLLGFSEYPDLQIPLFLLFLTVYTVTVVGNLGMIMIIRVSPQLHTPMYFFLSHLSFVDFCYSTTVTPKLLENLVVEDRTISFIGCIVQFLLACIFAVSETFMLAVMAYDRFVAVCNPLLYKAVMSQKLCASLVAGPYTWGVVSSLTLTYFLLTLSFCGSNIINNFVCEHSVIVSVSCSDTYISQVLCFAIAMFNEVSSLVIILTTYIFIFVTVIKMPSAGGRQKAFSTCASHLTAITIFHGTVLFLYCVPNSKNSWLIIKVGSLFYTVVIPMLNPLIYSLRNKDVKESVRKLINHSMQFC

SEQ ID NO: 2939 - DNA, 907 bp, Felis catus
atgttactttcagagagaaataaaactggggctgtgttcactctcttgggcttctcagattacccagaactgcaagtccctctcttcttgatttttttggccatctacagtgtcactgttgtaggaaatattgggatgatagttataatcaagattaactccaaactgcacacccccatgtactttttcctcagccacctctcatttgtggatttctgctattcctccatcattgttcccaagaccctggcaaacctagttgtagaagacaggaccatttcatttccaggatgtatagtacaatattttttcttttgtacctttgtggtagctgaatcctttttattggctgtgatggcctatgaccgctttgtggccatctgcaaacctctgctctacacagtggccatgtcccagaaattctgtgccatgctggtggttggatcatacgcatggggagtagcatgttccctgatactcacatgttctgctatcaggttatctttccagggtttcaacacaatcaatcacttcttctgtgagttctctgcattgctgtccctgtcttgctctgatatttacatcaatcagttgctgcttttcatttttgccaccttcaacgtggtcagcacactgtttatcattctcatgtcttatgtatttatcattgtcaccatcctcaagatgcgttcagccagtggtcgtcgcaaagccttctccacctgtgcctcccacctgacagccatcaccatcttctatgggaccattgtcttcctctactgtgttcctaactccaaaaactcgaggaacacagtgaaagtggcgtctgtgttttacacagtggtgatccctatgctgaatcccttgatctacagtctgagaaataaagacatcaaggatacagtca

SEQ ID NO: 2940 - protein, 303 aa, Felis catus
  MOD_RES (303)..(303): Any amino acid
MLLSERNKTGAVFTLLGFSDYPELQVPLFLIFLAIYSVTVVGNIGMIVIIKINSKLHTPMYFFLSHLSFVDFCYSSIIVPKTLANLVVEDRTISFPGCIVQYFFFCTFVVAESFLLAVMAYDRFVAICKPLLYTVAMSQKFCAMLVVGSYAWGVACSLILTCSAIRLSFQGFNTINHFFCEFSALLSLSCSDIYINQLLLFIFATFNVVSTLFIILMSYVFIIVTILKMRSASGRRKAFSTCASHLTAITIFYGTIVFLYCVPNSKNSRNTVKVASVFYTVVIPMLNPLIYSLRNKDIKDTVX

SEQ ID NO: 2941 - DNA, 934 bp, Felis catus
gggcaagggaaactgctccggtgtgaccgagttcattctcctgggattcgcagaagcccctgagttgagagttgccctcttctctgtgttctttctcatctatggagtcacggtgctgggcaacctgggcatgatggcagtgattcaggtcagctgtcaccttcacactcccatgtactttttcctcagccacttgtcctttgtggatttttgctactccaccatcatcgtgccaaagatgctaactaatatcttaaacgaggacaaaaccatttccttcctggggtgctgcgtgcaattctacttgttttgtacatgtgtggtaagtgaggtcttcctgttggcggtcatggcctatgaccgcttcgtggccatctggaacccactgttgtacacggtcaccatgtcccggaatctctgtgtggagctggtgtcttgttgctacctgtgtgggatggtgtgttctctgatccacttgtgtttagctcttgagatcacatcctacagatcaaatgtgattgaccacttcttctgcgatctgccccctctcttatcccttgcttgctctgatgtgactatgaatgaactgctgctgtacatcgtggccaccttcaatgagatcaccaccattgtgatcatcctcacctcctacttgctaattctcatcaccatcctgaggatgcactctgccgagggaaggcgcaaagccttttccacctgtgcctcccacctcacagccatccttgtcttccacggaacaatccttttcacttactgccggcccagttctggcaacagtatggatactgacaaggtggccacggtgttctacactgtagtgattcccatgctcaaccccctcatctatagcctccggaacaaggatgtgaaggaagcgctcagaaaaatggtgagctccaaaatattttcctag

SEQ ID NO: 2942 - protein, 310 aa, Felis catus
GKGNCSGVTEFILLGFAEAPELRVALFSVFFLIYGVTVLGNLGMMAVIQVSCHLHTPMYFFLSHLSFVDFCYSTIIVPKMLTNILNEDKTISFLGCCVQFYLFCTCVVSEVFLLAVMAYDRFVAIWNPLLYTVTMSRNLCVELVSCCYLCGMVCSLIHLCLALEITSYRSNVIDHFFCDLPPLLSLACSDVTMNELLLYIVATFNEITTIVIILTSYLLILITILRMHSAEGRRKAFSTCASHLTAILVFHGTILFTYCRPSSGNSMDTDKVATVFYTVVIPMLNPLIYSLRNKDVKEALRKMVSSKIFS

SEQ ID NO: 2943 - DNA, 945 bp, Felis catus
  modified_base (553)..(572): a, c, t, g, unknown or other
aactgctccagtgtgaccgagttcattctcctcggattcgcagaagcccccgagttgagagtcgccctcttctctgtgttccttctcagctatggagtcacggtgctgggcaacctgggcatgatggcagtgattcaggtcagctgtcaccttcacactcccatgtactttttcctcagccacttgtcctttgtggacttttgctactccaccgtcatcgtgccaaatgtgctgtccagtatcttaaacaagggcaaagccatctccttcctgggatgcatggtgcaattctatttcttttgtgcctatgcaatcactgaggtcttccttttggctgtgatggcctatgaccgcttcgtggccatctgcaacccactgttgtacatggtcaccatgtcccagaatctctgtttggagctggtgtcttgttgctacctgtgtgggatggtgtgttctctgatccacttgtgtttagctcttgagatcacatcctacagatcaaatgtgattgaccacttcttctgcgatctgccccctctcttgtcccttgctnnnnnnnnnnnnnnnnnnnnactatgaatgaactgctgctgtacatcgtggccaccttcaatgagatcaccaccatcgtgatcatcctcacctcctacttgctaattctcatcaccatcctgaggatgcactctgccgagggaaggcgcaaagccttttccacctgtgcctcccacctcacagccatccttgtcttccacggaacaatccttttcacttactgccggcccagttctggcaacagtgtggatactgacaaggtggccacggtgttctacactgtagtgattcccatgctcaaccccctcatctatagcctccggaacaaggatgtgaaggaagcactcaagaaagtgttgggatctagattaccttttgaaaaactattttctt

SEQ ID NO: 2944 - protein, 192 aa, Felis catus
  MOD_RES (185)..(191): Any amino acid
NCSSVTEFILLGFAEAPELRVALFSVFLLSYGVTVLGNLGMMAVIQVSCHLHTPMYFFLSHLSFVDFCYSTVIVPNVLSSILNKGKAISFLGCMVQFYFFCAYAITEVFLLAVMAYDRFVAICNPLLYMVTMSQNLCLELVSCCYLCGMVCSLIHLCLALEITSYRSNVIDHFFCDLPPLLSLAXXXXXXXL

SEQ ID NO: 2945 - DNA, 933 bp, Felis catus
atggaattggagaacctcactgtgaagactgagttctttctcttgggatttagtgagcatccagaactctggagggttctttttgctgtgttcctttttatctactctgttaccttaatggggaacctagggatgatgtcattaatcatgaccagttcgcatttgcacacccctatgtactttttcctctgcatactgtccttcgtcgatgtatgctactcctccgtcattgcccccaaattacttgcagacttggtttccgagaaaaagaccatttcttacaagggctgtgctgcacagttatattttttctgttctttggttgacacagaatctttcctcttggctgccatggcttatgaccggtacctagccatctgcaacccactgctttatactgttattatgtccaagaggctttgctgccagcttgtgattggagcattttgggggggtaccatgagctcaattattcacactatcaataccttccatctgtctttctgctccaaagaaattaaccatttcttctgtgatatctccccactcttctctctgtcctgcactgatacttacatgcatgacattgttctggtagtttttgctggtttagtggaagctatctgtcttctaacagttcttctctcttatgtctgcatcatagcagccattcttaaaacaggttctgctgaaggaagaagaaaagggttctccacttgtgcttcccatctgactgtggtcactatttaccatggtaccctcatttttatttatttgcgccccagcgctggtcattcgctggatattgacaaagtgacctctgtgttctatacattgattatacctatgttgaatcccttaatttacagtctgaggaacaaagatgtcaaaaatgcctttaggaaagtgatcagccgaaaattgctttcttaa

SEQ ID NO: 2946 - protein, 310 aa, Felis catus
MELENLTVKTEFFLLGFSEHPELWRVLFAVFLFIYSVTLMGNLGMMSLIMTSSHLHTPMYFFLCILSFVDVCYSSVIAPKLLADLVSEKKTISYKGCAAQLYFFCSLVDTESFLLAAMAYDRYLAICNPLLYTVIMSKRLCCQLVIGAFWGGTMSSIIHTINTFHLSFCSKEINHFFCDISPLFSLSCTDTYMHDIVLVVFAGLVEAICLLTVLLSYVCIIAAILKTGSAEGRRKGFSTCASHLTVVTIYHGTLIFIYLRPSAGHSLDIDKVTSVFYTLIIPMLNPLIYSLRNKDVKNAFRKVISRKLLS

SEQ ID NO: 2947 - DNA, 921 bp, Felis catus
agtactgattatttttttcagggcacctttcacatccttattccgtaagctgtagatcagtgggtttaacattgggatgacgaccgtgtagaacacagaggccattttgtccgtgtccatagagtaactggagctgggtcggaaatacatgaacaggagtgtgccgtgaaatatggccactgcggtcaagtgggaggcacatgtagaaaaggctttgcgtctcccttccactgagttcattctgaggatggtcattatgatgtaggtgtaggagaggaggacggtgatgacgctgcaccccaccacacaaccaatgaaagtgaacatcactatctcgtttatagatgtatccgaagacgagagggacagcaagggtgggatgtcacagaaaaagtgattgatgatattggaattgcagaatgccaatcgaaacgtgcaaccggtgtggattgccgaatccacaaatcccacgatgtaggcaagggccacgagctggatgcagattctcctggacatggccattgtatacagaagtggattacagatggctgcgtaccggtcgtaagccatgacagccaacatgagacactccacatctgcgaaggccccgaaaaaatacagctgaattgcacacgagttgtatggaatcttcttttgctcagataagaagccagccagcatcttgggagacacagtggaggagtagcagacatcacagaaagacaggttgctcaggaaataatacatgggtgtgtggagcctggagtccagtttgattagcaggatcatccccagattggcaatcatggttatggcataaaccagcagaaagaacacaaagagcccctgctgcacatcttttcttccagtaagtcctaggagtatgaagtccgtcatcacagagcagttctcaccagccat

SEQ ID NO: 2948 - protein, 307 aa, Felis catus
MAGENCSVMTDFILLGLTGRKDVQQGLFVFFLLVYAITMIANLGMILLIKLDSRLHTPMYYFLSNLSFCDVCYSSTVSPKMLAGFLSEQKKIPYNSCAIQLYFFGAFADVECLMLAVMAYDRYAAICNPLLYTMAMSRRICIQLVALAYIVGFVDSAIHTGCTFRLAFCNSNIINHFFCDIPPLLSLSSSDTSINEIVMFTFIGCVVGCSVITVLLSYTYIIMTILRMNSVEGRRKAFSTCASHLTAVAIFHGTLLFMYFRPSSSYSMDTDKMASVFYTVVIPMLNPLIYSLRNKDVKGALKKIIST

SEQ ID NO: 2949 - DNA, 912 bp, Felis catus
aagttttttccgagcctctttcacatctttgttccgcaggctataaatcacagggtttaacatgggaatcacaagggtgtagaacaaggaggtcattttgtcttgatcaagagagtaggaagaactcgggcggaaatacataaagagcagggttccctggaaaattgcaacagcagttaagtgggaggtgcaggtggagaaagctttgaacctcccctcagcagagcggatctttatcactgccaggatgatataacagtaagacacaaagagccctgaaagggtaatcagctcaatgaagccaaaaatggtgaatatcactaactcattaacttgggtatctgagcaagataacaaaaggagaggtgggacatcacagaagaagtggttgatcacatttgatccacagaaacataacctgaatgataatattgtatttgcagaagcatccacaagccctaccatgtaaaccccagccatgagcagaaagcacactctgctggacatgttggccgtgtagagcaaggggttgctaatggccttgtaccgatcaaaggccatcaccgccagcagtaggcactcagaatcagcaaaggtacagaagatccagaattgcagagcacagccatagaaaggaattgactttatcttggtaatgaggcccaccagcatccggggcccaattgctgtagaataacagaggtcactgaaagagaggtggctgaggaagaaatacattggtgtgtgaagcttagaatccattctaattaacatgatcatcccgaggtttgcaataagaatgatgagataaacaattagaaatgtgacaaacagggtcactttaattccagggttattgctaattcccaggagaaggaattcattcacagaagagcaattttttccatccat

SEQ ID NO: 2950 - protein, 304 aa, Felis catus
MDGKNCSSVNEFLLLGISNNPGIKVTLFVTFLIVYLIILIANLGMIMLIRMDSKLHTPMYFFLSHLSFSDLCYSTAIGPRMLVGLITKIKSIPFYGCALQFWIFCTFADSECLLLAVMAFDRYKAISNPLLYTANMSSRVCFLLMAGVYMVGLVDASANTILSFRLCFCGSNVINHFFCDVPPLLLLSCSDTQVNELVIFTIFGFIELITLSGLFVSYCYIILAVIKIRSAEGRFKAFSTCTSHLTAVAIFQGTLLFMYFRPSSSYSLDQDKMTSLFYTLVIPMLNPVIYSLRNKDVKEARKKL

SEQ ID NO: 2951 - DNA, 928 bp, Felis catus
tattttgtttttcaatttttctaaggccctttttacgtccttgttccgtaggctataaatcagtgggtttaacatgggaatcacaagggtgtaaaacaaggaggtcattttgtcttgatcaagagagtaggaagaactcggccggaaatacatgaagatcatggtcccctggaaaattgcaacagtagttatgtgggaggtgcaggtggagaaagctttgaacctcccctcagcagagtggatcttcaggacggataggattatataacaataagagacaaggactactgaaatggtgctcagttcaatgaagccaaaaatggtgaatattgctaattcgttgagttgtgtgtctgcgcaagagagcaataggagagggggtacatcacagaagaagtgattaatcaatctcctttgatccacagaaacataaccggaatgttagtgtcgtgtgtatcaaagcatctgccgttgccagcacgtaaacccccgccatgagcaggaagcacactctgctggacatgttgaccgtgtagagcaaggggttgctaatggcctcgtaccgatcaaaggccatcactgccagcagtaggcactcagaatcagcaaacgtacagaagaccaagaattgcagagcacagccaacgaaagggattgatgtgtttttggctagaagttctaccaaagttttgggcccaattgctgtggaataacagaggtcacagaaagagaggtggctaaggaaaaagtacattggtgtgttcagctgagaactcattctaattagaataatcattccgaggtttgccaggagattagtgagataaataagcaggatggtggtgaatagagtcactttgatctcagagttgtccgtaattcccaagagaaagaattcagtcaaggaggagcagttttctttgtccat

SEQ ID NO: 2952 - protein, 175 aa, Felis catus
MDKENCSSLTEFFLLGITDNSEIKVTLFTTILLIYLTNLLANLGMIILIRMSSQLNTPMYFFLSHLSFCDLCYSTAIGPKTLVELLAKNTSIPFVGCALQFLVFCTFADSECLLLAVMAFDRYEAISNPLLYTVNMSSRVCFLLMAGVYVLATADALIHTTLTFRLCFCGSKEID

SEQ ID NO: 2953 - DNA, 934 bp, Felis catus
tcaatgaaaccaccgtctatttttaatttttttcagagctttgttcacatctttgttccggaggctgtaaatcataggatttaacatgggaatcacaagggtataaaacaaggaggtcattttgtcttgatcagagtaggaagagtaggaagaacttggccggaaatacataaagagcagggtcccctggaaagttgcaacagcagttaagtgggaggcacaggtggagaaagctttgaacctcccctcagcagagcggatctttatcactgccaggatgatctaacagtaagatgcaaagagccctgaaagggtaatcagctcagtgaagccaaaaatggtgaatatcactaactcattaacttgtgtatctgagcaagataacaaaaggagaggtgggacatcacagaagaagtcgttgatcacatttgactcacagaaacataagtgaaatattaatattgtatttacagaagcatccacaattcccatcatgtaaaccccagccgtgagcagaaagcacactctgctggacgtgttggtcgtgtagagcaaggggttgctaatgaccttgtagcgatcaaaggccatcactgccaaccatagacactcagaatctacaaaggtgcagaagatccagaattgcagagaacagccatagaaggaaattgacttgttctttgcagtgaggcctaccagcatctggggtccaattgctgtagaataacagaaggagaggtagctgaggaagaaatacactggtgtgtgaagctgggaatccattctgattaaaatgatcatcccaaggattgcaaccagaatgatgagataagcaactagaaatgtgataaatagggtcactttaattccagggttattgctaattcccaggagaaggaattcattcaaagaagagcaatttttttccatccat

SEQ ID NO: 2954 - protein, 216 aa, Felis catus
WMEKNCSSLNEFLLLGISNNPGIKVTLFITFLVAYLIILVAILGMIILIRMDSQLHTPVYFFLSYLSFCYSTAIGPQMLVGLTAKNKSISFYGCSLQFWIFCTFVDSECLWLAVMAFDRYKVISNPLLYTTNTSSRVCFLLTAGVYMMGIVDASVNTILIFHLCFCESNVINDFFCDVPPLLLLSCSDTQVNELVIFTIFGFTELITLSGLFASYC

SEQ ID NO: 2955 - DNA, 862 bp, Felis catus
tgggtttaacatgggaatcacaagggtgtagaacaaggaggtcattttgtcttgatcaagagagtaggaagaactcggccggaaatacatgaagagcaggggtcccctggaaagttgcaacagcagttaagtgggaggtgcaggtggagaaagctttgaacctcccctcagcagagtgaaccttcaggacggataggattatataacaataagagataaggactcctaaaatggtactcagttcaatgaagccaaaaaatgtgaataatgccaactcattgatctctgtatttgagcaggaaagaaggtagagtggaggtagatcacagaagaaatgattaatctcctttgatccacagaaacataaccggaatgttagtgtcgtgtgtatcaaagcatctgccgttgccagcacgtaaaccccggccatgagcaggaagcacactctgctggacatgttaaccgtgtagagcaaggggttgctaatggccttgtaccgatcaaaggccatcactgccagcagtaggcactcagaatcagcaaatgtacagaagaccaagaattgcagagcacagccaacgaaagggattgatgtgtttttggctagaaggtctaccaacattttgggcccaatagctgtggaataacagaggtcacagaaagagaggtggctaaggaaaaagtacattggtgtgttcagctgagaattcattctaattagaataatcattccgaggtttgcaaaaagattaatgagataaataataagaaacattgtaaatagggttgttttcatcccagggttattggtaattcccaagaaaatgaaatcagtcaaggatgaacaatttcctccatccat

SEQ ID NO: 2956 - protein, 268 aa, Felis catus
MDGGNCSSLTDFIFLGITNNPGMKTTLFTMFLIIYLINLFANLGMIILIRMNSQLNTPMYFFLSHLSFCDLCYSTAIGPKMLVDLLAKNTSIPFVGCALQFLVFCTFADSECLLLAVMAFDRYKAISNPLLYTVNMSSRVCFLLMAGVYVLATADALIHTTLTFRLCFCGSKEINHFFCDLPPLYLLSCSNTEINELALFTFFGFIELSTILGVLISYCYIILSVLKVHSAEGRFKAFSTCTSHLTAVATFQGTPALHVFPAEFFLLS

SEQ ID NO: 2957 - DNA, 945 bp, Felis catus
tcacgaggcatctacctttaatcgtacagctctcttagcggcatctttgacatctttatttctcaaactataaatcaatggattcagcactgggatgatgatggtgtagaacacggagataattttatcagtgttaggagaatatagatagctgggccttgagtaaatgaagaggagagtcccctgatagatggccactgaagtcaggtgagaggcacatgtggaaaaggttttcttcctcccactggaagaacggatctttaagactgagcgaaggatgaaaaagtaggagatgatgatgacaatgaaacagataatttccactgagctgccatatgtggagagaagccactcattaactgatgtgtctgtgcaggataacttaagcagtggggggaggtcacagaaaaaatgattaatgacatttttatcacagtatttcagaataaaggcaaaggacgtatgaaccagggaactcaggttgcctccaatgtaggacaatacaatcaaccatatacagatgtcccgagacatcacaaccatatacagtaaagggttacagatggcgacgtagcgatcgtatgccatggcagccaagataaaggattctgtatcagcaaaagcacagaaaaaataaaactggagggcacagccataataagagatagatttgttctctgagaggaaattgatgagcattttgggaacaatgactgaggagtaacagaggtctgcaaaggataagttgctaaggaaaaaatacatgggggtttgaaggtgagaatcagtcctgattaatatcatcagtccaatgttccctgttaaaatcataccatacagtgtcagaaacatgaggaataggacaatctgcagttcagggcgggtcggaaaccctaaaagaataaactcagtcaccaaagtgtagtttccatctatcaattccat

SEQ ID NO: 2958 - protein, 314 aa, Felis catus
MELIDGNYTLVTEFILLGFPTRPELQIVLFLMFLTLYGMILTGNIGLMILIRTDSHLQTPMYFFLSNLSFADLCYSSVIVPKMLINFLSENKSISYYGCALQFYFFCAFADTESFILAAMAYDRYVAICNPLLYMVVMSRDICIWLIVLSYIGGNLSSLVHTSFAFILKYCDKNVINHFFCDLPPLLKLSCTDTSVNEWLLSTYGSSVEIICFIVIIISYFFILRSVLKIRSSSGRKKTFSTCASHLTSVAIYQGTLLFIYSRPSYLYSPNTDKIISVFYTIIIPVLNPLIYSLRNKDVKDAAKRAVRLKVDAS

SEQ ID NO: 2959 - DNA, 935 bp, Felis catus
tcacgccatttttttaagtaatagttttctcagggctgcagtcacatccttgttcctaagactgtatatcaggggattaaacattggcgtcactgtggtatagaaaagagagagcagtctgtcagttcctgcagaatgattggacttgggccttatgtaggtaatggtagcggatccaaagaataaaaacacgaccagcaggtgggaagaacaggtggaaaaagctttggcccgtcctccggcggttggcaacttgagaatggtggaaatgattttgctgtaagagacaagtatcaacacaaaaggaagtgtgacaaacaacatagctactacatagaccgatatctcatgtacaaagaggtccccacaggctagccggaggatggggggtatgtcgcagaagaagtggttgatttggttagaattacagaaatgcagagagaaaatctgacatgtttgtcctatctggactgggactccaccgatccaggagccaatggccagttggatacacatcttctggttcatgactagagagtagtgcagagggttacaaatggccacgtagcggtcataggccattactgtcaggaggaaacactcagtggctcccaacgcgaggaagaagcacatctgggaggcacagcccagcatagaaatgcttctatcctgagtccaaaggttcaccagaatcctagggagagtgacggacacgtaacagatttccagcgaggaaagatgcgccaggaaaaaatacatgggtttctgtagtgccttgtcaagcctggttattgttattacgaggctatttccaattaagataataacgtaaatggtggagaacactccaaatagtaaccgctggaggtttggaaggtcagaaaatcccaagagaacaaattgctttatggtggaagtattatcatctgctttca

SEQ ID NO: 2960 - protein, 310 aa, Felis catus
KADDNTSTIKQFVLLGFSDLPNLQRLLFGVFSTIYVIILIGNSLVITITRLDKALQKPMYFFLAHLSSLEICYVSVTLPRILVNLWTQDRSISMLGCASQMCFFLALGATECFLLTVMAYDRYVAICNPLHYSLVMNQKMCIQLAIGSWIGGVPVQIGQTCQIFSLHFCNSNQINHFFCDIPPILRLACGDLFVHEISVYVVAMLFVTLPFVLILVSYSKIISTILKLPTAGGRAKAFSTCSSHLLVVFLFFGSATITYIRPKSNHSAGTDRLLSLFYTTVTPMFNPLIYSLRNKDVTAALRKLLLKKMA

SEQ ID NO: 2961 - DNA, 942 bp, Felis catus
ttacttatatagcaatcttctcaatgccatgatgacatccttgttccttagactgtatatcataggattaaacatgggagtcacaattgtgtagaaaagagaaagtactttgtcaattcctgctgagtgactgtgtttgggtcttaagtaagtgataacggctgatccaaagaacaacgccacgacaataagatgagaaaaacaggtggagaaggctttggcccgacttgtggctgatggcaattgaaggactgtggagatgattttgctataggagataagtatcaacagaaagggaatggtgacaatcaacacagcagctatgtagatcaacatttcactcacaaatgtgtccccacaagcaagcttgaggattggggggatgtcacagaagaagtggtcaattaaattggagccacaaaaggacagagagaaaatctggaacgtttgccctatctggactggaattccactgatccaggagccagccaccagctggatacagatcttatgattcatgactagagggtagtgcagagggttacagatggccacgtagcggtcataggccatcactgtcagcaggaaacactccgtggctcccaacacaagaatacagcacatctgtgtggcacaggcaactaatgaaattgttcttctctgggtccaaaggttcataagcattctggggagagtaactgacacatagcagatttctaaaaaggaaaaattgccaaggaaatagtacataggagtctgaagtgcaggatccaattttgttattagaaatatgatgccattactcatcacaatagtgatatagatgaccgagaacaatccaaatagaagccaccggagatggggaacatcagcaaagtccaagagaacaaattctatcagttcagttaggtttgcttctggtggtttttctttgtgttgcat

SEQ ID NO: 2962 - protein, 313 aa, Felis catus
MQHKEKPPEANLTELIEFVLLDFADVPHLRWLLFGLFSVIYITIVMSNGIIFLITKLDPALQTPMYYFLGNFSFLEICYVSVTLPRMLMNLWTQRRTISLVACATQMCCILVLGATECFLLTVMAYDRYVAICNPLHYPLVMNHKICIQLVAGSWISGIPVQIGQTFQIFSLSFCGSNLIDHFFCDIPPILKLACGDTFVSEMLIYIAAVLIVTIPFLLILISYSKIISTVLQLPSATSRAKAFSTCFSHLIVVALFFGSAVITYLRPKHSHSAGIDKVLSLFYTIVTPMFNPMIYSLRNKDVIMALRRLLYK

SEQ ID NO: 2963 - DNA, 939 bp, Felis catus
cttcgttagtagttttcttagtgctaccgtgatgtctttgttcctcagagtatatataatgggattcaaagttgggatcaaaacggtgaagaaaagagagatcaatttcccaactccttcagattgatttgatttcagttgtgtataattgatagtagccgttccatagaataagacgacaactatcaggtgagaagaacaggtggagaaggctttagccctccctttggctgatgacaatttcagaatgctggagataattttgccataggagacaacaatcaacagaaatggaaccatgacaattgccactgcaattatatagaccacaaattcattcacaagtgtgtccccacaagctagcttgagtactggggggatgtcacagaagaaatgattaattgtgttagacccacaaaagggcagagagaaaatctggcatgtttgtccaattacaaatggaaatacactgatccaggagacagtcaccagttggacacagaccttgtggttcatgattagagggtagtacagagggttacaaatggccatgtagcggtcataggccatcactgtcaggagaagacactctgagcttccaaatgtgaggaaaaaaaacatttgtgcagcacaggcaaagaaagaaatatttcctttctgagtcaataggtccatgagcattctgggcattgtgactgttacataacagatttctaagaaggagagattgccaagaaaaaaatacatgggggtctggagagcagagtcaattcttgttaccaatattatgatgctattgcacatcaggatagttaggtagatgactaaaaatatcccaaaaagagtccagtggagattgggactatcagaaaaccccaagagaacaaattccatcagtgtagtaatatttgaaattcctgtttgcaattgattctccat

SEQ ID NO: 2964 - protein, 313 aa, Felis catus
MENQLQTGISNITTLMEFVLLGFSDSPNLHWTLFGIFLVIYLTILMCNSIIILVTRIDSALQTPMYFFLGNLSFLEICYVTVTMPRMLMDLLTQKGNISFFACAAQMFFFLTFGSSECLLLTVMAYDRYMAICNPLYYPLIMNHKVCVQLVTVSWISVFPFVIGQTCQIFSLPFCGSNTINHFFCDIPPVLKLACGDTLVNEFVVYIIAVAIVMVPFLLIVVSYGKIISSILKLSSAKGRAKAFSTCSSHLIVVVLFYGTATINYTQLKSNQSEGVGKLISLFFTVLIPTLNPIIYTLRNKDITVALRKLLTK

SEQ ID NO: 2965 - DNA, 939 bp, Felis catus
cttcgttagtaattttctcagtgccaccatgatgtctttgttcctcagagtatatataatgggattcaaagttgggatcaaaacggtgtagaaaagagagatcaatttcccaactccttcagattgatttggtttcggttgtaaatacgtgatggtagccgttccatagaataagatgacaactatcaggtgagaagaacaggtggagaagactttagccctccctttggctgatgacaatttcagaatgctggagataattttgccataggagacaacaatcaacagaaatggaaccatgacaaatatcactgcaactacgtagactgctatctcattcacaaatgtgtccccacaagctagcttgagtactggggggaggtcacagaagaaatgattaattgtgttagacccacaaaagggcagagagaaaatctggcatgtttgcccaattacaactgggactccactgatccaggagacagtcaccagttggacacagaccttgtggttcatgattagaggatagtgcagagggttacaaatggccacgtagcggtcataggccatcactgtcaggagaagacactctgagcctccaaacataaggacaaaacacatttgtgcagcacaggcaaagaaagaaatatttcctttctgagtcagtaagtccatgagcattctggggatagtgactgttacataacagatttctaagaaggagagattgccaagaaaaaaatacatgggggtgtggagagcagagtcaattcttgttaccaatattatgatgctattgcacatcaggatagttaggtagatgactaaaaatatcccaaaaagagtccagtggagattgggaatatcagaaaaacccaagagaacaaattccaccagtttagtaacatttgaaattcctgtttttaatcgattctccat

SEQ ID NO: 2966 - protein, 313 aa, Felis catus
MENRLKTGISNVTKLVEFVLLGFSDIPNLHWTLFGIFLVIYLTILMCNSIIILVTRIDSALHTPMYFFLGNLSFLEICYVTVTIPRMLMDLLTQKGNISFFACAAQMCFVLMFGGSECLLLTVMAYDRYVAICNPLHYPLIMNHKVCVQLVTVSWISGVPVVIGQTCQIFSLPFCGSNTINHFFCDLPPVLKLACGDTFVNEIAVYVVAVIFVMVPFLLIVVSYGKIISSILKLSSAKGRAKVFSTCSSHLIVVILFYGTATITYLQPKPNQSEGVGKLISLFYTVLIPTLNPIIYTLRNKDIMVALRKLLTK

SEQ ID NO: 2967 - DNA, 933 bp, Felis catus
ttaaggtaacaattttctcaaggccatcatggcatccttatttctcagagtgtatatcataggattaaacattggggtgacaatggtatagaaaagagagagaaacttgtctgctctggaagaatgtttagacttgggccgtaaatatgtgatgattgcagatccaaagaacatcgccacaactgtgatatgagacgagcaggtggagaaagctttggttcgtcctgttgctgatggcaacctcagaatggtggagatgattttgatgtaggatccaagtatcaacagaaaggggatcgtaacaaacagcacagcgactgtaaagactaacatctcattcaggaatgtgtccccacaggccaacttgagtagtggagggatgtcacagaagaagtgattgatttggttagacccacaaaatggcagagagaaaatttggtatgtctgccctgtctccactggaactccagtgatccagcaggccactaccatctggacacagaccttgtggttcataactaaaggatagtgcagagggttacaaatggccacgtagcggtcataggccatcactgtcagaaggaggcactctatgtttccaagcgtaaggacaaaacccatttgtgttgcacaggcaaacaaagaaatatttcttttctgagtccaaaggtttgtgagcattctgggaagagtgacagatacaaaacagatttccaagaaggaaaaattactaaggaaaaaatacatgggcgtctgaagagcctggtcaaccctgactatgagaacaatgatgccatttcccatcagaattatcacatagacaaagaaaaatattacaaaaagaaacatttgaagattgggaatatcagaaaatcccaaaagaacaaattccatcactgaagtgagatttacttctgctgtttttttctccat

SEQ ID NO: 2968 - protein, 310 aa, Felis catus
MEKKTAEVNLTSVMEFVLLGFSDIPNLQMFLFVIFFFVYVIILMGNGIIVLIVRVDQALQTPMYFFLSNFSFLEICFVSVTLPRMLTNLWTQKRNISLFACATQMGFVLTLGNIECLLLTVMAYDRYVAICNPLHYPLVMNHKVCVQMVVACWITGVPVETGQTYQIFSLPFCGSNQINHFFCDIPPLLKLACGDTFLNEMLVFTVAVLFVTIPFLLILGSYIKIISTILRLPSATGRTKAFSTCSSHITVVAMFFGSAIITYLRPKSKHSSRADKFLSLFYTIVTPMFNPMIYTLRNKDAMMALRKLLP

SEQ ID NO: 2969 - DNA, 961 bp, Felis catus
atggaaaatgtgactgaagtcacgacatttatattgatgggcttcacaaatgattttaagctgcaagttttcctatttttcctatttctagcaatctatctttttacgatgatgggaaacttgggaatggttttattggtcattggggattctcggctccacaaccctatgtactattttctgagtgtcttatcattcctggatgcctgctactcttcagctgtcaccccaaaaatgttagtcaatttcttgtcagagaataaagccatttcattccttggatgtgcagcacagatgtttctctttgttactttcggaaccacggaatgttttatcttagctgcaatggcttatgatcgctatgtagccatctacaaccctctcctgtattcagttagaatgtcacccagggtctacgtgccgctcatagtttcctgctatgttggtggctttctgcatgctactttacacaccgtggctacctttcgtctatccttctgtgcatccaatgaaattaaacatgtcttttgtgacatccctcctcttctcgctatttcttgttctgacactcacataaaccaactgctagtcttctactttgcgggatctattgagatatccactatcctcatagtcctggtctcctatggttttattctgttggccattctgaggatgcattccgctgaagggaggcggaaggtcttttccacgtgtggctctcacctaactggagtatcaatttttcacggtacggttctcttcatgtatgtgagacctaattccagctatgctttggatcatgatatgatagtgtcagtattttacacgattgtgattcctatgctgaatcccatcatctatagtttgaggaacaaagatgtgaaagatgcaatgaaaagagtgtttggtaaaagctggtttgccaataaagtatacttttcacactaaacgttaaatt

SEQ ID NO: 2970 - protein, 316 aa, Felis catus
MENVTEVTTFILMGFTNDFKLQVFLFFLFLAIYLFTMMGNLGMVLLVIGDSRLHNPMYYFLSVLSFLDACYSSAVTPKMLVNFLSENKAISFLGCAAQMFLFVTFGTTECFILAAMAYDRYVAIYNPLLYSVRMSPRVYVPLIVSCYVGGFLHATLHTVATFRLSFCASNEIKHVFCDIPPLLAISCSDTHINQLLVFYFAGSIEISTILIVLVSYGFILLAILRMHSAEGRRKVFSTCGSHLTGVSIFHGTVLFMYVRPNSSYALDHDMIVSVFYTIVIPMLNPIIYSLRNKDVKDAMKRVFGKSWFANKVYFSH

SEQ ID NO: 2971 - DNA, 957 bp, Felis catus
tcatattacaatccattttggtaagaattttttgagtgccaccaaaacatctttgtttctcaaacaatatattatgggattaaacattggtgtcacaatgctgtaaaagagagaaagaaatttgtccattcctgttgaatggctggactttggtctcaaatacgaaatgatgcctgatccaaagaataaagccacaaccacaaggtgggaagaacacgtagagaatgccttggctcgcccagcggctgatggcagcttcaggatggttgagattattttcacataagatccaagaatcaacataaaaggaatagtgacaactagaacagcaactgtataaaccaatatctcaatcgtaaaagtatccccacaggcaagcttaagtattggaggtatgtcacagaaaaagtgattcaactgattggacccgcagaagggttgagagaagattaggtaggtgaaccctatgtgtactggaattccagtgatccaacagccagctgccaattggatacacagcctactgttcatgatgagagggtagagtaaggggttgcaaatggcgacatacctgtcgtaagccattgcagtcaaaataaagcactcggtggctccaaagaccagaaagaaatacatttgtgtagcacaggccagaaaggaaatgcttctactttgtctacaaagatctgttaataatctggggacagtgactgacacataacatatttccaaggaagaaaagttcccaaggaaaaaatacatgggagtccggagggagggatcaatctgggttattatgataatgaggctatttcccatcagaataatcacataaattatcaaaaacaccccaaaaagaaactcttggaggtcaggaacatcagaaaagccaagcaggatgaaatccattaatgtagtgtgattccctcctggaggatattgtcctttagattccat

SEQ ID NO: 2972 - protein, 318 aa, Felis catus
MESKGQYPPGGNHTTLMDFILLGFSDVPDLQEFLFGVFLIIYVIILMGNSLIIIITQIDPSLRTPMYFFLGNFSSLEICYVSVTVPRLLTDLCRQSRSISFLACATQMYFFLVFGATECFILTAMAYDRYVAICNPLLYPLIMNSRLCIQLAAGCWITGIPVHIGFTYLIFSQPFCGSNQLNHFFCDIPPILKLACGDTFTIEILVYTVAVLVVTIPFMLILGSYVKIISTILKLPSAAGRAKAFSTCSSHLVVVALFFGSGIISYLRPKSSHSTGMDKFLSLFYSIVTPMFNPIIYCLRNKDVLVALKKFLPKWIVI

SEQ ID NO: 2973 - DNA, 937 bp, Felis catus
tagttcaaaaaatttacaaagcatatcagacaaaaggagggatcctcctcttggtagtgaaattccataaagccttctttacttcctcatttctaaggctgtagatcaggggattcaacatagggatcactactgtgtagaacacagaagccactttgtcctgacccaaggagtagctggaactaggtctcagataggtatagatggcggtggcatagaacagagttatcgctgtcaagtgagaggcacacgtggagacggctttgtgcctcccctgccgtgaatgcacgtggaagacagagaagagaatgtaggagtaggaggtgaggatgatcagcagagtcccggccagattcgcaccagcaaacgtggaaatgataccctcggtaaggtgtgtgtcagagcacgagagcctaaagagtggagggctgtcacagaagaagtggtgaatgacattggaaccacagaatggcaagctgcctacataactcgtgttaaccatggagttcaagaatcctgctgtaaaagcccctgctgccattttgaggcagactgtcctggacatgatcaaagagtaaaggagggggttgcatatggccacgtaacggtcataggccattaagccaaagaggatggcttcggttgtggccaaggcgataaagaagtacaattgcaggaagcagcctgcgaaggagatggttttcgtctctgacagtaagtctaccagcatctttggggtgatggcggaggaataacaaacatccacaaaggacaggttagccaggaagaaatacatgggtgtgtgaagtcgggaatcagtgccgattaagaggatcatcccaacattccccaaaactgtaagggcgtaaatcccaaagaaaagcagaaagaggatgatccgtaactccatggtgtctgctaatcccaacaggatgaa

SEQ ID NO: 2974 - protein, 303 aa, Felis catus
FILLGLADTMELRIILFLLFFGIYALTVLGNVGMILLIGTDSRLHTPMYFFLANLSFVDVCYSSAITPKMLVDLLSETKTISFAGCFLQLYFFIALATTEAILFGLMAYDRYVAICNPLLYSLIMSRTVCLKMAAGAFTAGFLNSMVNTSYVGSLPFCGSNVIHHFFCDSPPLFRLSCSDTHLTEGIISTFAGANLAGTLLIILTSYSYILFSVFHVHSRQGRHKAVSTCASHLTAITLFYATAIYTYLRPSSSYSLGQDKVASVFYTVVIPMLNPLIYSLRNEEVKKALWNFTTKRRIPPFV

SEQ ID NO: 2975 - DNA, 939 bp, Felis catus
atgttggagagtaattataccatgccaactgagtttcttcttgttggattcacagattatttgcctctcagggtcacactcttcttggtatttcttatagtctatacactaactgtggtgggaaatctgggtttaataatcttagttcatatcaatccgagccttcaaacccccatgtattattttcttagcaacctgtctttcttagacatctgctattctaccgcgatcgctcctaaaatgctggtgaattttttagcatccaggaaaagcatctctccctatggctgtgcactacaaatgtttttctttggttgctttgctgatgctgagtgcctcattctggcagcaatggcctatgaccgctatgcagccatctgtaacccattgctctattctacccttatgtcgaggagagtctgtatctgcttcgttgtgttggcgtacttcagcgggagtatgacttccatggtacatgtctgcctcacattcaggctgtcattttgtggctctaatattgtcaatcatttcttctgtgatatcccacctcttctggctttatcatgcacggacatccatgtcaatgagcttctgctctttgccttatgtggtttcatccagaccagcacttttgtggtcatatttatctcttacttctgtatcctcatcactgttttgagcattaaatcctcagggggcaggagcaaaacgttctccacttgtacttcccatttcatagcggtctccttgttctacggaacactcctgtttatgtacttacgtcccaccactgactattccctggacactgacaaggtagttgcagtgttttatactgtggtctttcccatgtttaacccaataatatacagtttcagaaacagggatgtaaaaaatgccctcaaaaagctattagaaagaaactggactttcaaatga

SEQ ID NO: 2976 - protein, 312 aa, Felis catus
MLESNYTMPTEFLLVGFTDYLPLRVTLFLVFLIVYTLTVVGNLGLIILVHINPSLQTPMYYFLSNLSFLDICYSTAIAPKMLVNFLASRKSISPYGCALQMFFFGCFADAECLILAAMAYDRYAAICNPLLYSTLMSRRVCICFVVLAYFSGSMTSMVHVCLTFRLSFCGSNIVNHFFCDIPPLLALSCTDIHVNELLLFALCGFIQTSTFVVIFISYFCILITVLSIKSSGGRSKTFSTCTSHFIAVSLFYGTLLFMYLRPTTDYSLDTDKVVAVFYTVVFPMFNPIIYSFRNRDVKNALKKLLERNWTFK

SEQ ID NO: 2977 - DNA, 929 bp, Felis catus
atggcaggttggaaccagacaggggtgaaggaattccttctggtaggtttaactgaaaaccctaatttgcagatccctctctttttccttttctcccttatttattccatcactctggcaggtaattgggggatgattatcttgatctggttaaatacccaacttcatacgccaatgtactttttccttagcaacctctctttttgtgatatctgctactctactgtctttgctccaaagatgttggtcaattttctatcaaaacacaaagctagcacattttctggttgtgttctacagagtttcttttttgcagtttatgtaaccacagagggcatccttctgtctatgatggcttatgaccgctatgtggcaatagctaatcccttgtcatatacactcataatgacccaaaaggtttgtatgcagatggtccttgcgtcatacttgggtgggctcattaattcgttgacacacacaataggtttgctcaagctagatttctgtggtcctaacatcgtgaatcattatttctgtgacattccccctcttctgagactctcttgctctgatgcccatgacaatgagatgctacttttagttttctctggggtcattgcaatgttcactttcactatcatcatggtctcttatacgtgcatcatcattgccatccagagaatccgctcagctgaggggaggcacaaagccttctccacttgcgcctctcacctcactgctgtgaccttattctatgggtctgtaacctttagttacatccagccaagttctcagtattctctggaacaggagaaagtctctgctgtgttttatacattggttatccccatgctgaacccactgatttatagcttacgcaataaggatgtaaaagaggcagcaaaaaggtcaatgtggtggaagagaac

SEQ ID NO: 2978 - protein, 310 aa, Felis catus
MAGWNQTGVKEFLLVGLTENPNLQIPLFFLFSLIYSITLAGNWGMIILIWLNTQLHTPMYFFLSNLSFCDICYSTVFAPKMLVNFLSKHKASTFSGCVLQSFFFAVYVTTEGILLSMMAYDRYVAIANPLSYTLIMTQKVCMQMVLASYLGGLINSLTHTIGLLKLDFCGPNIVNHYFCDIPPLLRLSCSDAHDNEMLLLVFSGVIAMFTFTIIMVSYTCIIIAIQRIRSAEGRHKAFSTCASHLTAVTLFYGSVTFSYIQPSSQYSLEQEKVSAVFYTLVIPMLNPLIYSLRNKDVKEAAKRSMWWKRT

SEQ ID NO: 2979 - DNA, 939 bp, Felis catus
atggctgatgataatttgacattggttacagagtttatccttttgggactgacagaccgtcctgaactgaaagtggtcctctttacgccgttccttctgatctacaccatatctttggtggggaatataggaatgctctttctaatccaaataactcccaaactccacacacccatgtatcatttccttagctgcctgtcatttgttgatgcctgttattcgtccgtctttgcaccgaaaatgctgctcaacttctttgctgaacgggagacaatctcattctctgcatgcatcgtgcaatattttttctttgtgtcactccttaccactgagggcttcttgctggcggcaatggcttatgaccgctacgtggccatcgtgaaccctttactttatacagtggcgatgactaaaatagtttgcgttgtcctggtcattgggtcatgtgtaggaggcttaatcaactcgttgacacacacaattggcttggtgaaattgtctttctgtgggccaaacatcatcagtcacttcttctgtgaccttcccccactgttgaagctgtcgtgttctgacacgtccctgaatgaactgttgcttttaatcttttctggaattattgccatcgtcactttcttgactgtgatgatctcctacatcttcattgttgccgccatcctcaggatccgctcagcagcaggaagacaaaaagccttctctacctgtgcttcgcatctaacggccgtgactttattctatggctctataagctttagttacattcaaccaagttcccaatattccttagaacaagagaaggtggtgtctgtgctttataccttggtgattcctatgttaaacccaatgatttacagcctgaggaataaggaagtaaaggatgccgtgaaaaaggctatagaaatgaaatacttcccttgttaa

SEQ ID NO: 2980 - protein, 312 aa, Felis catus
MADDNLTLVTEFILLGLTDRPELKVVLFTPFLLIYTISLVGNIGMLFLIQITPKLHTPMYHFLSCLSFVDACYSSVFAPKMLLNFFAERETISFSACIVQYFFFVSLLTTEGFLLAAMAYDRYVAIVNPLLYTVAMTKIVCVVLVIGSCVGGLINSLTHTIGLVKLSFCGPNIISHFFCDLPPLLKLSCSDTSLNELLLLIFSGIIAIVTFLTVMISYIFIVAAILRIRSAAGRQKAFSTCASHLTAVTLFYGSISFSYIQPSSQYSLEQEKVVSVLYTLVIPMLNPMIYSLRNKEVKDAVKKAIEMKYFPC

SEQ ID NO: 2981 - DNA, 934 bp, Felis catus
atggccaacagaaatgtcagtgtggtaactgaattcatcctccttgggctgaccgataaccctgaactgaatactgtcctttttgtgctgtttctctccatttattttgtcaccgtggtgggcaatgtttggattatagcaataatctgggctagtacccagctccattcccccaaatacttcttcctttgccagctggctttcttggatttctgctattcgtcagtctttattcctaaaatgttggtgaattacctagcaggacagaaagtcatctcctatcacggttgcctccttcagtattcctttgtcagcatgatcctgaccactgaatgtttcctgctggcggccatggcctatgaccgctatgtcgccatttgccgcccgcttcactacaaaggcctcatgacccccacgttctgcacccacttggtggctgcttgctacctgctaggttctgccagctcactcacccacctgagaggcttgctcagcctgtctttctgtgggcccaacatcatcaaccattacttctgtgacatcccactgctctttcaactgtcctgttcggacacccaacacaacaagattttacttaccgtcctctctggaatgacatcggtgaccaccttcctgatggtggttggttcctatgtgggaatcctgctcactgtcctgaagtcaccctccacaaggagcagatataaagcgttctccacgtgtgtatctcacctaacagtagtgactctcttctacggaacagtgatatttacttatctgggaagcagttccagctccgcaccagatagagccaaaatcctgtccatgttttacacccttttgctgccaatcctaaatttcctgatatacagtgtgagaaacacagaggccaacgaagcaatgaaaagaattattgtgagaaaaatatttgctc

SEQ ID NO: 2982 - protein, 312 aa, Felis catus
  MOD_RES (312)..(312): Any amino acid
MANRNVSVVTEFILLGLTDNPELNTVLFVLFLSIYFVTVVGNVWIIAIIWASTQLHSPKYFFLCQLAFLDFCYSSVFIPKMLVNYLAGQKVISYHGCLLQYSFVSMILTTECFLLAAMAYDRYVAICRPLHYKGLMTPTFCTHLVAACYLLGSASSLTHLRGLLSLSFCGPNIINHYFCDIPLLFQLSCSDTQHNKILLTVLSGMTSVTTFLMVVGSYVGILLTVLKSPSTRSRYKAFSTCVSHLTVVTLFYGTVIFTYLGSSSSSAPDRAKILSMFYTLLLPILNFLIYSVRNTEANEAMKRIIVRKIFAX

SEQ ID NO: 2983 - DNA, 918 bp, Felis catus
atgactgggaacaatttcactgagatcactctcttcatcctctctggatttgcaaatcacccggaactacaagtcagtcttttcttaatgttcctctttatttatctgttcactgttctggggaaccttgggctgatcatgttaatcagaattgactctcatcttcgcacacctatgtacttttttcttagcaacttagcatttattgacatattttattcttccactgtaacacccaaggcgctggtaaatttccaatccaaacagaaaaccatctcttttgttgcctgctttgttcagatgtacttttttgtgggtttggtgtgtagtgagtgttttcttttgggatcaatggcctatgaccgctacgtagcaatctgcaatcccttattgtactcagtggttatgtcccggaaagtgtgcaacgggctgggagtcatgccatatgcaataggcttcacgaattctctgatatccgtctgtgtgataagcagcttggcattctgtgattccagcatcaatcatttcttctgtgataccacagctcttttggccctgtcttgtgcggatgcgttcagcacagaaatggtgatctttgtcttagctgggaccacccttcttagctctctgctcatcatcacagtcacttacgttgccatcatctcggccattctcaagatccagtctgcagcaggcagacagaaggccttttccacctgtgcttcccacctcatgggcgtcactatcttctatgggtccctgattttcacatatttgcagcctgataacacatcatccctgacccaggcacaggtggcgtccgtattctataccatcgtcattccgatgttgaatccactgatctatagtctgaggaacagagatgtgaaaaatgctctcctgagagtcatgcataga

SEQ ID NO: 2984 - protein, 306 aa, Felis catus
MTGNNFTEITLFILSGFANHPELQVSLFLMFLFIYLFTVLGNLGLIMLIRIDSHLRTPMYFFLSNLAFIDIFYSSTVTPKALVNFQSKQKTISFVACFVQMYFFVGLVCSECFLLGSMAYDRYVAICNPLLYSVVMSRKVCNGLGVMPYAIGFTNSLISVCVISSLAFCDSSINHFFCDTTALLALSCADAFSTEMVIFVLAGTTLLSSLLIITVTYVAIISAILKIQSAAGRQKAFSTCASHLMGVTIFYGSLIFTYLQPDNTSSLTQAQVASVFYTIVIPMLNPLIYSLRNRDVKNALLRVMHR

SEQ ID NO: 2985 - DNA, 917 bp, Felis catus
agaaagaataacacacatgtgcctgacttcatccttatggggctgacagattctgaagaggtccagctggtccttttcatgctgtttctcctgatatacctggttactgtgctgggaaatgcagggatgatattgatcatccgcctggatctccagcttcacacccccatgtattttttcctccgtcacctgtcatttcttgacctcagttactcaactgtcatcacacctaaaaccttacagaacttactgacttccaccaagtatatttcatacacgagctgcttcacccagatgtccttttttgtcttcttgggtgccactgaatgtttccttctctcctcaatggcctatgatcgctatgtcgctatctgcaatcctctgcactacccagtggttatgtcctcaaggttctgctctcacctcatctttgggtcctatatgattggctttgtggactcctttgtcaatgggctttgcatgagcaggttgcatttctgcgactccaatgtaatccatcactttttctgtgacacaaccccagttttagccttgtcttgcactgacacacatgacattgaaatcatgatatttattgtcgctggctccactctaatggtgtctcttatcacaatatctgtgtcctatgtgtccattctgtctactatcctgaaaattacttccacttcaggaaagaaaaaagccttctctacttgtgcctctcatctcctgggagtcgccatcttttatggcactatgatttttacttatttaaagccaagtaagtcttattccttgggaaaggatcaagtggcttctgttttttatactattgtgatccccatgctgaatccactcatttatagtctcaggaacaaagaagtgaaaaacgctctccttagagtcatgtggaaggg

SEQ ID NO: 2986 - protein, 306 aa, Felis catus
RKNNTHVPDFILMGLTDSEEVQLVLFMLFLLIYLVTVLGNAGMILIIRLDLQLHTPMYFFLRHLSFLDLSYSTVITPKTLQNLLTSTKYISYTSCFTQMSFFVFLGATECFLLSSMAYDRYVAICNPLHYPVVMSSRFCSHLIFGSYMIGFVDSFVNGLCMSRLHFCDSNVIHHFFCDTTPVLALSCTDTHDIEIMIFIVAGSTLMVSLITISVSYVSILSTILKITSTSGKKKAFSTCASHLLGVAIFYGTMIFTYLKPSKSYSLGKDQVASVFYTIVIPMLNPLIYSLRNKEVKNALLRVMWKG

SEQ ID NO: 2987 - DNA, 931 bp, Felis catus
aattgataaaccaatttttttgaaacactcttttcattgcctcttttacatctttgttccttaaactgtagatgatgggattcagcatgggaatcacaatgctgtaaaacattgacactatcacgtcatggtccagagcatagctggaactcggtctcacatacatgaagaggatggttccatgatatattgacactccagttaggtgagagccacatgtagaaaagactttccgcctccctgcagcagaatgaatcttcagaatggccaacaaaatgaaaccataggagatcagaactgtcaggatagtgacgatctcaatggagcccacaaggtagaagagcaggagctggtttgtgtgagtgtcagaacaagaaatggcgaggagaggagggatgtcacaaaagacatgtctaatttcattggatgcgcagaaggacaggctgaatgtggccactgtgtgtacggaagcatgcaaaatgccacccacgcaggaagcaatgatgagtggcacatagactctgggtgacatgctcactgagtacaggagagggttgtagatggcgacatagcggtcatatgccatcgcagccaagagaaagcattctgtggtcccaaaggtaacagccagaaacatctgtgttgcacatccaaggaatgaaatgattttattctttgacatgaaatctactaacatatttggagtaataactgaggaaaaacaagcatccacagatgataacacacttagaaaatagtacatgggattgtggagccgggaatccccaatgactaatgaaactaaaaccaaattccccatcatagtaaagaggtagattgctagaaacaggaagaataagattgtctgcagctcaagcttatctgtgaagcccttcagtacaaatatggtgacttccgtgtgattcttcat

SEQ ID NO: 2988 - protein, 311 aa, Felis catus
  MOD_RES (311)..(311): Any amino acid
MKNHTEVTIFVLKGFTDKLELQTILFFLFLAIYLFTMMGNLVLVSLVIGDSRLHNPMYYFLSVLSSVDACFSSVITPNMLVDFMSKNKIISFLGCATQMFLAVTFGTTECFLLAAMAYDRYVAIYNPLLYSVSMSPRVYVPLIIASCVGGILHASVHTVATFSLSFCASNEIRHVFCDIPPLLAISCSDTHTNQLLLFYLVGSIEIVTILTVLISYGFILLAILKIHSAAGRRKVFSTCGSHLTGVSIYHGTILFMYVRPSSSYALDHDVIVSMFYSIVIPMLNPIIYSLRNKDVKEAMKRVFQKNWFINX

SEQ ID NO: 2989 - DNA, 939 bp, Felis catus
tgaaaatgtattttacttaggaaccaatttttaccaattttttcattgcttcttttacatctttgttccttaaactgtagatgatgggattcagcatgggaatcacaatcgtgtaaaatgttgagactatcatgtcatggtccagagcatagctggaactcggtctcacgtacgtgaagaggatggttccatgatatattgacactccggttaggtgagagccacatgtagaaaagactttctgcctccctgcagcagaatgaatcttccgaatggccaacaaaatgaaaccataggagatcagaactgtcaggatagtgacgatctcaatggagcccacaaggtagaagagcaggagctggtttgtgtgagtgtcagaacaagaaatggcgaggagaggagggatgtcacaaaagacatgtctaatttcattggatgcgcagaaggacaggctgaatgtggccacggtgtgtatggaagcatgcaaaatgccacccacgtaggaagcaacgatgagtggcacatagactctgggtgacatgctcactgagtacaggagagggttgtagatggcgacatagcggtcatatgccattgcagccaagagaaagcattctgtggtcccaaaggtaacaaagagaagcatctgcgctgcacatccaacataggaaatggctttattctctgcgaggaaattgaccaacatttttggggtgcaactgaagaataacaggcatccaggaaagacaatacgctcagaaagtagtacatggggttgtgtagccgagaatccccaatgactaatagaactagccccaaatttcctaccagagtaaaaaggtagattgctagaaatagtaaaaagaggaagatttgcacctcaaaatcatctgtgaaacccgtcaatataaacatggtgactttggtcacattttccat

SEQ ID NO: 2990 - protein, 131 aa, Felis catus
MENVTKVTMFILTGFTDDFEVQIFLFLLFLAIYLFTLVGNLGLVLLVIGDSRLHNPMYYFLSVLSFLDACYSSVAPQKCWSISSQRIKPFPMLDVQRRCFSLLPLGPQNAFSWLQWHMTAMSPSTTLSCTQ

SEQ ID NO: 2991 - DNA, 928 bp, Felis catus
atgaagaatgtcactgaagtcaccacatttgtactgaagggcttcacaaacaaccttgaactacagatcatcttattcttcctgtttctaacaatctacctctttactctgatgggcaacttaggactggttgtattggtctttggggattcccggctccacaaccccatgtactattttctaagtgtgttatcatctgtggatgcctgctattcctcagtaattaccccaaatatgttagtagatttcatgtcaaagaataaagtcatttcattccttggatgtgcaacacagatgtttctggctgttacctttgggaccacagaatgctttctcttggctgcaatggcatatgaccgctatgtcgccatctacaaccccctcctgtactcagtgagcatgtcacccagagtctatgtaccactcatcgctgcttcctttgttggtggcattttgcatgcttgtgtacacaccatggccacattcagcctgtccttctgcgcatccaacgaaattagacatgtcttttgtgacatccctcctctcctcgccatttcttgttctgacactcacacaaaccagcttctactcttctactttgcagggtctattgagatatttactctattgatagtcctgacctcctatggttttattatgttcataattctaaggatgcattctgctgaaggaagacgaaaaatcttttctacatgtggttctcacctaactggagtgtcagtttttcacggtacagttctcttcatgtacgtgaaacctaattccagctatgatttggatcatgacatgatagtgtcagtattttacagcattgtgattcccatggtgaatcccatgatctatagctggaggaacaaagatgtaaaagacgcaatgcagaaagtgtttaagaaaaattgatttatca

SEQ ID NO: 2992 - protein, 306 aa, Felis catus
MKNVTEVTTFVLKGFTNNLELQIILFFLFLTIYLFTLMGNLGLVVLVFGDSRLHNPMYYFLSVLSSVDACYSSVITPNMLVDFMSKNKVISFLGCATQMFLAVTFGTTECFLLAAMAYDRYVAIYNPLLYSVSMSPRVYVPLIAASFVGGILHACVHTMATFSLSFCASNEIRHVFCDIPPLLAISCSDTHTNQLLLFYFAGSIEIFTLLIVLTSYGFIMFIILRMHSAEGRRKIFSTCGSHLTGVSVFHGTVLFMYVKPNSSYDLDHDMIVSVFYSIVIPMVNPMIYSWRNKDVKDAMQKVFKKN

SEQ ID NO: 2993 - DNA, 948 bp, Felis catus
atggcccaagggaatctcaccccagtgactgagttcattctcacaggagtctcagacctcccagagctccagattccactcttctttgttttcctggtgatctatgggttcactgtggcagggaacctgggcatcatcaccctcaccagtgttgactctcaacttcaaacccccatgtacttcttcctcaggcacttggctatcatcaatcttggtgattctactgtcattgccccaaaaatgctggttaacttcttggcttcaaaaaagaccatatcctactatggatgtgcagcccaactgggtgggttcttagtctttattgtggctgagattttcatgctagctgtaatggcctacgaccgctacgtggctatttgcaaccccctgctctacggggtggtggtatctccacagatctgtctgctgctggtatccctcacatacctctacagtctgaccacagcactgaccgtcacctcctgtgtgttctctgtatcatactgctcttccaatgtaatcaatcatttttactgtgataatgtccctttgttggcattgtcctgttctgatacttacattccagaaacagcagtgtttaccttttcagggaccaatttgcttttctctatgattattgttctaatttcctatttcaacatcgtccttgccattttgaggatacgttcctcagagggtcgacaaaaagccttttccacctgtgcctcccacatgatggctgtcactgtgttctacgggacccttctcttcatgtatttgcaaccaaggagcaaccactcattggatactgataaaatggcctctgtcttctacaccctggtgatacccatgctgaatcccctcatttacagcctaaggaacaaggatgtgaaggatgcattgaagagtttcctaaataaggcgtgtcagtctttcaaattcatgtaa

SEQ ID NO: 2994 - protein, 315 aa, Felis catus
MAQGNLTPVTEFILTGVSDLPELQIPLFFVFLVIYGFTVAGNLGIITLTSVDSQLQTPMYFFLRHLAIINLGDSTVIAPKMLVNFLASKKTISYYGCAAQLGGFLVFIVAEIFMLAVMAYDRYVAICNPLLYGVVVSPQICLLLVSLTYLYSLTTALTVTSCVFSVSYCSSNVINHFYCDNVPLLALSCSDTYIPETAVFTFSGTNLLFSMIIVLISYFNIVLAILRIRSSEGRQKAFSTCASHMMAVTVFYGTLLFMYLQPRSNHSLDTDKMASVFYTLVIPMLNPLIYSLRNKDVKDALKSFLNKACQSFKFM

SEQ ID NO: 2995 - DNA, 971 bp, Felis catus
tcccacagcattcttccttcatggccaggatgaaccaaccaaatcaaacagtgctaacagaattcatcctaatgggaatcacagaccggccagggctgcaggctcccttctttggactcttcctcagcatctatgtgatctcagtggtgggcaacctgagcatgatcatcctcaccaaggtggactccaggctacaaacacccatgtacttcttcctcagacacctggctctcactgatctgggttattcaacaactataggaccaaaaatgttagtcaatttcatagctaatcaaaacacaatcccctataactggtgtgccacacagctggctttcttcatcttgttcatcatcagcgagcttttcattctgtcagcaatggcctatgaccgctatgtggccatctgtcatcctctgctttatatggttgttatgtcacaaaaggtgtgctgggtgctggtggccgtcccctatgtctacagtgcctttctttctctgataatcaccataaagatttttatgtcatccttttgtgaccataatgtcattagacatttttattgtgacaatcttcccttattaactttgttatgctccagcacacgtgacattgagttgataatactgatcttttcagcatttaatttggtgtcttctcttctgatagtgcttgtctcctacatcttaatcctgatggccatcctcagcatgaactctgcacagggcaggcacaaggctttctccacctgtggatcccatatgacagtggtcgttgtattatatgcaactctattcttcatgtacgtgcaacccaaatccagtcattcctttgatactgataaaattgcctctgtattttatactttgataatacctatgctgaatcccatgatctacagtttgaggaacaaagaggtaaaaggtgccctgcgtcggatatggaaaaatctgcacaaactgcctatgtag

SEQ ID NO: 2996 - protein, 316 aa, Felis catus
MARMNQPNQTVLTEFILMGITDRPGLQAPFFGLFLSIYVISVVGNLSMIILTKVDSRLQTPMYFFLRHLALTDLGYSTTIGPKMLVNFIANQNTIPYNWCATQLAFFILFIISELFILSAMAYDRYVAICHPLLYMVVMSQKVCWVLVAVPYVYSAFLSLIITIKIFMSSFCDHNVIRHFYCDNLPLLTLLCSSTRDIELIILIFSAFNLVSSLLIVLVSYILILMAILSMNSAQGRHKAFSTCGSHMTVVVVLYATLFFMYVQPKSSHSFDTDKIASVFYTLIIPMLNPMIYSLRNKEVKGALRRIWKNLHKLPM

SEQ ID NO: 2997 - DNA, 896 bp, Felis catus
acaaacacaatctaacactgttgaaagaattcattctaatgggaatcacaggactccctgagctgcaggctccattatttggactactcctcactgtatatctggtctcagtcgtgggtaatctgggtttgatcatcctcaccaagatagactctaggctacaaacacccatgtacttcttcctcagacacctggctttcactgatcttggttattcaacagctgtgggacccaaaatgctagtaaattatgctgtagatcaacatacaatctcctttaatgggtgtgccacccaactcacttttttcaatatttttatcattaatgaaattttcattctgtcggcaatggcctatgaccactatgtggccgtctgtaaccctctgctctacacagctgttatgtcacaaagattatgtcaggtgctagtggtaatgccttgtctctatagtgtctctttgtctttgttgaccatcatgaaaattttcctttcatcatttagtgaatataatgtcatcaggcatttctactgtgacagtctaccattgatagctttgctctgttcaggcaccgatgaaattagattgataattctgatcttttctgcttttaatttggtgtcatctcttctcacagtccttgtgtcctacattctaatctctgttgccatcttcaggatgaactctgcagaaggcaggcacaaggctttctccacctgtggatcccatctggcagtgattgccttattctatggcactctattctttatgtatgtgcagccgaaatctactcattcctttgatactgataatatggccgccttattttacatgttggttatacccatgctgaatccaatgatctacagcttgaggaacaaagaggtgaaaaatgcc

SEQ ID NO: 2998 - protein, 298 aa, Felis catus
KHNLTLLKEFILMGITGLPELQAPLFGLLLTVYLVSVVGNLGLIILTKIDSRLQTPMYFFLRHLAFTDLGYSTAVGPKMLVNYAVDQHTISFNGCATQLTFFNIFIINEIFILSAMAYDHYVAVCNPLLYTAVMSQRLCQVLVVMPCLYSVSLSLLTIMKIFLSSFSEYNVIRHFYCDSLPLIALLCSGTDEIRLIILIFSAFNLVSSLLTVLVSYILISVAIFRMNSAEGRHKAFSTCGSHLAVIALFYGTLFFMYVQPKSTHSFDTDNMAALFYMLVIPMLNPMIYSLRNKEVKNA

SEQ ID NO: 2999 - DNA, 942 bp, Felis catus
atggaaaaacacaatctgacagtgtttaatgaatttattctcatgggaatcacacaacgtcctgagctgcaggctccattatttgggctcttcctcatcatctatgtgatctcagtggtgggcaacctgggcctgatcatcctcgccaaggtggactccaggctacaaacacccatgtacttcttcctcaaacacctggctctcactgatctgggttattcaacaactgtgggacccaaaatgttagcaagttttgttgtggaagaaaacacaatttcctatcatttgtgtgccacacagggagcattctacattatgttcatcgttagcgagcttttcattctgtcggctatgtcctatgaccgctatgtggccatctgtaatcctctgctctatccagtcatcatgtcacaaagggtgtgtcaggtgctgatgacaatcctctatctctacagcacatttatggctctactagtcaccataaggatttttagttcatccttctgtggttacaatgtcatcagccatttctactgtgactgtcttcccttgctatccttgctctgctcaaacatgcatgaaattgaattgatgattttggctttctcagtttttaatttgatgtcctcccttctgatggttgttgtgtcttacctgctgatcctactagccatagtcaggatgaactcagctgagggtaggcacaaagccttttctacatgtgggtcccacctgacagtggccacagtgttttatgggactatgatatttatgtatgcacaacctgagtccagtcattcctttgacactgataaaatggcgtccatattttacacccttgttatccccatgttgaatcccatgatctatagtctgaggaacaaagatgtaaaatgtgctttccataggatatggaaaaagttatgaggtaccttttcttaa

SEQ ID NO: 3000 - protein, 308 aa, Felis catus
MEKHNLTVFNEFILMGITQRPELQAPLFGLFLIIYVISVVGNLGLIILAKVDSRLQTPMYFFLKHLALTDLGYSTTVGPKMLASFVVEENTISYHLCATQGAFYIMFIVSELFILSAMSYDRYVAICNPLLYPVIMSQRVCQVLMTILYLYSTFMALLVTIRIFSSSFCGYNVISHFYCDCLPLLSLLCSNMHEIELMILAFSVFNLMSSLLMVVVSYLLILLAIVRMNSAEGRHKAFSTCGSHLTVATVFYGTMIFMYAQPESSHSFDTDKMASIFYTLVIPMLNPMIYSLRNKDVKCAFHRIWKKL

SEQ ID NO: 3001 - DNA, 942 bp, Felis catus
atggaaaaagataatctaacagggctgaatgaattcattctcatgggaatcacagaccgtcctgagctgcaggctccattatttgggctcttcctcatcatctatgtgatctcagtggtgggcaacctgggcatgatcatcctcaccaagatggactccaggctacaaacacccatgtacttcttcctcaaacacctggctctcactgatctgggttattcaacaactgtaggacccaaaatgctagtcaattttgttgtggatcaaaatacaatcccctattatttttgtgctatacagctcgctttctttcttgtgttcatcattagtgaacttttcattctgtcagcgatgtcttatgatcgctatgtggccatctgtaaccctctgctctacccaatcgtcatgtcacaaagtgtgtgtcaggtgctagtggcaatcccctatctctacagtgcatttgtgtctcttctagtcaccatgaagatttttagttcatccttctgtggctacaatgtcattagtcatttctactgtgacagtctccccttgatatctttgctttgctcaaatacacatgaaattgaactgattattctgatcttagcaggctttaatttgattttttcccttttgatagttattgtgtcttacctcctgatccttgtagccatcgtcaggatgaactcagctgagggtaggcacaaggccttctccacctgcgggtcccacctgacagtggccacagtgttctatgggactctgatatttatgtatgtgcaacctgagtccagtcattcctttgacactgataaagtggcgtccatattttacacccttgttatccccatgttgaatcccttgatctatggcttgaggaacaaggatgtaaaatgtgctgtacaaacaatgtggaaaaagctatgtaatcttttttcttaa

SEQ ID NO: 3002 - protein, 313 aa, Felis catus
MEKDNLTGLNEFILMGITDRPELQAPLFGLFLIIYVISVVGNLGMIILTKMDSRLQTPMYFFLKHLALTDLGYSTTVGPKMLVNFVVDQNTIPYYFCAIQLAFFLVFIISELFILSAMSYDRYVAICNPLLYPIVMSQSVCQVLVAIPYLYSAFVSLLVTMKIFSSSFCGYNVISHFYCDSLPLISLLCSNTHEIELIILILAGFNLIFSLLIVIVSYLLILVAIVRMNSAEGRHKAFSTCGSHLTVATVFYGTLIFMYVQPESSHSFDTDKVASIFYTLVIPMLNPLIYGLRNKDVKCAVQTMWKKLCNLFS

SEQ ID NO: 3003 - DNA, 943 bp, Felis catus
atggaaacacataatctaacaatgctcaatgaattcattctcatgggaatcacagaccgtcctgagctgcaggctccattatttgggctcttcctcatcatctatatgatctcagtggtgggcaacctgggcatgatcatcctcacccagatggactccaggctgcaaacacccatgtacttcttcctcagacacctggctctcaccgatctgggttattcaacaactgtaggacccaaaatgctagtcaattttgttgtggatcaaaatacaatctcctgttatttttgtgctatacagctcgctttctttcttgtgttcattgttagtgaactttttattctaacagcaatgtcctacgaccgctatgtggccatctgtcaccctctgcgctatccagtcatcatgtcacaaagggtgtgtcaggtgctggtggccatcctctatctctacagcacatttgtgtctcttatagtcaccatcaagatttttagttcgtccttctgtggctacaatgtcattagtcatttctactgtgacagtctccccttgatatctttgctttgctcaaatacacatgaaactgaaatgattattctgattttagccggttttgatttgatttcatcccttttgatagttattgtgtcttacctcctgatccttgtagccatcgtcaggatgaactcagctgagggtagacacaaggctttttctacctgtgggtcccacctgacagtggccacagtgttttatgggactctgatatttatgtatgtgcaacctgagtccagtcattcctttgacactgataaagtggcatccatattttacacccttgttatccccatgttgaatcccttgatctatagcttgaggaacaaggatataaaatatgcaggacaaaggatgtggaaaaaaatatgtaattcttttttcttaa

SEQ ID NO: 3004 - protein, 315 aa, Felis catus
  MOD_RES (315)..(315): Any amino acid
METHNLTMLNEFILMGITDRPELQAPLFGLFLIIYMISVVGNLGMIILTQMDSRLQTPMYFFLRHLALTDLGYSTTVGPKMLVNFVVDQNTISCYFCAIQLAFFLVFIVSELFILTAMSYDRYVAICHPLRYPVIMSQRVCQVLVAILYLYSTFVSLIVTIKIFSSSFCGYNVISHFYCDSLPLISLLCSNTHETEMIILILAGFDLISSLLIVIVSYLLILVAIVRMNSAEGRHKAFSTCGSHLTVATVFYGTLIFMYVQPESSHSFDTDKVASIFYTLVIPMLNPLIYSLRNKDIKYAGQRMWKKICNSFFLX

SEQ ID NO: 3005 - DNA, 944 bp, Felis catus
ttaacaggggaaatgtttcatctctatggcccttttcacagcatcctttacctctttgttcctcagactgtaaataagtgggtttaacatgggaatcactagtgtatagaacacagaaaccaccttctcctgctccacagaatactgggaacttggctgaatgtaactaaagcttaaggtaccatagaatatggtcacagaagtcaggtgagaggcacaggtggagaaggctttctgtctacctgctgctgaactgatcctcaggatagtgataaaaatgaaaatgtaggaaatgaccacaatcaaaaaagtagccatggcaatgactccagaaaaagttaagagcagcaactcattcttggatgtatcagaacacgacagctttagcagtgggggaacatcacagaagaagtggctaacaacattggacccacaaaaggacagtcttcccaagcttattgtgtgtatcaatgagttgagcattccaccgacaaatgacccagtgaccagccctacacacttccttttagacatgactacactgtaaagcaaagggttggcaatggccacatagcggtcataggccatcaatgacagcaagaagccttctgtggtgataaacaccccaaaaaacaaatgctgcactatgcaggcagataatgagatggtttccctcacaaccaagaagttgatcagcattttcggtgcaataacagatgaatagcaggcatctataaatgaaaggcagcttaggaaaaagtacatgggtgtgtggagcttgggagtgatttggattaagaaaatcatgcccagattccctgccaaggtaattgcataaatcaccaagaacaacacaaaaagcatgattttcaggtcagcattatctgtcaatcccaaaagaataaattcagtaacagctgtgaaattttcttcggccatttgtt

SEQ ID NO: 3006 - protein, 312 aa, Felis catus
MAEENFTAVTEFILLGLTDNADLKIMLFVLFLVIYAITLAGNLGMIFLIQITPKLHTPMYFFLSCLSFIDACYSSVIAPKMLINFLVVRETISLSACIVQHLFFGVFITTEGFLLSLMAYDRYVAIANPLLYSVVMSKRKCVGLVTGSFVGGMLNSLIHTISLGRLSFCGSNVVSHFFCDVPPLLKLSCSDTSKNELLLLTFSGVIAMATFLIVVISYIFIFITILRISSAAGRQKAFSTCASHLTSVTIFYGTLSFSYIQPSSQYSVEQEKVVSVFYTLVIPMLNPLIYSLRNKEVKDAVKRAIEMKHFPC

SEQ ID NO: 3007 - DNA, 915 bp, Felis catus
atgggccaacagaatctaacatcactgacggagttcattctgatgggagtcacaaggcagcctgagctacaggttcccctttttggggtcttcctcatcatctatacagtcacagtggtgggcaacctgggcatgatcatcttgacccaggtggactcccgcctacatacacctatgtatttttttatcaaacatctggctttcattgatcttggtaattctactgtcatttgtcccaagatgctggtaaattttgttgtggatcaaaatgccatttcttattatgcatgtgccacacagttggctttcttccttatgttcatcattagtgaatttttcatcttgtcggccatggcctatgaccgctatttggccatctgtaaccctctgctctacaatgttactatgtcccagagactttgtcacatgctagtgggcattccatacctctacagtacctttcaggctctaatgttcactattaagatttttacattgaccttctgtggttctaatgtcatcagtcatttctattgtgatgatgttgccttgttacttatgctctgctcaaatgcacaagacatagaattgttgatcatactattttcagcacttaatttgatctcttccctgatggtagtccttgtgtcttatatactaattctgatatccatatttcaaatgcattctgcagagggtaggaaaaaagctttctccacgtgtgggtctcatttgacagtggtgattgtgttctatgggtctctactatttatgtacatgcagcccaaatctgcccactcttttgatactgataaaatggcttctgtgttttacacattagtgatccccatgcttaaccccttgatctacagcttaagaaacaaagaggtaaaaaatgccttccgcagggtcttt

SEQ ID NO: 3008 - protein, 305 aa, Felis catus
MGQQNLTSLTEFILMGVTRQPELQVPLFGVFLIIYTVTVVGNLGMIILTQVDSRLHTPMYFFIKHLAFIDLGNSTVICPKMLVNFVVDQNAISYYACATQLAFFLMFIISEFFILSAMAYDRYLAICNPLLYNVTMSQRLCHMLVGIPYLYSTFQALMFTIKIFTLTFCGSNVISHFYCDDVALLLMLCSNAQDIELLIILFSALNLISSLMVVLVSYILILISIFQMHSAEGRKKAFSTCGSHLTVVIVFYGSLLFMYMQPKSAHSFDTDKMASVFYTLVIPMLNPLIYSLRNKEVKNAFRRVF

SEQ ID NO: 3009 - DNA, 959 bp, Felis catus
atgaatcctatggagaaacagaatcattctgcagtgattgaggtgactgaatttattctcctggggatcaccagcaatcctgggctacaagcacctctcctcgcaatcttcctcatcatatatttgatcacagtgacaggcaatctgggcatagttatcttgacccatttggactccaagctaaatacccccatgtactttttccttagacatctgtcaattactgatcttggttactccactgtcatcggcccaaaaatgatggtaaactttgtggtgcacaaaaatacaatttcctaccattggtgtgccacccagctggcagtctttgagattttcatcatcaccgaactgttcattctttcagcaatggcctatgatcgctacgtagccatctgcaaacctctcctctacgtggtcatcatggcagagaaggtgcgttgggcgctggtccttattccttatttctacagcacatttgtgtcgctctttctcacaatcaaattatttaaattgtccttctgtggctctaacattatcaggtatttttactgtgactgccttcctctcatatccatgctctgttcagacacacatgaattagaattgatcattttaagtttttcaggctgtaatctgctctcttccctcttgattgttcttatatcctacatgtttattcttgtggccatcctcagaatgaactcaaccgaggggagatacaaagccttctcaacctgtagttcccacttgacggtggtggtcgtgttctatgggacattattgtttatttacctgcagcccaaatccagccatacttttgatattgataagatggcctctgtgttttacactttggtgatccctatgctgaatccatggatctacagcttaaggaacaaagaagtaaaagatgctctgaagagaattttaaccaaccgatgcaaaattcccactta

SEQ ID NO: 3010 - protein, 320 aa, Felis catus
  MOD_RES (320)..(320): Any amino acid
MNPMEKQNHSAVIEVTEFILLGITSNPGLQAPLLAIFLIIYLITVTGNLGIVILTHLDSKLNTPMYFFLRHLSITDLGYSTVIGPKMMVNFVVHKNTISYHWCATQLAVFEIFIITELFILSAMAYDRYVAICKPLLYVVIMAEKVRWALVLIPYFYSTFVSLFLTIKLFKLSFCGSNIIRYFYCDCLPLISMLCSDTHELELIILSFSGCNLLSSLLIVLISYMFILVAILRMNSTEGRYKAFSTCSSHLTVVVVFYGTLLFIYLQPKSSHTFDIDKMASVFYTLVIPMLNPWIYSLRNKEVKDALKRILTNRCKIPTX

SEQ ID NO: 3011 - DNA, 928 bp, Felis catus
atggctccagggaacctcaccctggtgactgagttcattctcatgggagtctcagaccgcccagagctccagattccactcttctttgttttcctggtgatctatgggctgaccatggcagggaatctgggcatcatcaccctcaccagtgttgactctcaacttcaaacccccatgtacttcttcctgcgccatttggctatcatcaatcttggcgattctactgtcattgcccctaaaatgctgatcaattttttagtacagaagaaaaccacctcatactatgaatgtgccacccaactgggagggttcttatttttcattgtagccgaggtgctcacgttagctgtgatggcttatgaccgctatgtggccatttgtaaccccctgctttacatggtggtggtatctccacagatctgccttcttctggtatccctcacatatctctatggcttttccacaggtattgtggtttcatattgtatattttctctgtcttattgctcttccaatgtaatcaatcatttcttctgtgatattgtcccactgttaacattgtcctgctctgatacttaccttccagagacaatagtatttatatccgcagctacaaatttggtcttatcgttgataatagttgtagtatcttatttcaacattgttttgtccattctaaggatgcgttcatcagaaggaaggaaaaaagccttttccacatgtgcttcacatatgatggctgtcactgtgttctatgggacccttctcttcatgtatttgcagcctcaaactaactactcattggataccgataaaattgcttctgtgttttatacactggtgatccccatgttgaatcccatgatctacagcctgcggaataaggatgtgaaggctgccttacagagatttctaacaatttcatgct

SEQ ID NO: 3012 - protein, 310 aa, Felis catus
  MOD_RES (310)..(310): Any amino acid
MAPGNLTLVTEFILMGVSDRPELQIPLFFVFLVIYGLTMAGNLGIITLTSVDSQLQTPMYFFLRHLAIINLGDSTVIAPKMLINFLVQKKTTSYYECATQLGGFLFFIVAEVLTLAVMAYDRYVAICNPLLYMVVVSPQICLLLVSLTYLYGFSTGIVVSYCIFSLSYCSSNVINHFFCDIVPLLTLSCSDTYLPETIVFISAATNLVLSLIIVVVSYFNIVLSILRMRSSEGRKKAFSTCASHMMAVTVFYGTLLFMYLQPQTNYSLDTDKIASVFYTLVIPMLNPMIYSLRNKDVKAALQRFLTISCX

SEQ ID NO: 3013 - DNA, 952 bp, Felis catus
cagataaattgcacccacgtaaaggattttattctcacgggcctcacagatcgaaaggaattaaagacgcccttctttgtggttttcttatctatctacctcttcacagtagttggtaacctcggcttgatcctagtcattagaacagactcaagactcaacacaccgatgtacttctttcttagcaacctggcgtttgttgacttttgctactcttctgtcattacacccaaaatgcttgggaatttcttgtacaaacaaaatgttatctctttcaatgcatgtgctgctcaattaggctgtttcctggccttcatgaccgctgaatgcttgctactggcttccatggcctatgacagatacgtggccatttgtaaccctctcctctacctggttgtcatgtccccaggaatctgcattcagcttgtggttgtcccctacagctatagcttcctggttgcactatttcatactatcctcacctttcgcctctcctattgccactccaacgtcatcaatcatttctattgtgatgacatgcctctcctcaggctaacctgctcagacactcactccaaacagctatggatctttgtctgtgctgggatcatgttcatttcttcccttctggtcgtctttgtctcctacacgtacattatttctgccatcctgaggatgcgctcagctgagggcaggcgcaaggctttctccacgtgtggctctcacatgctggcggtcaccatattctatgggacccttatctttatgtacttacagccaagctcaaaccattccctagacacggataagatggcctcagtcttctatacagtgatcattcctatgttgaaccctttgatctacagccttaggaacaaggaggtgaaagatgctctgaagaaagtcattgtcaatagaaaccaggcttttgtgttcattaaattaaggaagt

SEQ ID NO: 3014 - protein, 318 aa, Felis catus
  MOD_RES (318)..(318): Any amino acid
QINCTHVKDFILTGLTDRKELKTPFFVVFLSIYLFTVVGNLGLILVIRTDSRLNTPMYFFLSNLAFVDFCYSSVITPKMLGNFLYKQNVISFNACAAQLGCFLAFMTAECLLLASMAYDRYVAICNPLLYLVVMSPGICIQLVVVPYSYSFLVALFHTILTFRLSYCHSNVINHFYCDDMPLLRLTCSDTHSKQLWIFVCAGIMFISSLLVVFVSYTYIISAILRMRSAEGRRKAFSTCGSHMLAVTIFYGTLIFMYLQPSSNHSLDTDKMASVFYTVIIPMLNPLIYSLRNKEVKDALKKVIVNRNQAFVFIKLRKX

SEQ ID NO: 3015 - DNA, 817 bp, Felis catus
tgatctacttaattagtgtcataggtaatcttgggttaattatgctaatttatacccgttctcagcttcacacacccatgtattcttttgtcagcaatctagcttttgttgctttttgctacacctcctctgtcacccctaacaccctggtgaacttcctccaagaaattaagagaatatccttacctgcttgtgccactcagttgtgttgctttatcatgtttgtggtctgtgaagtgtatatgctctcaatcatggcgtatgataggtatgtagccatttctaaacctttactgtataccgttatcatgaacagaagggtctgtattcaaatggtggtcactacacatttgtatggcttttctgtgggactcctccaggcaattctaacattccacttacctttctgtaatgcaaacataataaatcacttctactgtgatgatgttccctggttggtctggcctgccgtaaaacccattataaagatatcaaagaactgatatggttcacacttgctgctttcaatacccttttctctctctttatcgtcctcatctcctgcatagtcattctatttgccattctgaggattcattcagcagaaggccgacaaaaggcattttctacttgtgcctcccacctgacttcatcaccatgttttatggtaccgtcatcttcatgtatatgcagccgaaacaagccattctctggatactgacaaaatagcttctgttttctatattgtggtgatccccacgatgaatcctttaatatacagcctgaggaaccaggaagtcaaaatgctttgaagaga

SEQ ID NO: 3016 - protein, 166 aa, Felis catus
IYLISVIGNLGLIMLIYTRSQLHTPMYSFVSNLAFVAFCYTSSVTPNTLVNFLQEIKRISLPACATQLCCFIMFVVCEVYMLSIMAYDRYVAISKPLLYTVIMNRRVCIQMVVTTHLYGFSVGLLQAILTFHLPFCNANIINHFYCDDVPWLVWPAVKPIIKISKN

SEQ ID NO: 3017 - DNA, 922 bp, Felis catus
atggcaaaaggcaatcagtcagcagtcactgagtttattctcttgggcctcacagataatccagagtttcaggccatcctcttttgtgtattcctattgatttactcagttactctcctgggtaatcttggcttgattgtgttaatccaaataagtccccagcttcacacacccatgtattttttcctctgtcatctggcttttgttgatttttatggtgcctccaccattactccaaacacccttgcaaactcgttacgtgaaattaaaactatgccattttatgcatgtgccactcaagtgtgttgctttatcacattttcagtttgggaattattaatgctgtctgtcatggcctatgatcgctatgtggccatctgcaaccctttactctaagtcattctcatgcccaggaaactctgcttccaaatggtcactagctcttatatttatggactcactgtaggactcgtacaagcagtggctacattccacatgtctttctgtgactctaatgtggtcaaccagttctactgtgatgatgtccccttgattgctctggcttgctctgatacccaagtcaaagagttgatgctgtggatcattgctgggttcaatgtgttcttttctcttatcattgttctcatatcctatgtgttcgttgtcttcaccatcttgaagatccattctgctgcaggaagacataaagccttttccacctgcgcttctcacctgttttctattaccatgtattatgggaccctcagttttatgtacctgcgccccaagtcaagccactcactggataaagacaaatttgcctcagtgttctatgcagtggtgattcccatgttaaacccattgatctacagcttgaggaatcaggatgtaaaaaaggctctcaagaaaatctttgacaaag

SEQ ID NO: 3018 - protein, 173 aa, Felis catus
  MOD_RES (173)..(173): Any amino acid
MPRKLCFQMVTSSYIYGLTVGLVQAVATFHMSFCDSNVVNQFYCDDVPLIALACSDTQVKELMLWIIAGFNVFFSLIIVLISYVFVVFTILKIHSAAGRHKAFSTCASHLFSITMYYGTLSFMYLRPKSSHSLDKDKFASVFYAVVIPMLNPLIYSLRNQDVKKALKKIFDKX

SEQ ID NO: 3019 - DNA, 960 bp, Felis catus
ttattttcttaactttaacagctttaaggtttcacaacctttatccaaggctttccttgaagcatctttaacctctttgttccttagactatagatcagggggttcaacatcgggatcaccaccgtgtagaatacagacgccattttgtccgtgtccagggagtgatttgatttgggctgtaggtacataaagatcaaggtgccgtagaaaatagtgacagtcaccatatgggagccacaggtggaaatggccttgcgtcgcccctgagtagagcggatccttaagatggcagcaatgataaagatgtaggaggtgagaacaatggaagaggagcagatcatatcaaaaccagcaaaggcaaagatcagaatttccttcacgtgtgtgtctgagcaggacagagccaagagaggaaggtcatcacagtagaaatggttaattacattggggccacagtaagttagatggaaggtgataatggtatggaatagggcaaccagaaagctgtatatatatggaactgccactaattgaatgcagagtctttttgacatcagggttgaatagtgcaggggactacagatggccacgtagcgatcataggccatagaagccaacaggaaacactcggtgatcatgaaggtgagaaagcagcccagttgtgttgcacaagcatagaaaggaatagcgttgatttccacaacaaaattcaccatcatctttggtgtgatagcagaggagtagcaaaggtcaacaaaggccaagtgactgaggaaatagtacataggcgagtggagtcgaacatcaatcctgattaaagttatcaaccccatgttgcccagcactgtgaccagatagatgatgaaaaacaccacaaagcatggggcctgaagctctggttggtctgtgattccctggagaatgaattcagtgacatgggtgatattggtctcagccat

SEQ ID NO: 3020 - protein, 319 aa, Felis catus
MAETNITHVTEFILQGITDQPELQAPCFVVFFIIYLVTVLGNMGLITLIRIDVRLHSPMYYFLSHLAFVDLCYSSAITPKMMVNFVVEINAIPFYACATQLGCFLTFMITECFLLASMAYDRYVAICSPLHYSTLMSKRLCIQLVAVPYIYSFLVALFHTIITFHLTYCGPNVINHFYCDDLPLLALSCSDTHVKEILIFAFAGFDMICSSSIVLTSYIFIIAAILRIRSTQGRRKAISTCGSHMVTVTIFYGTLIFMYLQPKSNHSLDTDKMASVFYTVVIPMLNPLIYSLRNKEVKDASRKALDKGCETLKLLKLRK

SEQ ID NO: 3021 - DNA, 957 bp, Felis catus
atggttgaaaggaataacaccagggtgacagaattcattcttttgggcttttctgtccatagagagattgaaatcactctcttttttctcatttcagtagtatatactctaactttggtagggaaccttgggatgatttcattaatacgattggattctcgacttcacacacccatgtacttttttctcagcaatctggcctttgtagacctctgttactcttcatcaatagcccccaagttcctgcagaccctcctgaccaagcacaagtctatatctttctacgcatgtgcaacacagttgggctttttcctgaacttcttgatttcagagatgctccttcttgcagtgatggcttatgaccgctatgtggccatctgcaatcctcttctctacatggtgagcatgtccccaaaagtgtgtatgcaactagtaacaggcccctacttatacagcttttctgttgctttgctccacacagccgttactttccaactgatttattgtggcccaaatatcatcaatcacttttattgcgatgatgtccctttgatggccctcgcctgctcagacaccagtctcaaagaaatcttgattttcatctttgcgggtttcaacatgatcagctctttgagcactgttcttatttcttacttatacatcgtggctgccatcttgaaaatccaatctacagaaggaaggttcagagctttctcaacctgcgcgtctcatctgactgctgtgactatattctatgggactctgatcttcatgtatctgcagcccaaatcaaaccattcccttgacacagacaaaatggcctctgtgttctacacaattgtaattcctatgctgaacccaatgatctatagcttgaggaacaaagaggtgaaaaatgccttgaggaaatcaattgacaaatgttacatcctgcttctaacaaactttaaaaaatga

SEQ ID NO: 3022 - protein, 318 aa, Felis catus
MVERNNTRVTEFILLGFSVHREIEITLFFLISVVYTLTLVGNLGMISLIRLDSRLHTPMYFFLSNLAFVDLCYSSSIAPKFLQTLLTKHKSISFYACATQLGFFLNFLISEMLLLAVMAYDRYVAICNPLLYMVSMSPKVCMQLVTGPYLYSFSVALLHTAVTFQLIYCGPNIINHFYCDDVPLMALACSDTSLKEILIFIFAGFNMISSLSTVLISYLYIVAAILKIQSTEGRFRAFSTCASHLTAVTIFYGTLIFMYLQPKSNHSLDTDKMASVFYTIVIPMLNPMIYSLRNKEVKNALRKSIDKCYILLLTNFKK

SEQ ID NO: 3023 - DNA, 927 bp, Felis catus
ccccacatttgccttggcaattgctttgttgactgcctctctcacatccttgttcctcagactgtagatcatgggattcagcatggggatcactgtggtatagaacacggccaccattttcccctgctccacggactcttcagtgggacgcctgaggtacatgaatatgagagtcccataaaacagggtcacagctgtcaagtgggacccacaggtggagaacgccttcttcctgccctcagcagagtgcatccgtagcacggtgactacaatgagggtgtaggatgtgaggaccacagagagagaatatgtgaagtttattccagcaataacaatcatcgtgtattctttgatgtggacccccccacaggcaatcttgatgagaggagggtctgcacaatagaagtggttgatttcaaagtttccacagaagtacaatccatatgtccagagggtacatattaagctaacagagaatccatagacgtaaggcacagagataagtcgaacacagacaatcctggacattctactgccataaagcaacggcttgcagatggccatgtagcgatcaaaggccatcactgccaagatatagacctccacgtggacaagggcaatgaaaaagtagcactgcaccaaacaccccacataggaaatagtttttgtctctgacaataaattttccagcattttgggggtgacattggaagagaaccacacgtcgacaaaagacaaatggctcaagaaaaagtacatagggctctgaagctgaggactgatgctgatcagaatgatcataccaacgttccctaaaagagtgatcatgtaaactactaggaatatcacaaaaaagagaacttgaaattcctgacgactggccaagcccagaagaacaaattctgtcacatccgtgaaatttggcat

SEQ ID NO: 3024 - protein, 309 aa, Felis catus
MPNFTDVTEFVLLGLASRQEFQVLFFVIFLVVYMITLLGNVGMIILISISPQLQSPMYFFLSHLSFVDVWFSSNVTPKMLENLLSETKTISYVGCLVQCYFFIALVHVEVYILAVMAFDRYMAICKPLLYGSRMSRIVCVRLISVPYVYGFSVSLICTLWTYGLYFCGNFEINHFYCADPPLIKIACGGVHIKEYTMIVIAGINFTYSLSVVLTSYTLIVVTVLRMHSAEGRKKAFSTCGSHLTAVTLFYGTLIFMYLRRPTEESVEQGKMVAVFYTTVIPMLNPMIYSLRNKDVREAVNKAIAKANVG

SEQ ID NO: 3025 - DNA, 933 bp, Felis catus
ttattttgttaagcatgttctgctggccactttgctcatggcttctttcacatccttgttcctcaaactgtagatcatgggattcagcatggggatcactgtggtataaaacacagccaccattttcccctgctccacggactcttctgtgggacgcctgagatacatgaatatgagagtcccataaaatatgacgacagcggtcaagtgggacccacaggtggaaaaggccttccgcctcccttcggctgagtgcatccgtagaatggcaatgagaatgaacagataagaaatggtgacgacactcagagaatatgtgaagttaatgcctgcaagtatgatcattgtatattcttttacgaaggtcccagcgcacgccattttgatgagaggtgggtctgcacagtagaagtggttgatctcaattctcccacaaaagtacaagccatatgtccagagggttgctgccagactagtcagaaaaccatatatgtaagggaaagaaatcagtcgaatacagactgttctagacattttgctgccatagagcagagggttcccaattgccatatacctatcaaaggccatcacagcaagaataaaaatttctacatggacaagggcaatgaaaaagaaacattgcaccaaacaaccagcataggaaatagtttttgtctctgataacagattttccagcattttaggggtgacattggaggaaaaccacacatcaacaaatgacaaatgactgagaaaaaagtacatggggctgttaagctgtggactgatcttaattaacataatcatgccaatgttgcccaccaccgtgacaatatagaccgcaagaaaaatgacgaagaagagaacttgccattcctgatgactggttaatcccaaaagaataaactctgtcacatcggtgaaattgagcat

SEQ ID NO: 3026 - protein, 310 aa, Felis catus
MLNFTDVTEFILLGLTSHQEWQVLFFVIFLAVYIVTVVGNIGMIMLIKISPQLNSPMYFFLSHLSFVDVWFSSNVTPKMLENLLSETKTISYAGCLVQCFFFIALVHVEIFILAVMAFDRYMAIGNPLLYGSKMSRTVCIRLISFPYIYGFLTSLAATLWTYGLYFCGRIEINHFYCADPPLIKMACAGTFVKEYTMIILAGINFTYSLSVVTISYLFILIAILRMHSAEGRRKAFSTCGSHLTAVVIFYGTLIFMYLRRPTEESVEQGKMVAVFYTTVIPMLNPMIYSLRNKDVKEAMSKVASRTCLTK

SEQ ID NO: 3027 - DNA, 936 bp, Felis catus
ttaagaaaatcttttttttcttatcaactctttggttaatgcttctttcacatctttattcctaaggctataaatcatggggttcaacatgggaattaccgttgtataaaatacagcaaccatttttccctgttccacagattcctttgaagggggtctaagatacatgaagaaaagagttgcatagaatatggtgacagctatcagatgggagccacaggtggaaaaagctttgtgcctgccttctgtggaacgaatcctcaggatagcaggaaaaatataaaggtaggatatcaagatgatgaggagagaaaaggagaggttacatccagccacaacaaacatggacagctctttgttggaagtgtcagaacaagccagcttaatcagtggtgggtcagcacagtagaagtggttaatttcattggggccacagaaggctaggttgtaagtccacatggtttccatgaggccagtgagcgctccatacacataaggcccggtgatgagggatgtgcacacactcttggacatcttgctgccataaagcagagggttgcagatggccatgtaccgatcaaaggccatcacagccaggatgtagatctccacgtggaccaaggcaataaaaaagtaacactgcaccagacatgcagggtaagaaatagttttcttctccgacaagaaaatctccagcatctttggagtcacattggaagagaaacacagatccacaaaggataagtggctcagaaaaaagtacatgggtttgtgcagccgggcattgacctggatgagtacaatcatgccgagattccctgcgactgtggccgtgtaaatggccagaaacagcaggaagaggagaatctgtaattccaggtgactggtcagtccaagaagaatgaactcattcactgaggtgaaatttcttctcat

SEQ ID NO: 3028 - protein, 311 aa, Felis catus
MRRNFTSVNEFILLGLTSHLELQILLFLLFLAIYTATVAGNLGMIVLIQVNARLHKPMYFFLSHLSFVDLCFSSNVTPKMLEIFLSEKKTISYPACLVQCYFFIALVHVEIYILAVMAFDRYMAICNPLLYGSKMSKSVCTSLITGPYVYGALTGLMETMWTYNLAFCGPNEINHFYCADPPLIKLACSDTSNKELSMFVVAGCNLSFSLLIILISYLYIFPAILRIRSTEGRHKAFSTCGSHLIAVTIFYATLFFMYLRPPSKESVEQGKMVAVFYTTVIPMLNPMIYSLRNKDVKEALTKELIRKKRFS

SEQ ID NO: 3029 - DNA, 957 bp, Felis catus
ttatttcaaaagtacatttcttctcatcaatttccaaaaagcttgcttcacattcttgttcctcaggctataaatgatggggttcaacatagggcttacaaaagtgtagaaaacagcaataattttagactgctccactgacttgtccgtgggaggtctaacatacatgcagaagagtgtcccgtaaaatacagtcactgccaccagatgggaaccacacgtggaaaaagctttgtgcctgccttcagcagaatgtatcctcaggatggcagtgagaatgaagatgtaagagatgacaattatgaggagggagttggagaggttaaatcctgctaccacaaacatggacgtctctttaatgaaagtgtcagagcaggacagctggatgaggggggggtcagcgcagtagaagtgattaataatattggagtcacagaaggtcaagcggtacgtccacatggtttccatcaggccactaaggaagccgtagacatagggaccagcaatcaggcgaatacagacccctctggacatcttgctgctgtaaagcaaagggttacagatggccacgtacctgtcataagccattacagccagcatgtaatactcagtaatcaccatggcaatgaaaaaataacactgggttaaacaagcagcataggaaatggttttcttctctgataagaagttcgccaacatcttgggagtcacattcgtggaataacacaaatccaagccggacaaactggcgagaaagaagtacatgggggtgtggaggcgtgaatctatcctgatcaataccaacatcccaaggttcccccccacggtgatcaagtagatcaccaggaacagcacaaagaggatgggctgaagctctggacgatctgttaatcccaggagaacaaattcggtcactaaggtggaatttcctctgaccattttcttagctgccagcat

SEQ ID NO: 3030 - protein, 318 aa, Felis catus
MLAAKKMVRGNSTLVTEFVLLGLTDRPELQPILFVLFLVIYLITVGGNLGMLVLIRIDSRLHTPMYFFLASLSGLDLCYSTNVTPKMLANFLSEKKTISYAACLTQCYFFIAMVITEYYMLAVMAYDRYVAICNPLLYSSKMSRGVCIRLIAGPYVYGFLSGLMETMWTYRLTFCDSNIINHFYCADPPLIQLSCSDTFIKETSMFVVAGFNLSNSLLIIVISYIFILTAILRIHSAEGRHKAFSTCGSHLVAVTVFYGTLFCMYVRPPTDKSVEQSKIIAVFYTFVSPMLNPIIYSLRNKNVKQAFWKLMRRNVLLK

SEQ ID NO: 3031 - DNA, 967 bp, Felis catus
atttcaaatgaacagataaccaaatttcaattttatgaaagagatttccctgaatgatttgctgcatagcatggaccacatccttgttccgtagactataaatcaatgggttcaacattgggctcaagaaagtataaaagactgcaattattttggactcctccacagacttctcagatggggtccttaagtacatgcagaagagggttccataaaatagggtgactgttgtcaagtgggaaccacaagtagaaaaggctctgtgcctgccttcagcagaatggatcctcaagatggctgcaataatgagaaggtaggaaaggacaatgatgaagagagagcttgacagagtcaagccagcgactacaaacattgccatttttttgacataagtgtcagagcaggccaatagtataagaggaggatctgcacagtagaaatgattgatttcaagggagccacagaaggacaagtgaaaagtcagcagtgtctgggagagtccattaaggaagccacaagtataagacaccatgactagagagatacaaacattcttagacattctggtactgtaatgtagagggctacaaatggctacatagcgatccaatgccatcgaagcaaggatataaaactcagtgatcaccagggcaatgaagagaagacactgtgtgaagcatccagcataggagatggtcttctggtcggagaggaagttgtacagcatgtttggagtgatattggaggaatagcaaatgtccacgaaggagaggtggctaaggaagaagtacatgggtgtttggaggtgagaattggtcctgatcagcataatcatgcagagattgcctgccagcgtgatcaggtagatcaccagaaacaccccaaacaggatcttctccaggacagggtcgtctgtgagtcccaagagaatgaattctgccactgtagtgtggtttggggaagacat

SEQ ID NO: 3032 - protein, 323 aa, Felis catus
  MOD_RES (323)..(323): Any amino acid
MSSPNHTTVAEFILLGLTDDPVLEKILFGVFLVIYLITLAGNLCMIMLIRTNSHLQTPMYFFLSHLSFVDICYSSNITPNMLYNFLSDQKTISYAGCFTQCLLFIALVITEFYILASMALDRYVAICSPLHYSTRMSKNVCISLVMVSYTCGFLNGLSQTLLTFHLSFCGSLEINHFYCADPPLILLACSDTYVKKMAMFVVAGLTLSSSLFIIVLSYLLIIAAILRIHSAEGRHRAFSTCGSHLTTVTLFYGTLFCMYLRTPSEKSVEESKIIAVFYTFLSPMLNPLIYSLRNKDVVHAMQQIIQGNLFHKIEIWLSVHLKX

SEQ ID NO: 3033 - DNA, 917 bp, Felis catus
gttgttttaaaaattttacctgaggaagctttgacgtccttagttctcagactctagatgaaaggatttaacatgggaatgatcactgtataaaacacagataccactttgtcttggtcccttgagtagcagaagctggagcgcagatacatgaacagaatagtgccaaagaaaatggtgatcaccatcaagcgggaagcgcaggtggagaaagccttgtgcctcccttcagcagaatggatcctcaaggcggcaatgaggatgtacagataagaactgagaataatcaggaggcagctcagttcattacaactggcaaaagcaaaaatgacaacttcattgacacgtgtatcagaacaagagagtttcaggaggggtggagtgtcacagaaaaagtggttgatgacattcaagtggcagaaagacagctgaaaggtgaagcctgggtgaatggcagccttcagaaagcctgcaagatacgcggccaataccagaaggacattaagacgcagggacgtggtgactgtgtaaagaagaggcttgcagatgaccacgtaacggtcataggccatcacagccaacagaaagccctcaattccagcaaaggaaccaaaaaagaagaactgcgtggcacatgcactaaatgaaatgactgggttctccagccagaaattcattagcatattaggggcaatgacagaagaataacagaagtcaacaagggataaattactgaagaaaaagcacattggggtatggagatgtgagtcactcttgattaataggatcatgccaagatttccaaacacagttatcatatagatgactagaaacaccataaaaagaagaaactgtagttctggatgatccctgaatcccatgagaataaattcagccactgttgtatggttgctcat

SEQ ID NO: 3034 - protein, 287 aa, Felis catus
MSNHTTVAEFILMGFRDHPELQFLLFMVFLVIYMITVFGNLGMILLIKSDSHLHTPMCFFFSNLSLVDFCYSSVIAPNMLMNFWLENPVISFSACATQFFFFGSFAGIEGFLLAVMAYDRYVVICKPLLYTVTTSLRLNVLLVLAAYLAGFLKAAIHPGFTFQLSFCHLNVINHFFCDTPPLLKLSCSDTRVNEVVIFAFASCNELSCLLIILSSYLYILIAALRIHSAEGRHKAFSTCASRLMVITIFFGTILFMYLRSSFCYSRDQDKVVSVFYTVIIPMLNPFI

SEQ ID NO: 3035 - DNA, 948 bp, Felis catus
ttacagcatgtgtttctgtaagatcttctttagggcccctttcacatccttatttttcaaactgtagatgagggggtttaacataggaatcactactgtataaaagacagagacaatcttttcctgttccattgaatagctagatgtagggcgcaagtacatgaagagaattgtcccaaaaaatatggtgacagccatgaggtgggaggcacaggtggagaaggctttgtgcctgccctctaaagagggaatcctcaagatggcaatgaggatacacaggtaagaaatgagaacaaccataacacaagtgatgacattaaaactggagaaaaccatgatcacaatgccattgatgcgagtgtcagagcaagacagcttgagcaggggtggggtgtcacagtagaaatggttgatcctattagagccacaaaaggacaatctgaaagtcattcctgtgtgtatggctgcattcccaaagcctgctaggaaagacatagctactagcaagaaacaaattctcccagacatgagaactgagtacagcagagggttccaaatggctgcatagcgatcatatgccatcatagccaacagaaagcattcagtccccaaaaaggaaccaaagaagtagaactgggcagcgcatccattaaaagatatggctttgttctcagccacaaggttcaccagcatcttaggagtgacagaagaagagtaagaggcatcaacaaaagagaggctgctgagaaagaggtacattggagtgtggagacaaggatccattttaattaacaccatcatccctaaattacccaccatggttgccatatagattaacagaaacaatccaaagaggacactctgtagatctgagttgtctgagagtcctaagaggataaattctgtcacttctgtttgatttcgtccttgaacctctttcatatatct

SEQ ID NO: 3036 - protein, 313 aa, Felis catus
MKEVQGRNQTEVTEFILLGLSDNSDLQSVLFGLFLLIYMATMVGNLGMMVLIKMDPCLHTPMYLFLSSLSFVDASYSSSVTPKMLVNLVAENKAISFNGCAAQFYFFGSFLGTECFLLAMMAYDRYAAIWNPLLYSVLMSGRICFLLVAMSFLAGFGNAAIHTGMTFRLSFCGSNRINHFYCDTPPLLKLSCSDTRINGIVIMVFSSFNVITCVMVVLISYLCILIAILRIPSLEGRHKAFSTCASHLMAVTIFFGTILFMYLRPTSSYSMEQEKIVSVFYTVVIPMLNPLIYSLKNKDVKGALKKILQKHML

SEQ ID NO: 3037 - DNA, 929 bp, Felis catus
atggataaagaaaaccactcaatggtgaccgagtttatctttatgggcatcactcaagaccctcagctgcagaccatcttttttgtggtcttcctcttgatctacctggtcaatgtcgtggggaacattggtatgattatcttgatcataacagacactcagcttcacacccccatgtactttttcctgtgtaacctctctttcgttgacctgggatactcttcagccatcgcccccaggatgctggctgacttcttaacaaagcacaaagttatctccttctccagctgtgccacccagtttgctttcttcgtaggtttcgtggatgccgagtgctatgtcttggccgccatggcctacgaccgtttcgtggccatctgtcgacccctccactatagcactctcatgtccaagaaagtttgtatagctctcatgctgggctcttacctggctggcttggtgagtttagtagcccacacttccctcaccttcagtttgagttactgtggttccaatattatcaaccacttcttctgtgaaatcccacctctcttagccctctcttgctcagacacttacatcagcgagatcttgctctttagtctgtgtggcttcattgaattcagcaccatcctcatcatcttcatctcttatgccttcatcctcgtagcaatcatcagaatgcgctcagctgaaggccgccataaggctttctccacctgtgggtctcacctcactggcgtcacccttttttatggcacagtcatgtttatgtacctgaggccaacatccagctactccctggaccaagacaagtgggcctctgtgttctacactattatcatccccatgctgaatcccttgatctacagtttacggaacaaggacgtgaaagctgctttcaaaaaactaactggaaggaaacctca

SEQ ID NO: 3038 - protein, 310 aa, Felis catus
  MOD_RES (310)..(310): Any amino acid
MDKENHSMVTEFIFMGITQDPQLQTIFFVVFLLIYLVNVVGNIGMIILIITDTQLHTPMYFFLCNLSFVDLGYSSAIAPRMLADFLTKHKVISFSSCATQFAFFVGFVDAECYVLAAMAYDRFVAICRPLHYSTLMSKKVCIALMLGSYLAGLVSLVAHTSLTFSLSYCGSNIINHFFCEIPPLLALSCSDTYISEILLFSLCGFIEFSTILIIFISYAFILVAIIRMRSAEGRHKAFSTCGSHLTGVTLFYGTVMFMYLRPTSSYSLDQDKWASVFYTIIIPMLNPLIYSLRNKDVKAAFKKLTGRKPX

SEQ ID NO: 3039 - DNA, 930 bp, Felis catus
tgtcttctgttttgcaatagctctccttaaagctcctttcacatcttggttccttaggctatagatcaaggggttgagcataggtgtgatcacagtgtagaacactgcaatgatcttgcccccagccctggaggacttcgactggggtctcatgtacatgaagatggcagttccgtagaacaaggccaccactgtcagatgggaggcacaggtggacagtgccttgtgccttccagaggctgaccgtatcctgaggactgatagaaggattcgggcataggaaacaacaatcaggagaaaaggaatgaagacgatgataatactgaagatgaaaacaaccagctcagtaaatgaggtgtcagtgcaagccaacctcaggacagaagggacctcacagaaaaagtgattcaggacattgggcccacagtagggcaaactcaaggtgaggacattgataaccatggagctcaggaagctaatggaccaagaaatggttgccaattggacacagacactttggttcataatgacagtataatgaagagggtgacaaatggctacatatctgtcataagccatgaccccaaggagaacacattcaatcattccaaaggagagggagaagtacatctgagtagcacagctagagaatgggatggtctttttccccaccatgttggacagcatttgtgggacattggtggatgtatagcagatatctagaaaggataaattagtgaggaagaagtacatgggggtttggagacgaggttctatctgaataacagtgatgattgtaatattccccactactgttaataaatagaaaaacaagaacataataaaaagaatgagctgcatctttggctgagatgagaggcccaggaacacaaattcagtcacagtgaagtttgtttttatcatatccat

SEQ ID NO: 3040 - protein, 310 aa, Felis catus
MDMIKTNFTVTEFVFLGLSSQPKMQLILFIMFLFFYLLTVVGNITIITVIQIEPRLQTPMYFFLTNLSFLDICYTSTNVPQMLSNMVGKKTIPFSSCATQMYFSLSFGMIECVLLGVMAYDRYVAICHPLHYTVIMNQSVCVQLATISWSISFLSSMVINVLTLSLPYCGPNVLNHFFCEVPSVLRLACTDTSFTELVVFIFSIIIVFIPFLLIVVSYARILLSVLRIRSASGRHKALSTCASHLTVVALFYGTAIFMYMRPQSKSSRAGGKIIAVFYTVITPMLNPLIYSLRNQDVKGALRRAIAKQKT

SEQ ID NO: 3041 - DNA, 918 bp, Felis catus
atggagagaagcaatcacacagcgacggagttcatcctggtgggtttcaccacagacccaacgatgcagctggtcctgtttgtggtattccttggtgtgtactctctgactgtggttggaaatacctccctcatggtgttgatctgtaaagactcccggctgcacacacctatgtattttttcattgggaatctatcttttctggatctctggtattccactgtctacaccccaaagatcctcatgacctgcatctctgaagacaaaagcatctcctttgctggctgtgtatgtcagttcttcttctctgctgggctggcatacagtgagtgttacctgttggctgccatggcttatgaccgctacatggccatctcaaagccattgctttattctcaggctatgtctgtaaagctatgtgcatctttggtagcttcttcataccttggtggctttattaactcttctattatcaccaaaagaacttttgccttgaacttctgtagtggcaatgtcattgatgactttttttgtgatttgcttcccctggtgaagttggcttgtggcaaaaaagatggctaccagactgtgctctatttcctcctggcctccaatgtcatcacccccacagtgctcatcctcgcttcctacctgttcatcattgccaccatcttgaggatccgttccacccagggccgcctcaaagctttctccacctgttcctcccacctgatctctgtcaccttgtactatggctccattctctacatctattctcgtccccagtctagctattctttggacagggacaaaatagtttctacattttacactgtggtgttccccatgttgaaccccatgatctatagcctgagaaataaggatgtaaaagaggctctggataaactcattaaataa

SEQ ID NO: 3042 - protein, 305 aa, Felis catus
MERSNHTATEFILVGFTTDPTMQLVLFVVFLGVYSLTVVGNTSLMVLICKDSRLHTPMYFFIGNLSFLDLWYSTVYTPKILMTCISEDKSISFAGCVCQFFFSAGLAYSECYLLAAMAYDRYMAISKPLLYSQAMSVKLCASLVASSYLGGFINSSIITKRTFALNFCSGNVIDDFFCDLLPLVKLACGKKDGYQTVLYFLLASNVITPTVLILASYLFIIATILRIRSTQGRLKAFSTCSSHLISVTLYYGSILYIYSRPQSSYSLDRDKIVSTFYTVVFPMLNPMIYSLRNKDVKEALDKLIK

SEQ ID NO: 3043 - DNA, 923 bp, Felis catus
atggaaagaagcaatcatacagtgactgagttcattctggtgggtttcaccacagacccaacgatgcagctggtcctgtttggggtattccttggtgtgtactctctgactgtggtagggaataccaccctcatagtgttgatctgtaacgactcccggctgcacacacccatgtattttttcattgggaatctgtcttttttggatctctggtattcctctgtctacaccccaaagatcctcatgacctgtatctctgaagacaaaagcatctcctttgctggctgtgtatctcagttcttcttctctgctgggttggcatacagtgagtgttacctgttggctgccatggcttatgaccgctacgcagccatttccaaccctctgctttatgctcagtccgtgtcaaggacattgtgcatctgtttggttacatattcctacactggaggttttgtcaatgcaataatactcaccagcaacacattcacattggatttttgtggtgacaatgtcattgacgactttttctgtgatgtcccacctctggtgaagttggcgtgtgatgttaaagagagctaccaggctgtgctctacttcctcctggcctccaatgttatcacccccacgacgctcatcctcgcctcctacctgttcatcatcgctgccatcttaagaattcgctccgcccagggccgccgcaaggccttctccacctgctcctcccacctggtctctgtcaccttgtactatggctccattctctacatctattctcgcccaagttccagctattcccttgagagggacaaaatggtgtccacattttatactgtgctcttccctatgttgaaccccatgatctatagtctgaggaataaggatgtgaaagaggctctgaaaaaactctttcggttaacaca

SEQ ID NO: 3044 - protein, 308 aa, Felis catus
  MOD_RES (308)..(308): Any amino acid
MERSNHTVTEFILVGFTTDPTMQLVLFGVFLGVYSLTVVGNTTLIVLICNDSRLHTPMYFFIGNLSFLDLWYSSVYTPKILMTCISEDKSISFAGCVSQFFFSAGLAYSECYLLAAMAYDRYAAISNPLLYAQSVSRTLCICLVTYSYTGGFVNAIILTSNTFTLDFCGDNVIDDFFCDVPPLVKLACDVKESYQAVLYFLLASNVITPTTLILASYLFIIAAILRIRSAQGRRKAFSTCSSHLVSVTLYYGSILYIYSRPSSSYSLERDKMVSTFYTVLFPMLNPMIYSLRNKDVKEALKKLFRLTX

SEQ ID NO: 3045 - DNA, 938 bp, Felis catus
tcatctctgtggccttatggtttgtgctgccttccagaaggcctctttgacatctttgtttctcaggctgtagatgagagggttgagcaatgggttgaccacagtgtagaacagagcagctactttgtctctttccagggagtaggtagaacttggccttgaatacatgaagagcaaggatccgtagaagaacatgactgagatgagatgtgaggcacaggtggagaaggccttgcgccttcctgaggctgagtggatcctcaggatcgccaggaggatgttgaaataggaaaccaagatggcaaggatgctggagaggactgtgaagcccaccacacccaagaggactttttcatagacgtgggtatctgtacaagacatttttaccaatggtggcgcatcacagaagaagtggtctatgatgtttttaccacagaaggtcaggcggaaagtgttggcagtatgggctatggcgtttaaaagtcctcctaagtaggagccagcaacgagtccagtacagagagaattggacatagtacttgaataaagtagtgggttgcagattgcagcatgccggtcataggccatggctgctaggagataacactcagtataggctacaacacaggaaaaaacaactgggcgccacatccagccaaggaaatacgtttatcttctgagacacaattagccaagattttgggagtgtatacagaagtgtaccaaaaatccaagaaggacagattgccgatgaaaaagtacatgggcgtgtgcaggcgggaatcaacccggattaggatgaccagggtcatattccccgacaaagtcatcaaatagagtatcagaaaaattccaaatagaatcagctgccaccgtgggtctgctgagaaacccaccaagatgaattcagtcagaagggtgcgatttcctacttccat

SEQ ID NO: 3046 - protein, 216 aa, Felis catus
MWRPVVFSCVVAYTECYLLAAMAYDRHAAICNPLLYSSTMSNSLCTGLVAGSYLGGLLNAIAHTANTFRLTFCGKNIIDHFFCDAPPLVKMSCTDTHVYEKVLLGVVGFTVLSSILAILVSYFNILLAILRIHSASGRRKAFSTCASHLISVMFFYGSLLFMYSRPSSTYSLERDKVAALFYTVVNPLLNPLIYSLRNKDVKEAFWKAAQTIRPQR

SEQ ID NO: 3047 - DNA, 936 bp, Felis catus
ttaagaaaatgttgccctatctaacattttcttcagggcatctttaacatctttatttcttaagctataaatcaagggattcaacattggtatgaccacagtatagaagactgaaaccactttatccctttctagagcatagctggtacttggtcgggagtaaacgaagagaatagagccgtagtacaaagtgacagccgtcaggtgagagccacaagtggagacggccttgaggcggccttgggtggagcgcatctttgagatggcagcagcaatgaagaggtaagaggcaaggatgagcacagtgggagtaatgacattggaggccagtatgaaatagagcacagcctggtagctctccttcacgtcacaggccagctttacaaggggaggtagatcacaaaagtaatcgtcaatgacattgttcccacagaagctcagggtaaatgtctcactggtaatgagggttgagttaagaaagccaccaaagtatgaaactgcaacaagaccagtacataacctcgaagacattgcctggaaataaagcagaggattggagatggccgtgtagcggtcgtaagccatggcagccaacaggtaacactcactgtatgccagcccagccgagaagaagaactgagcaaggcagccagcaaaggagatgcttttgtcttccgcagcgcaggtcatgaggatttggggggcatagacagaagagtaccagagatccaggaaggaaagatttccaatgaagaaatacatgggtgtgtggagttgagaatcagcaccgatcagagaaatcagggtgatgttcccggacagactgatgacatagatggtgaggaaaatgacaaagagtactctctgtaaccacaagtctgctgtgaaccctagaagtataaactctttcactctggtgaaatttttctcatccat

SEQ ID NO: 3048 - protein, 311 aa, Felis catus
MDEKNFTRVKEFILLGFTADLWLQRVLFVIFLTIYVISLSGNITLISLIGADSQLHTPMYFFIGNLSFLDLWYSSVYAPQILMTCAAEDKSISFAGCLAQFFFSAGLAYSECYLLAAMAYDRYTAISNPLLYFQAMSSRLCTGLVAVSYFGGFLNSTLITSETFTLSFCGNNVIDDYFCDLPPLVKLACDVKESYQAVLYFILASNVITPTVLILASYLFIAAAISKMRSTQGRLKAVSTCGSHLTAVTLYYGSILFVYSRPSTSYALERDKVVSVFYTVVIPMLNPLIYSLRNKDVKDALKKMLDRATFS

SEQ ID NO: 3049 - DNA, 934 bp, Felis catus
ttaggccatacaaaacttcctcttagcagcagtcctgtggatggcatctttgacttccttgttcctcaagctgtagataagtgggttcaacatggggatcactgcagtgtaaaacactgacaccactttattgagatccagagacagacttgctctaggtcgtacataaataaagaaaagagtaccatacaggatggagacgaccgtcaggtgagaagagcaggtagaaaaggctttgcgcctcccatccacagagtggatcttcatgatggcgacaaggatgtaaatgtaggaaatcaggatagtcagaccgctgaagactccaacagctccagctacgacaaaaactaccaacttagtaagccttgtgtcagcacatacaagggaaaggaggggggacatatcacagaagaaatgattaatgacattggggccacaaaaaggaagaaggaatgcatttgttgtatgggtcatggtgttcatgaacccgatgacatagggaccaaccaccagctggatacagagtctctgggacatggcaacagaatacaataatgggttgcagatggccacatagcggtcataggccatggacgccaagagaaaacactctgctgccacaaagaacccaaaaaaccactgctgcaaagcacagcccaagaaggagatggccttcctcttcgcaaagacgtccgtgagcatcttggggctcacaacagaggagaagcacatgtccacaaaggacaagtggctgaggagaaagtacatgggtgtgtgaaggcgggaatcaatccgaatcagaataatcatacccaagtttccggttagattgatgacgtagaaactcaggaagagcaggaagagggaggcctgcaattgggggttgtcactcaaacctgccaaaatgaactctgtaacccttgtgtagttgtca

SEQ ID NO: 3050 - protein, 310 aa, Felis catus
DNYTRVTEFILAGLSDNPQLQASLFLLFLSFYVINLTGNLGMIILIRIDSRLHTPMYFLLSHLSFVDMCFSSVVSPKMLTDVFAKRKAISFLGCALQQWFFGFFVAAECFLLASMAYDRYVAICNPLLYSVAMSQRLCIQLVVGPYVIGFMNTMTHTTNAFLLPFCGPNVINHFFCDMSPLLSLVCADTRLTKLVVFVVAGAVGVFSGLTILISYIYILVAIMKIHSVDGRRKAFSTCSSHLTVVSILYGTLFFIYVRPRASLSLDLNKVVSVFYTAVIPMLNPLIYSLRNKEVKDAIHRTAAKRKFCMA

SEQ ID NO: 3051 - DNA, 945 bp, Felis catus
ttaacttcttatgcaaaacttccccctgacgatcgttctgcacatggcagctttcacttctttatttctcaagctgtagatgagaggattcaacatggggatcactgctgtgtagaacaccgacaccactttattgatgtccagagaaaagattgcacctggtcgcacatagataaagaagagggtcccatataagatggacactgcggtgagatgggaggagcaggtggaaaaggctttgcgcctcccatcgccagagcggatcctcaggatggcagtaaggatgtaaaaataggagattacaatggtcaggctactgacaaccagtacagctccagccacaatgaaaaccaacagtttattgatccgggtgtcagcacataccagagaaagaaggggggacatgtcacaaaagaaatgattgataatgttggagcgacaaaagggaagtcggaaagcagccgttgtgtgagtcatggtgctcatgaagccaatagtatagggtccaaccaccaactgtacgcagagtctctgtgacatggagacagaatacaataatgggttacagatggccacatagcggtcgtaagccatggacgccaggagaaggcactcaatggccacaaagaacccaaagaaccattgctgcaaggcacagcccaggaaggagatggccttcctctcagtgaagaagtcagtgagcatcttgggacccactactgatgaaaagcagatgtccacaaaagacaggtgactgagaaaaaagtacatgggcgtgtgaaggcggggatctatctggataagaataatcatacccaagtttcctgtgatggtaacaaggtaaaaaagtagaaatagcaagaaaaggaagacttgcattcgaggatgatacttcaaacttatgaaaataaattctgtgattcttgtattgttcccatcagccat

SEQ ID NO: 3052 - protein, 314 aa, Felis catus
MADGNNTRITEFIFISLKYHPRMQVFLFLLFLLFYLVTITGNLGMIILIQIDPRLHTPMYFFLSHLSFVDICFSSVVGPKMLTDFFTERKAISFLGCALQQWFFGFFVAIECLLLASMAYDRYVAICNPLLYSVSMSQRLCVQLVVGPYTIGFMSTMTHTTAAFRLPFCRSNIINHFFCDMSPLLSLVCADTRINKLLVFIVAGAVLVVSSLTIVISYFYILTAILRIRSGDGRRKAFSTCSSHLTAVSILYGTLFFIYVRPGAIFSLDINKVVSVFYTAVIPMLNPLIYSLRNKEVKAAMCRTIVRGKFCIRS

SEQ ID NO: 3053 - DNA, 945 bp, Felis catus
atggaatttagaaatcaaactttggtcactgagtttttatttgtgggcttaacaaattacttccagcaccaggttgttctgtttgtgatgtttctcttggcttatctggtcactcttctgggaaatgtggggatgatcaccctcatttggatggattcccggctccacactcccatgtacttttttctcagccacttgtcctttgtggatgtctgctcctcttctgtcattggtcccaagatgttgacagacatctttgtgaaaaaaaaagtaatctctttcttgggttgtgcttcccagttatggttttttggtcagtttgtagtgacagagtgtttcctgttggcctccatggcttatgacaggtatatggccatctgtaagcccttgttgtatacactcattatgtcccggcgaatctgtgtgcagctggtggtagggccttataccatgggtcttataagcgccataacgcatacgacgtttgcctttcgcctgccttactgtggtccaaataccatcaatcacttcttctgtgaccttcttcctgttctctccctggcatgtgcagacacccaggtcaatcaggttttacttttcatcttggctggagctctaggagtgctcagtggtgtgatcatcctggtttcctacatttacatcgtggtcactatcttgaggatccgctctgctgaggggaggcgcaaagccttctccacctgctcttcacacctgactgctgtctccatcctgtatgggacactcttctttatctacgtacgccccagttctagtttctcgctggacatcaataaagtggtttctgtgttctacacagccgtgatccccatgttgaacccccttatctacagcctgagaaacagagaggtcaaggattcattcagaaggacgtttgagaagaagaatcttcttctgagtaggtaa

SEQ ID NO: 3054 - protein, 314 aa, Felis catus
MEFRNQTLVTEFLFVGLTNYFQHQVVLFVMFLLAYLVTLLGNVGMITLIWMDSRLHTPMYFFLSHLSFVDVCSSSVIGPKMLTDIFVKKKVISFLGCASQLWFFGQFVVTECFLLASMAYDRYMAICKPLLYTLIMSRRICVQLVVGPYTMGLISAITHTTFAFRLPYCGPNTINHFFCDLLPVLSLACADTQVNQVLLFILAGALGVLSGVIILVSYIYIVVTILRIRSAEGRRKAFSTCSSHLTAVSILYGTLFFIYVRPSSSFSLDINKVVSVFYTAVIPMLNPLIYSLRNREVKDSFRRTFEKKNLLLSR

SEQ ID NO: 3055 - DNA, 932 bp, Felis catus
ttacctactcagaagaagattcttcttctcaaacgtccttctgaatgaatccttgacctctctgtttctcaggctgtagataagggggttcaacatggggatcacggctgtgtagaacacagaaaccactttattgatgtccagcgagaaactagaactgggcgtacgtagataaagaagagtgtcccatacaggatggagacagcagtcaggtgtgaagagcaggtggagaaggctttgcgcctcccctcagcagagcggatcctcaagatagtgaccacgatgtaaatgtaggaaaccaggatgatcacaccactgagcactcctagagctccagccaagatgaaaagtaaaacctgattgacctgggtgtctgcacatgccagggagagaacaggaagaaggtcacagaagaagtgattgatggtatttggaccacagtaaggcaggcgaaaggtgaacgtcgtgtggatcatggtgctcataagacccatggtataaggccctaccaccagctgcatgcagattcgccgggacataatgagtgtatacaacaagggcttacagatggccatatacctgtcataagccatggaggccaacaggaaacactctgtcactacaaactgaccaaaaaaccagatctgggcagcacaacccaagaaagagattactttttttttcacaaagatgtctgtcaacatcttgggaccaatgacagaagaggagcagacatccacaaaggacaagtggctgagaaaaaagtacatgggagtgtggagccgggaatccatccaaatgagggtgatcatccccacatttcccagaagagtgaccagataagccaagagaaacatcacaaacagaacaacctggtgctggaagtaatttgttaagcccacaaataaaaactcagtgaccaaagtttgatt

SEQ ID NO: 3056 - protein, 276 aa, Felis catus
NQTLVTEFLFVGLTNYFQHQVVLFVMFLLAYLVTLLGNVGMITLIWMDSRLHTPMYFFLSHLSFVDVCSSSVIGPKMLTDIFVKKKVISFLGCAAQIWFFGQFVVTECFLLASMAYDRYMAICKPLLYTLIMSRRICMQLVVGPYTMGLMSTMIHTTFTFRLPYCGPNTINHFFCDLLPVLSLACADTQVNQVLLFILAGALGVLSGVIILVSYIYIVVTILRIRSAEGRRKAFSTCSSHLTAVSILYGTLFFIYVRPVLVSRWTSIKWFLCSTQP

SEQ ID NO: 3057 - DNA, 930 bp, Felis catus
atgacaaaagaaaatatcactaaagtgactgaattttttcttctggggtttggtgcccaaaacaagtttcgagacctcctcttcattgtatttctggtcatctatgcgacttccatggtgggtaatattggaatgatcctactcatcaagacagattccagacttcaaacacccatgtactttttcctacaacatttggcttttgttgatatctgttatacctccgctatcactcccaagatgctgcaaaacttcatattagaaaacaaatctatatcctttgagggctgtataatgcaattattggtttatgcaacatttgcaaccagtgactgttacctcctggctgctatggcagtggatcgttatgtagccatctgtaacccacttcactaccccataatcatgtcccgaagagtctgcatccaactggtagctggttcatatgtcatgggttcaataaatgcttccgtgcacacaggttttacattttcactgtccttctgcaaatccaataccatcaatcattttttctgtgatgttcccccaattcttgccctttcatgctccaacattgacatcaacatcatgctccttgttgtctttgtgggatttaacttgatattcactgtgtcagttgtcatcttttcctacatgtatatcatggccgccatcctgaagataccttctgtttcagggaggaaaaaagctttctccacatgtgcctcccacctgacagcagtcactgttttctatgcaaccctgtcatacatgtacttacagccccaagctagtaattcccaggagaatatgaaagtagcctctgtattttatggcattgtgattcctcttttgaaccccatgatctatagtttgagaaataaggaagtgaaagaggctataaaagggatgaggaaaaagttcttctag

SEQ ID NO: 3058 - protein, 309 aa, Felis catus
MTKENITKVTEFFLLGFGAQNKFRDLLFIVFLVIYATSMVGNIGMILLIKTDSRLQTPMYFFLQHLAFVDICYTSAITPKMLQNFILENKSISFEGCIMQLLVYATFATSDCYLLAAMAVDRYVAICNPLHYPIIMSRRVCIQLVAGSYVMGSINASVHTGFTFSLSFCKSNTINHFFCDVPPILALSCSNIDINIMLLVVFVGFNLIFTVSVVIFSYMYIMAAILKIPSVSGRKKAFSTCASHLTAVTVFYATLSYMYLQPQASNSQENMKVASVFYGIVIPLLNPMIYSLRNKEVKEAIKGMRKKFF

SEQ ID NO: 3059 - DNA, 928 bp, Felis catus
atggaacaaaacaatggcactgaaataagtgagttcattctcctgggatttgctggtcaacgcaagtcgtggcatattctcttcatagtatttctagtgatctacgtggccatcctagtgggcaatattggaatgatcctactcatcaagattgattcttgccttcgtaccccgatgtattttttcctccaacatttggcatttgttgatctctgctacacctctgctatcactcccaaaatgctgcaaaactttgtacaaacagagcaatccatctcattcatagggtgtatggtgcaattactagtctatggtgcttttgcaacgactgactgttacatcttggctgcaatggcagtggaccggtatgtcgccatctgcaatccactccgctatccaatagtcatgtcccagagagtctgcattcaactcctatttggctcatacttcataggttttctaaatgcctctgtaaacacaagttttactttttcactgagcttttgcaaatccaataaaattaaccactttttctgtgatgaacccccaattttagctctctcttgctccaacattgacttcaacatcatgctactaactgtctttgtggggtttaacctaatgttcactgtgctggttgtcatcttttcctacatatatatcctggctgccatcctgaagatatcttccattgcagggaagaaaaaagccttctccacgtgtgcctcccacctgacagcagtcactgttttctatgggactctgtcttacatgtatctgcaccatgggaccaatgagtctcaagagcaagaaaaaatggcttctgtgttttatggcattatgatccccatgttaaaccccctcatctacagcctgagaaaccaagatgtgaaggaagccctaaaagtggttacaaagaagtgcttct

SEQ ID NO: 3060 - protein, 310 aa, Felis catus
  MOD_RES (310)..(310): Any amino acid
MEQNNGTEISEFILLGFAGQRKSWHILFIVFLVIYVAILVGNIGMILLIKIDSCLRTPMYFFLQHLAFVDLCYTSAITPKMLQNFVQTEQSISFIGCMVQLLVYGAFATTDCYILAAMAVDRYVAICNPLRYPIVMSQRVCIQLLFGSYFIGFLNASVNTSFTFSLSFCKSNKINHFFCDEPPILALSCSNIDFNIMLLTVFVGFNLMFTVLVVIFSYIYILAAILKISSIAGKKKAFSTCASHLTAVTVFYGTLSYMYLHHGTNESQEQEKMASVFYGIMIPMLNPLIYSLRNQDVKEALKVVTKKCFX

SEQ ID NO: 3061 - DNA, 957 bp, Felis catus
gcagggaaagataccgacctggagtttcctctccagtgcgtcctttacctccttgttgcggaggctatagatgaaggggttgagcatgggaattatgatggtgtagaacacggacactatttggccgttggtatcattagaggatccgtgaggctggacgtaggtgaaaaccacagtgccatagaaaatggcaatggccaagaagtgggaggcacaggtggagagggccttctcccgtccagctgctgagcgcatcctcccaatggccaccaggaccaagctgtaggaggtgaggatgactgcagcaggcagaagggtaaccagagcagagaagatacagaggagcagccctgctgtggccgtgttgccacgagccaggcggagaaggggtgggatgtcacagaagtagtgtgtcacctggttgggcccacagaaaggcagagcaaagacattcccagtctggatggcagagttggcaccaccaaatgcataggaagcagctaccagctggacgcaggtctccttagtcatgacagaaccgtaatggaggggttggcagatggccacaaagcggtcaaaggccatggaggccagcaggaagctctcagctgtcacgtgcaccacaaagaaggtcagttggaccacacagccctcgaaagagatggtcttatcggaggccaggaagttgaccaagagcttgggtgtgaccacagatgagtaacaaatatctagaaacgacaggacactgaggaagaaatacatggggctatggagacgggagtctgtgaagatgagtgccatcattcccaggttgcccagcactgttatggcataaatgagcaggaaggctacaaacagaagctcctggagatccgcataactggagaatcccaacaagatgaactcggtaactggagtgcggttgccatttgcaagggctagttctccaggtgtcat

SEQ ID NO: 3062 - protein, 319 aa, Felis catus
MTPGELALANGNRTPVTEFILLGFSSYADLQELLFVAFLLIYAITVLGNLGMMALIFTDSRLHSPMYFFLSVLSFLDICYSSVVTPKLLVNFLASDKTISFEGCVVQLTFFVVHVTAESFLLASMAFDRFVAICQPLHYGSVMTKETCVQLVAASYAFGGANSAIQTGNVFALPFCGPNQVTHYFCDIPPLLRLARGNTATAGLLLCIFSALVTLLPAAVILTSYSLVLVAIGRMRSAAGREKALSTCASHFLAIAIFYGTVVFTYVQPHGSSNDTNGQIVSVFYTIIIPMLNPFIYSLRNKEVKDALERKLQVGIFPC

SEQ ID NO: 3063 - DNA, 873 bp, Felis catus
ttccttaagctgtagaccagggggttcagcatggggatcacaatggtgtagaacacagagaggcccttgttataggctgcagcacttccagggttgggttggacatagacaaagaacacagacccgtagaagagggagaggcagtgaggtgggaggcacaagtggagaaagctttgtgctgggcctccagggacctcatcctacagattgtgaccaggatgaaggcataagagatcaagacggctgagaccatggggacagtgacccaggcagagaggcaaagcaggatgacgttggccactgtggtgtctgagcaggccagttggagcacagggaggatgtcacagaagaaacgatcaatgacgttgggaccacagtagggcaagatgaaggcattccttgtctgcggagctgaaacgaacactcccgcagcgtaggtgaccattaccagctggatgcacaaacgcttagacatgatggcgtggtagaggagagggtggcagatggccacaaatcgatcataggccattatggccaagagcaggctcccctgtgccgtggaggatcacggaggccatctggaccacacagcctgtaaacgagatggaccggtccgtggtgaggatgctgatcagcagcccgggggtgaacacggaggaattgcaggtgtccaggaaggagagcacgctcagaagaaagtacatgggggtgtggaggacggagctggcacggatcaggtctatcatgcccaggttgcccgccagtgtcacggtgcagatcatcaggaagacggcaaagaggagttgtttttggtctgcctggtctgtgaggcccagcaggatgaatcttgtcactgcggtgtgattctgcccc

SEQ ID NO: 3064 - protein, 117 aa, Felis catus
GQNHTAVTRFILLGLTDQADQKQLLFAVFLMICTVTLAGNLGMIDLIRASSVLHTPMYFLLSVLSFLDTCNSSVFTPGLLISILTTDRSISFTGCVVQMASVILHGTGEPALGHNGL

SEQ ID NO: 3065 - DNA, 951 bp, Felis catus
atgcagccatatgccccaaactggacccacgtaacagagtttgtcatagtgggctttgctggggtgcatgaagcacgccccctcttctttacactcttcctcaccatgtacctattcaccctggtggagaacttggccatcatcgtggtggtggctttagaccaccggctacgtagacccatgtatttcttcctgacgcacttgtcctgccttgaaatctggtacacttcggtgacagtgcccaagatgctggctggttttattggggtaggtgggggcaagaacatctcctatgctggctgcctgtcccagctcttcatctttaccttcctgggggcaacagagtgtttcctactggctgccatggcctatgaccgctatgtggccatttgtatgcctctccgatatgcggccttggtgtcgtggggcgcctgcatccgtctggccgctgcttgttggctggcaggcctcctcacacctgttttgcctatctacctcatgtcccagctgacgttttgtggccccaacgtcatcgaccacttcttctgtgatgcctcaccgctgctagccttgtcctgctcagatgtcaccctgaaggagaccacagacttcctcgtttctctggcggtgctcctggcctcctctacggttatttctgtgtcctatggcaatatcgtctggacgttgctgcacatccattcagctgctgagcgcaggaaggccttctccacttgtgcagctcacctgacagtggtgagcctcttctatggcactctttttttcatgtatgtccgcaccaaagtggcctcctccgtcaacttcaacaaggtggtgtctgtcttctactccattgtcacgccaatgctcaaccccctcatctatagtcttcggaacagggaggtgaagggagctctgggccgagccttgtccctcaggtcttggaaaggtcag

SEQ ID NO: 3066 - protein, 317 aa, Felis catus
MQPYAPNWTHVTEFVIVGFAGVHEARPLFFTLFLTMYLFTLVENLAIIVVVALDHRLRRPMYFFLTHLSCLEIWYTSVTVPKMLAGFIGVGGGKNISYAGCLSQLFIFTFLGATECFLLAAMAYDRYVAICMPLRYAALVSWGACIRLAAACWLAGLLTPVLPIYLMSQLTFCGPNVIDHFFCDASPLLALSCSDVTLKETTDFLVSLAVLLASSTVISVSYGNIVWTLLHIHSAAERRKAFSTCAAHLTVVSLFYGTLFFMYVRTKVASSVNFNKVVSVFYSIVTPMLNPLIYSLRNREVKGALGRALSLRSWKGQ

SEQ ID NO: 3067 - DNA, 888 bp, Felis catus
ttttctgaatgtgcagcttttacacctttgttcctcagactgtagatcaaggggttcggcatgaggatgaccacggtgtaaaagacagacacgatcttgtcctcctctgggaatgagtctgagtgatttctctggtacacgaaggcaagcgtcctgaagaagaggacaaccgtggtgaggcgggacatgcaggtggagaaggtcttggctcgtccaccaacagacttcacccttgaaatggctctgattatgagcctataggagaccgggatgatcaggacattggccaggaacatgagcttggcaaaaaagaggatgacagtggcactttgtgtcatgcttggcaggcaagcttcagcaggggtgggaggtcacagaagaagtctgtcacagacagagacggtcacagaaagagaaggtgagggtgcatgtggtacgcaggatggcccctgagaccccacagacataggctgcagccaacaatccccagcaggtgcctggagtcatagcgaggttatagcacaatgggttgctaacggcaacaaagtggccataggccatcaaacaccctgtgcctgcacagagggtgaagaaaaagaagtgggtagcacattggtcataggagaggaccgtcttgcctgtggccagtgtggccaggatccaaggggtgatgaccgaggcgtcgcaggcatccagtagggcgaggtggctcaagaagaagtacatgggcctgtggagttggacaccctcttgggtcagaatgatcatccccacattccccagaagggtgacgacatagaaaatgagaaacatcaggaagaggggccccgccagttcagggtgatctgtgaaggccacaagaatgaactctgtcacagcagtgagatt

SEQ ID NO: 3068 - protein, 166 aa, Felis catus
NLTAVTEFILVAFTDHPELAGPLFLMFLIFYVVTLLGNVGMIILTQEGVQLHRPMYFFLSHLALLDACDASVITPWILATLATGKTVLSYDQCATHFFFFTLCAGTGCLMAYGHFVAVSNPLCYNLAMTPGTCWGLLAAAYVCGVSGAILRTTCTLTFSFCDRLCL

SEQ ID NO: 3069 - DNA, 934 bp, Felis catus
cacactcagggacacctggagtctaccagtgacctttctgaaggctgctttcacatccttgtttcttaggctgtagatcagagggtttagcatggggatgaccacagtgtagaagacagacacgaccttgtcttcctccagggacttgcccgagccactccgcagatacatgaagatgagggtcccaaagaaaagggccacagcggtgaggtgggaggcacatgtggagaaagtcttggccttgccacgtggagacttcaccttcagaatggccttgatgatgagcaggtaggatatcagaatgaccaacgcgttggccaagatcacaaagttcccgaagaagacaatgacaatctcagtgtttgttgtgtcattgcaggcgagcttcagcaggggcgggaggtcacagaagaagaagttgatctgattgtggtcacagaaggagagggtgaaggtgcatgtggtacgcacaatgaaccctaacatcccacagacataggcttccaccgccaaactccagcaaattctaggattcatggctacagtgtagagcagtgggttgctaacagcaacatagcggtcataggccatcactgccagcaggaaacactctgtgcctgcacagaaggtgaagaaaaagaactgggtaccacactggccataggagatgaccgtcgtgcctgtggccagtgtggccaggatctgaggagtgatgaccgaggcgtagcaggcatccagcagggcgaggtggctcaggaagaagtacatgggcgtgtggagttggtcatccacttggatcagaatgatcatccccatattccccagaagggtgacgatatagaaaatgagaaacgtcaggaagaggggaatctccaacatgtggtagtcagtaaagcccacgagaatgaactctgttaccgtagtaagattattc

SEQ ID NO: 3070 - protein, 311 aa, Felis catus
NNLTTVTEFILVGFTDYHMLEIPLFLTFLIFYIVTLLGNMGMIILIQVDDQLHTPMYFFLSHLALLDACYASVITPQILATLATGTTVISYGQCGTQFFFFTFCAGTECFLLAVMAYDRYVAVSNPLLYTVAMNPRICWSLAVEAYVCGMLGFIVRTTCTFTLSFCDHNQINFFFCDLPPLLKLACNDTTNTEIVIVFFGNFVILANALVILISYLLIIKAILKVKSPRGKAKTFSTCASHLTAVALFFGTLIFMYLRSGSGKSLEEDKVVSVFYTVVIPMLNPLIYSLRNKDVKAAFRKVTGRLQVSLSV

SEQ ID NO: 3071 - DNA, 934 bp, Felis catus
atggcagagaatgacactgtggtgacagaattcattctaatggcattccagctgtcggcagggctgcaaatgagtctcttctttgtgtttctggtgctatatttcgtcaccgtggggggcaacctgggcatgatagtgttgattcagagagaccttcgtctccaaactcccatgtacttcttcctccgccacctttccttcctggacatttgctactcttctgtcattgtccctcagttgcttgagaccttgggtacccgtaagatggccatcacttacgaacgctgtgccacccagttcttcttctttacactctgtgccagcaccgaatgtttccttttggctgtgatggcctatgaccgctatatggctgtgtgtaaccccctcttctacgccactgccatgacaccacagacctgcctagggctggtggctggggcatatgcttgtgccatggtcatcgctgtgatccgcactgggtgtaccttttcgatctccttctgtaagtccaaccacgtggacttctttttttgtgacctcccacccctgctgaagcttgcgtgtagtgagaccaagccacgggaacgggtcatctacctcctagctttcttggtcattacgaccagcatatcagtgattcttatatcctacttttttatcattcatgctattctgaagattcgtacagcaggtggcaaagtcaagactttctccacctgtgtttctcacatgactgcagtggctcttttctttgggacactcatattcatatacctgaaaggtaacatgggcgcatcgcttggggaggataagattgtgtcagtattttacacggtggtcatccctatgctgaacccaatgatctacagcttgagaaacaaggaagtgaaggaggctctgaagaaaactctcaacaggataaaggtttcccaag

SEQ ID NO: 3072 - protein, 312 aa, Felis catus
  MOD_RES (312)..(312): Any amino acid
MAENDTVVTEFILMAFQLSAGLQMSLFFVFLVLYFVTVGGNLGMIVLIQRDLRLQTPMYFFLRHLSFLDICYSSVIVPQLLETLGTRKMAITYERCATQFFFFTLCASTECFLLAVMAYDRYMAVCNPLFYATAMTPQTCLGLVAGAYACAMVIAVIRTGCTFSISFCKSNHVDFFFCDLPPLLKLACSETKPRERVIYLLAFLVITTSISVILISYFFIIHAILKIRTAGGKVKTFSTCVSHMTAVALFFGTLIFIYLKGNMGASLGEDKIVSVFYTVVIPMLNPMIYSLRNKEVKEALKKTLNRIKVSQX

SEQ ID NO: 3073 - DNA, 936 bp, Felis catus
atggcagagaagaacctcacctccacgacccagttcctccttactgcgttcactgactgtcctgaacaggctctccctctcttcctcctctttctgttgatctatctcatcaccttgctggggaacacaggaatggtcatcctgatccgcgtggatggccggctccacaccccgatgtacttcctcctgagtcacctctctttcatggacatctgctactcgtctgtcacggtcccccagatgctggccatgctgctggagcgcggggcggctctgtcctacacacgctgtgccgctcagttcttcctcttcaccttctttggctccatcgactgctacctcctggcaatcatggcctatgaccgctacgtggccgtgtgccggcccctgctttatgtcaccgtcatgacgcagaaggcccgtctgggttttgtggctggggcttacggtgctggtctcttcagtgcctccgtgaggacagtctcggctttcaccctctccttctgtggaaccaatgagatcgactttattttctgtgatctccctcccctgttaaagctgacctgtggggacagctacacccaggaggtggtcattattgtgtttgcgatatttgtcatccctgcctgcatggcggccatcttggtgtcctacctgttcatcatcgtggccatcatgaggatcccctcagcgggaggccgggccaagaccttctccacgtgtgcctcccacctcacggccgtgtcactcttcttcggcactctcatcttcatgtacctccgagacaactcgggccactccttgcaggaagatcgggtggtggctgtgttttacacaacagtgatccccatgctgaaccccctcatttatagcctgaggaaccaggaagtgaaggaagccctgaggaaagttcttgaacgagctgagtggtcctga

SEQ ID NO: 3074 - protein, 311 aa, Felis catus
MAEKNLTSTTQFLLTAFTDCPEQALPLFLLFLLIYLITLLGNTGMVILIRVDGRLHTPMYFLLSHLSFMDICYSSVTVPQMLAMLLERGAALSYTRCAAQFFLFTFFGSIDCYLLAIMAYDRYVAVCRPLLYVTVMTQKARLGFVAGAYGAGLFSASVRTVSAFTLSFCGTNEIDFIFCDLPPLLKLTCGDSYTQEVVIIVFAIFVIPACMAAILVSYLFIIVAIMRIPSAGGRAKTFSTCASHLTAVSLFFGTLIFMYLRDNSGHSLQEDRVVAVFYTTVIPMLNPLIYSLRNQEVKEALRKVLERAEWS

SEQ ID NO: 3075 - DNA, 945 bp, Felis catus
atggctgggaggaatgacactgtagtgaccgagttcttcctcactgcgttcccagagcatcccgagtgggggctccctctcttcctggtgtttttgagtttctatctcctcactctgctggggaacacgggaatggtcatcctgatccgtgtggatggccggcttcacaccccgatgtacttcttccttggccacctttccttcgtggacatctgctactcgtccgtcacggtcccccagatgctggccatgctgctggagcgcggggcagttctgtcctacacacgctgtgccgctcagttcttcctcttcaccttctttgcttccatcgactgctacctcctggcaatcatggcctatgaccgctatgtggccgtgtgccggcccctgctttatgtcaccgtcatgaccgagaaggcccgctggggcttactggctgcagcttatgcggctggtttctccagtgcctttgttcggacggtcacagccttcaccctctccttctgtggaaccaatgagatcgactttattttctgtgatctccctcccctgttaaagctgacctgtggggacagctacacccaggaggtggtcattattgtgtttgccatttttgtcatgcctctttgtgtattggtgatcttggtgtcctacgtgtttatcatcgtggccatcatgaggatccgctcctcggggggccgggccaagaccttctccacgtgtgtctcccacctcacggccgtgtcactcttcttcggcactctcatcttcatgtacctccgagacaactcgggccagtcctcggaggaggaccgagcggtgtcagtgctctacacagtggtgacccccatgctgaaccccttcatctatagcctgaggaataaggaggtaaaggaggcggttgtgaaagccctgagcaggtcaaagtctcgtggaaggccctag

SEQ ID NO: 3076 - protein, 314 aa, Felis catus
MAGRNDTVVTEFFLTAFPEHPEWGLPLFLVFLSFYLLTLLGNTGMVILIRVDGRLHTPMYFFLGHLSFVDICYSSVTVPQMLAMLLERGAVLSYTRCAAQFFLFTFFASIDCYLLAIMAYDRYVAVCRPLLYVTVMTEKARWGLLAAAYAAGFSSAFVRTVTAFTLSFCGTNEIDFIFCDLPPLLKLTCGDSYTQEVVIIVFAIFVMPLCVLVILVSYVFIIVAIMRIRSSGGRAKTFSTCVSHLTAVSLFFGTLIFMYLRDNSGQSSEEDRAVSVLYTVVTPMLNPFIYSLRNKEVKEAVVKALSRSKSRGRP

SEQ ID NO: 3077 - DNA, 925 bp, Felis catus
ttttcctactgaggagctttcttagggcacctttcatgtccttgttcctcaggctatagatgaaggggttcatcatgggcgtcaccacggtgaatagcactgcaccaatcttatctccgccatcagggtgagtggttgaggggaagaagtaaacccctacaatggtcccatagaagagcaatacaactgtcaggtgagagccacaggtagagaaggctttccactttccttctgtggatgagattctcaggacagccctgacaatgcagatgtaggagaagagaatgagggcaaaggggaaggtgacaaccgataagcccgcgataaataatacgagttcattgatccttgtgtctgagcaggacagcttgagcagaggcgccaagtcacagaagaagtgtgggagagtgttgctgtcacagaaaagcaacggaaggagtagaagagtgtgtattagggcaacagcattactgaggacccacggaatgaccgcgagtgaaacgcagagcctgggttgcatgatggtcatgtagttcagagggtggcagatagccacaaagcggtcataggccatgacgcccaagaggaaattgtcaataacgacaaacacaatagaaaagtacatttgtgtgatgcagttctcataggagatggattgagtcttggtctgaatattcatcagcatcttggggactgaggtggatacggaggaaatatcagcaaaggatagattggcaaggaagaaatacatgggagtgtgaaggtaagaatccaagccgatggccaggatgatgagtccattcccaactacagtgaccaggtacatacccaggaaaagcacaaagaggaccttctgctgctcagcctggttggagagtcccagaaggaggaacccagagacggtggttcgatttccttgatgcat

SEQ ID NO: 3078 - protein, 309 aa, Felis catus
  MOD_RES (309)..(309): Any amino acid
MHQGNRTTVSGFLLLGLSNQAEQQKVLFVLFLGMYLVTVVGNGLIILAIGLDSYLHTPMYFFLANLSFADISSVSTSVPKMLMNIQTKTQSISYENCITQMYFSIVFVVIDNFLLGVMAYDRFVAICHPLNYMTIMQPRLCVSLAVIPWVLSNAVALIHTLLLLPLLFCDSNTLPHFFCDLAPLLKLSCSDTRINELVLFIAGLSVVTFPFALILFSYICIVRAVLRISSTEGKWKAFSTCGSHLTVVLLFYGTIVGVYFFPSTTHPDGGDKIGAVLFTVVTPMMNPFIYSLRNKDMKGALRKLLSRKX

SEQ ID NO: 3079 - DNA, 945 bp, Felis catus
ctagttgttctgggagaggcaattcctggcaagaactctccccagggtccccttcatttcacggttcctcagggtgtagataagtgggttgagcagtggggttcccaatgtgtacaccagtgaaatgaactgatcttgcttggggtagtagctggagttggggcgcaggtacatgaaggcacaacagccatactgcagcaggaccacggagaggtgggaggagcaggtggagaaggcccggtggcggccagttgccgagtggatcttgagcacagcagccacaatgaaggcgtaggaggtggcgatgaagaagaaaggcatggcaatggccaatgtggctgccaccagcactgcccgctcatggatgtggctgttggtgcaaacaagacgcatcaccggtggcacatcgcaaaagaagtgctcgatagtccgcgcccggcagaatggcagcgagaagatgaaggccaccagttgtatggacaggaacaagccaatgaccacagaggccacgaccaagtggacacagagagttaaagtcacagtgagcgggtactgcaagggggagcaaatagcaacataccggtcataagccatggcagccaagaggaagcagtcagcgctaccaagcccaatgaagaagatcatctgagtggcacagcccaggagggtgatggtcttctctgactggaggatgttggtcaggatgtggggcaccaccacagcagtgtagcatagttctattcccgagaggctgcccaggaagtagtacatggctgtgtgcaggcgtgcttctgtatggatggccaccacaatgaagacattcccaccaatgatcaagatataaaccaggctgactccaaggaaaaacaagacctggagctctgggggagacggataggccaagaacacaaattccatcaacattgagtgatttccccaggtcat

SEQ ID NO: 3080 - protein, 314 aa, Felis catus
MTWGNHSMLMEFVFLAYPSPPELQVLFFLGVSLVYILIIGGNVFIVVAIHTEARLHTAMYYFLGSLSGIELCYTAVVVPHILTNILQSEKTITLLGCATQMIFFIGLGSADCFLLAAMAYDRYVAICSPLQYPLTVTLTLCVHLVVASVVIGLFLSIQLVAFIFSLPFCRARTIEHFFCDVPPVMRLVCTNSHIHERAVLVAATLAIAMPFFFIATSYAFIVAAVLKIHSATGRHRAFSTCSSHLSVVLLQYGCCAFMYLRPNSSYYPKQDQFISLVYTLGTPLLNPLIYTLRNREMKGTLGRVLARNCLSQNN

SEQ ID NO: 3081 - DNA, 960 bp, Felis catus
tcagagagcttcacctgttcctttgctactgatggcctttttcagggcacctttgacatccttgttcctaagggtgtaaatcagcgggttgagtaggggggtgatgaaggtgtagactagggcaaactggcggtcctcatccaccgacgagcccgactggggacgcaggtagaccaaggcacagaagccatactgcagcaggaccacggtgaggtgcgacgagcaggtggagaaggcccggcggcggccctcggcggagcggatgcgcaggatggcggaggcgatgaacacgtaggacacgcagataagcaggaaggggacggtcagcaccaggatgcccaccacgtagagcacggcctggtgcacgcggatgtcggcgcaggccagccgcaggacgggaggcacgtcgcacaggaagtggttgatttcccggcggtgcccgcagaagggcaaggtgaagatcaagcaagtgagctgcagggagaggaggagggccaggcccagggcgcacagcaccatccggacgcacagcttctgggtcatgatgagggtgtagcgcagcgggtggcagatggccacgtagcgatcgtatgccatgattgccaagaggaagcagtcagcgccgccaagcgtgagaaaaaagaacatttgggccccacagccagccagcggaatgggtttccgggcgccgcaaaggttggcaagcatcagaggcaccaccactgtggtgtagctgatctctacgaaagacaggttgcacaggaagaagtacatgggggtgtgcagcgagctgtgtgtgcgcaccgcccagacgatggccgcgttgccacaaaggatcatcaagtagagcaggaggaagaggaggaagaggagggcctgcaattcggggacggtggtgaacgcgcggaacacgaactcggtggggccggactggttgaggacggggctcctggcaaacat

SEQ ID NO: 3082 - protein, 319 aa, Felis catus
MFARSPVLNQSGPTEFVFRAFTTVPELQALLFLLFLLLYLMILCGNAAIVWAVRTHSSLHTPMYFFLCNLSFVEISYTTVVVPLMLANLCGARKPIPLAGCGAQMFFFLTLGGADCFLLAIMAYDRYVAICHPLRYTLIMTQKLCVRMVLCALGLALLLSLQLTCLIFTLPFCGHRREINHFLCDVPPVLRLACADIRVHQAVLYVVGILVLTVPFLLICVSYVFIASAILRIRSAEGRRRAFSTCSSHLTVVLLQYGFCALVYLRPQSGSSVDEDRQFALVYTFITPLLNPLIYTLRNKDVKGALKKAISSKGTGEAL

SEQ ID NO: 3083 - DNA, 952 bp, Felis catus
ttagtaggctaaacccaatgaagactttgcttttccaaccaccttctgaaatgcacccttgacctctttgttccttaggctgtagaccaaagggttcagcatggggatgaccatggtgtagaacacggacgccattttgtctgtgttcatggaatgactagaacttggctgtaagtacgtgaagatgattgtcccgtagaagatggaaacagtggtaaggtgggatgcacaggtggagaaagccttcttctgcacctgagctgagcgcatcctcaggatagcaataaaaatgaacagataagagttcaagataaccaagagggtgaaaaagacattgaatgctgccagtgtgaagagcacaatctcattcatgtagatatcagagcaagagagagacagcattgggggaatgtcacagaaaaagtgattaattacattggaatgacagaaagagaggtggaaagtgaaaacaacatggatggaagactgcaagagtccacagatgtaggatccagtggccagtaaggtacacatagcacttgtcatggtggtggtgtaacgcaaaggtttgcacacggctgcatggcggtcaaaggccattgaggccagaaggaaactttcaatagtggcaaaggctgagaagaagaacatctgtgcagcacatgcattgtaggatatgatcttatctcctgtgagaaaccccaccattaccttgggagtgacagccgaggcataaacgcagtccacgagggagaggttgctgaggaagaagtacatgggagtgtggagacgagagtccaacagaatcaacacgatcattccaacgttcccaaccagaatgatgaggtaaatgatagtgaagatggtaaacaaagggacctgcatctccagggcatctgtgagccccacaagaatgaattccaccacctctgaaatgttctccatcaaagtc

SEQ ID NO: 3084 - protein, 314 aa, Felis catus
MENISEVVEFILVGLTDALEMQVPLFTIFTIIYLIILVGNVGMIVLILLDSRLHTPMYFFLSNLSLVDCVYASAVTPKVMVGFLTGDKIISYNACAAQMFFFSAFATIESFLLASMAFDRHAAVCKPLRYTTTMTSAMCTLLATGSYICGLLQSSIHVVFTFHLSFCHSNVINHFFCDIPPMLSLSCSDIYMNEIVLFTLAAFNVFFTLLVILNSYLFIFIAILRMRSAQVQKKAFSTCASHLTTVSIFYGTIIFTYLQPSSSHSMNTDKMASVFYTMVIPMLNPLVYSLRNKEVKGAFQKVVGKAKSSLGLAY

SEQ ID NO: 3085 - DNA, 945 bp, Felis catus
ctaggaggtgaagcttagagacaggtttgccttaacaaccttcttgaaagcattcttgacctctttgttccttaggctatacaccgcaggatttagcatgggaatgaccatagtatagaacacagacacaattttgtccatgtccatagaatggctggaggttggctgggagtacataaacatgactgtcccatagaagatggagactgcagtgaggtgagaagcacaggtggatatagctttcaggtatccctctattgagggcattttcaagatggtggtaaatacgaacaggtaggaaatcaaaataaccaaaagaccaaaaaaagatgtggaagcttgctaccaaaacaagaaccagctcactgacatgtctatcagaacaagagagagagagacaactgcaggaatatcacagaaaaagtgatggatcacattggacttacagaagaagaggtggaatgtgtttccaacatccacagaagcattcagaaaaccaaaaacataggagcctatagccaaacgagcacacacacctgtcgtcatggtggtggtgtaatggaggggtttgcacaccgctgcatagtggtcataggccattgaggccaagaggtaactctccaccgtggcaaaggctgcaaaaaagaacatctgagtagcacacgcattgtaggagatgagcttgtctcttataagtaatccagccaggaccctgggagtgacagctgtagagtaaccaaagtccaccagagacaggttactgaggaaaaagtacatgggagtgtggagacgagagtccaacagaatcagcgccatcatccccaggtttccaaccacactgatgaggtagatgagggtgaacatgataaagaggggggccagcagttctgggtcactggttagtcccagcaagatgaattcagtcacttctgtgttgttcttcat

SEQ ID NO: 3086 - protein, 200 aa, Felis catus
MKNNTEVTEFILLGLTSDPELLAPLFIMFTLIYLISVVGNLGMMALILLDSRLHTPMYFFLSNLSLVDFGYSTAVTPRVLAGLLIRDKLISYNACATQMFFFAAFATVESYLLASMAYDHYAAVCKPLHYTTTMTTGVCARLAIGSYVFGFLNASVDVGNTFHLFFCKSNVIHHFFCDIPAVVSLSLVLIDMSVSWFLFW

SEQ ID NO: 3087 - DNA, 935 bp, Felis catus
tcattaagacaaaacctagagaaaaatttgcctttttaacaacctttttgaatgcattcttgacctctttgttcctcaggctatagaccacagggttcagcatggggatgaccatggtgtagaacacggatgcaattttgtctgtgtccatggaatggctggaacttggctgtaagtacatgatgatgactgtcccataaaatatggaaactgtaatgaggtgagacacacaggtggataaagccttctggtatccctcacctgagtgtatcttcagaatggtagtaaatatgaacaggtaggaaataaagatgacaaaaagtgcaaaaaagacattgaagcttgagataaaaacaagaatcagctcacttttgtgtttatcagagcacgtcaaagtcatgacagctggaatatcacagaaaaagtgatgaaccacattggacacacagaaagagagactaaaggtgtctccaatgtttatagaggcatttaagacaccacaggcataggagcctatggccagatgagcacacacacctgtcgtcatggtggtggtgtaatggaggggtttgcacactgctgcatagcggtcataggccattgaggccaagaggtaattttccacagtggcaaagactgcaaaaaagaacatctgggcagcacatgcattgtaggagatgagcttgtctcccattaggagcccagccatgaccttgggagtgactgttgaggagtaacaaaagtcaaccagagacaggttactgaggaagaaatacataggagtgtggagacaagagtccagcaagatcagcacgatcatccccaggtttccaatcagagtgacgaggtagatgagcgtgaacattataaagagaggaaactgcagttctgggttatcggttagtcccagcaggatgaaattggtcacgtctgta

SEQ ID NO: 3088 - protein, 312 aa, Felis catus
  MOD_RES (312)..(312): Any amino acid
TDVTNFILLGLTDNPELQFPLFIMFTLIYLVTLIGNLGMIVLILLDSCLHTPMYFFLSNLSLVDFCYSSTVTPKVMAGLLMGDKLISYNACAAQMFFFAVFATVENYLLASMAYDRYAAVCKPLHYTTTMTTGVCAHLAIGSYACGVLNASINIGDTFSLSFCVSNVVHHFFCDIPAVMTLTCSDKHKSELILVFISSFNVFFALFVIFISYLFIFTTILKIHSGEGYQKALSTCVSHLITVSIFYGTVIIMYLQPSSSHSMDTDKIASVFYTMVIPMLNPVVYSLRNKEVKNAFKKVVKKANFSLGFVLMX

SEQ ID NO: 3089 - DNA, 939 bp, Felis catus
tcacagtcttaaagataattttgcctctgaaatgaccttcatgagtgcactcttaacctctttgttcctcaggctatagaccacagggttcagcatggggatgaccatggtgtagaacacagatgccattttgtctgtgtccatggaatggctggaactgggctgtaagtacataaaaatgagtgtcccatagaagatggagactgcagagaggtgagaagcacaggtagataaagccttctgatatcctgtagatgagtgcatctttagaatggtgataaatatgaatatgtaggaaatcaagatgaccatgagagcaaaaaagctgttgaagctcactacataaacaagaaccagctcactgacacgtctatcagagcaagaaagaaccacgactgcaggcacatcacagaaaaaatgatgaatcacattggacatacaaaaggagagtctgaacgtgtctccagtgtggatagaggcattcaggaaaccacaggtgtaggaacctatggccagacatgcacacacacctgtcgtcatggtggtggtgtaatggaggggtttgcacactgctgcatagcggtcataggccattgaagccaacaggtaactctccacagtggcaaaggctgcaaaaaagaacatctgagcagcacatgcattgtaggagatgaccttgtctcccataagtaatccagccatgaccttgggagtgacagctgtagagtaacaaaggtccaccagagacaggttactgaggaaaaagtacatgggagtgtggagacgagagtccaacagaatcaacactattatccccaggtttccaaccagagtgatgaggtagatgagggtgaacacgataaagaggggaacctgcagttctggatcactggttagtcccagcaagatgaactgcgtcacttttgtcctgttatccat

SEQ ID NO: 3090 - protein, 312 aa, Felis catus
MDNRTKVTQFILLGLTSDPELQVPLFIVFTLIYLITLVGNLGIIVLILLDSRLHTPMYFFLSNLSLVDLCYSTAVTPKVMAGLLMGDKVISYNACAAQMFFFAAFATVESYLLASMAYDRYAAVCKPLHYTTTMTTGVCACLAIGSYTCGFLNASIHTGDTFRLSFCMSNVIHHFFCDVPAVVVLSCSDRRVSELVLVYVVSFNSFFALMVILISYIFIFITILKMHSSTGYQKALSTCASHLSAVSIFYGTLIFMYLQPSSSHSMDTDKMASVFYTMVIPMLNPVVYSLRNKEVKSALMKVISEAKLSLRL

SEQ ID NO: 3091 - DNA, 930 bp, Felis catus
atggacactaatacagaagtgacagatttcatcctgatggatctgaccaatactccaaaacttcagattccactttttattgtgttcacccctcatttacttcatcagtgtttgggggaaccttgggatgatcatactgatcctactggactcccattgccactctctcatgtactttttcctcagtaacctgtctctggtggactttggttactctgcagctgtcactcccagggtcacggctggattccttataggagaccaggtcatctcctataatgcgtgtgctgctcaaacgttctcttctgcagcctttgcaactgtggaacgttatctcttatcctcagcggcccgtgacctctgcgcagcagtgtgaagcccctccatcccaccaccaccatgacgatgagcgtgtgtgctcttctggccatgggttgctacatctgtagtctcctgaatgcatccattcaggttgggaatacgttcagtctttctttctgtcagtccaatgtggtccatcactttttcctgtgatattccagcagtcatggctctctcttgctttgataaacacattagtaaggtggttcttgtgtatgtgtcaagctttaatgtcttttttgctcttctcgttataatcctatcctatctattcatatttataaccagcttgaagatgcagtcagctcaggggcaccaaaaggctttgtccacctgcacttcccacctcactacagtctccatcttctatgggacagtcatctttatgtatttacagcccagttccagccattccatggacacagacaaaacggcatccgtgttctacactgtgctcatccccatgctgaaccctgtggtctacagcctgaggaacaaagaggtcaagaatgctttcaataaagttttggaaaaggcaaaatcatctct

SEQ ID NO: 3092 - protein, 158 aa, Felis catus
MHPFRLGIRSVFLSVSPMWSITFSCDIPAVMALSCFDKHISKVVLVYVSSFNVFFALLVIILSYLFIFITSLKMQSAQGHQKALSTCTSHLTTVSIFYGTVIFMYLQPSSSHSMDTDKTASVFYTVLIPMLNPVVYSLRNKEVKNAFNKVLEKAKSSL

SEQ ID NO: 3093 - DNA, 945 bp, Felis catus
atggataacaggacagaagagacacaattcatcctggtgggactaaccagtgacccagaactgctgatccccctttttatcatgttcaccctcatctatctcatcaatgtggttgggaacctggggatgatggcgctgattctcttggactcccgtctccacactcccatgtactttttcctcagtaacctgtctctggtggatctttgttactctacagctgtcactcccaaggtcatggctggattacttgtgggagacaaggtcatctcctacaatgcatgtgctgctcagatgttcttttttgtagcatttgccactgtggaaaattacctcttggcctcaatggcctatgaccgctacacagcagtgtgcaaacccctccattataccaccaccttgaccacaggtgtgtgtgcttctctagctataggctcctacatctgtggttttctgaatgcctctttccatgttggggacatattcagtctgtctttatgtaagtccaatctgatccatcactttttctgtgatgttccagctgtcatggctctctcttgctttgataaacacgttagtgaactggttcttgtttttatgtcaagctttaatgccctttttgctcttctggttatattgatttcctacctattcatatttatttccatcttgaagatgcagtcagctcaggggtaccaaaaggctttgtccacctgcgcttcccacctcactacagtctccatcttctatgggacagtcatctttatgtatttacagcccagttccagccattccatggacacagacaaaatggcttccgtgttctattctatggtcatccccatgctgaatcctgtggtctatagcctgagaaacaaagaggtcaagtgtgcattcaagaaggtggtggagaaggcaagtttttctacaggattgggaatttaa

SEQ ID NO: 3094 - protein, 314 aa, Felis catus
MDNRTEETQFILVGLTSDPELLIPLFIMFTLIYLINVVGNLGMMALILLDSRLHTPMYFFLSNLSLVDLCYSTAVTPKVMAGLLVGDKVISYNACAAQMFFFVAFATVENYLLASMAYDRYTAVCKPLHYTTTLTTGVCASLAIGSYICGFLNASFHVGDIFSLSLCKSNLIHHFFCDVPAVMALSCFDKHVSELVLVFMSSFNALFALLVILISYLFIFISILKMQSAQGYQKALSTCASHLTTVSIFYGTVIFMYLQPSSSHSMDTDKMASVFYSMVIPMLNPVVYSLRNKEVKCAFKKVVEKASFSTGLGI

SEQ ID NO: 3095 - DNA, 934 bp, Felis catus
atgaagaacaacacggaagtggctgaattcatcctgctgggactaaccaatgacccaaagctacagatccttctatttatcatgttcaccctcatttacctcatcacgctgttggaaacatggggatgattgttttgattctcttagactctcatctccacactcccatgtactttttcctcagtaacctgtctctggtggactttggttactctacagctgtcactcccaaagttatggctgggctccttaagggagacaaagtcatctcttacaatgcatgtgctgcccagatgttcttttttggagccttggccactgtggaaaatttccttttggcctcaatggcctatgaccgctacacagcagtgtgcaaacccctccattacaccaccaccatgacgacaagggtgtgtgcatgtctggcgataggttcctacatctatggtttcttgaatgcttccatccacattcggaacacgttcagtctctcattctgcaagtccaatctgatccatcactttttctgtgatgttccagctgtcatggctctatcttgttctgatagacatgtcagtgaacttattcttattgtggtagcaagcttcaacatcttttttgctgtctttgttatcttgatttcctacctgctcatatttatcaccatcctgaagatgcactcaactcagggttatcagaaggctttatccacgtgcacttcccacctcactacagtctccatcttctatgggacagccatatttatgtactcccagcccacctccagccattccatggactcagacaaaatcgcatccatgttctacactatggttattcccatgctgaaccccctggtctatagcttaagaaacaaggaggttaaaactgctttcaagaaggtgggtgagaaggcaaaactgtctctaggctt

SEQ ID NO: 3096 - protein, 272 aa, Felis catus
  MOD_RES (272)..(272): Any amino acid
MGMIVLILLDSHLHTPMYFFLSNLSLVDFGYSTAVTPKVMAGLLKGDKVISYNACAAQMFFFGALATVENFLLASMAYDRYTAVCKPLHYTTTMTTRVCACLAIGSYIYGFLNASIHIRNTFSLSFCKSNLIHHFFCDVPAVMALSCSDRHVSELILIVVASFNIFFAVFVILISYLLIFITILKMHSTQGYQKALSTCTSHLTTVSIFYGTAIFMYSQPTSSHSMDSDKIASMFYTMVIPMLNPLVYSLRNKEVKTAFKKVGEKAKLSLGX

SEQ ID NO: 3097 - DNA, 771 bp, Felis catus
tgggctgaacggaatcttcatcttcttagtggatttcctgaaagcattattcacctctttattccttagattgtagacagtagggctcaacatgaggactctaattacacagaacacaaatcccatttggtcattgtctgtggaatcactagaactgggttgtaagtacacgaacgtgacagttccatagaagagggtgactgcagtgaggtgtgaggcacaggtggagaaggctttcttctgtccgtcggctgagcgcatcctcaggagggcaatgaatgtgaacagataggaggtcaagattactatcagggcaaaacaaacttagaaatctactaagataaagagcatgatctcatttatgtagttgtcacaacaggaaggagcctagattggggcgatatcacagaaaaagtgatggaccacattggaatggcagaagaggcagaaggtgaatccagggtgggtgaccccagacatagcagcctactgtcatttgagcacacaagctggtggtcacagcggtggtataatgtaagggcttacatactgctgcaggccgatcgtaagccatgacctctagcaagaaacagtctacactggcaaaagccgcacagaacacatgagcaacacagtcaccagaggagttgactttatcctccgtgagaaacccagccgtcaccttggtagtaacagttaggaagtaaacggggtccaccagagagaggttacatacaaacaaaaagctgaaataggcccataaatccagag

SEQ ID NO: 3098 - protein, 121 aa, Felis catus
LDLWAYFSFLFVCNLSLVDPVYFLTVTTKVTAGFLTEDKVNSSGDCVAHVFCAAFASVDCFLLEVMAYDRPAAVCKPLHYTTAVTTSLCAQMTVGCYVWGHPPWIHLLPLLPFQCGPSLFL

SEQ ID NO: 3099 - DNA, 939 bp, Felis catus
atggataacaggacaaaagtgacgcagttcatcttgctgggactaaccagtgatccagaactgcaggttcccctctttatcgtgttcaccctcatctacctcatcactctggttggaaacctggggataatagtgttgattctgttggactctcgtctccacactcccatgtactttttcctcagtaacctgtctctggtggacctttgttactctacagctgtcacccccaaagtcttgactgcattacttataagagacaaggtcatctcctacaatgcatgtgctgctcagatgttcttttttgtagcatttgccactgtggagagttacctgttggcttcaatggcctatgaccgctatgcagcagtgtgcaaacccctccattacaccaccaccatgacaataggtgtgtgtgcatgtctggccatagtttcctacgcctgtggtttcctgaatgcctctatccacactggagacacgttcagtctctccttttgtatgtccaatgtgattcatcattttttctgtgatgtgcctgcagtcgtggttctttcttgctctgatagacgtgtcagtgagctggttcttgtttatgtagtgagcttcaacagcttttctgctctcatggtcatcttgatttcctacatattcatatttatcaccatcctaaagatgcactcatctacaggatatcagaaggctttatctacctgtgcttctcacctctctgcagtctccatcttctatgggacagtcatttttatgtacttacagcccagttccagccattccatggacacagacaaaatggcatctgtgttctacaccatggtcatccccatgctgaaccctgtggtctatagcctgaggaacaaagaggttaagagtgcactcatgaaggtcatttcagagacaaaattatctttaagattgtga

SEQ ID NO: 3100 - protein, 312 aa, Felis catus
MDNRTKVTQFILLGLTSDPELQVPLFIVFTLIYLITLVGNLGIIVLILLDSRLHTPMYFFLSNLSLVDLCYSTAVTPKVLTALLIRDKVISYNACAAQMFFFVAFATVESYLLASMAYDRYAAVCKPLHYTTTMTIGVCACLAIVSYACGFLNASIHTGDTFSLSFCMSNVIHHFFCDVPAVVVLSCSDRRVSELVLVYVVSFNSFSALMVILISYIFIFITILKMHSSTGYQKALSTCASHLSAVSIFYGTVIFMYLQPSSSHSMDTDKMASVFYTMVIPMLNPVVYSLRNKEVKSALMKVISETKLSLRL

SEQ ID NO: 3101 - DNA, 940 bp, Felis catus
atgaagaataatacagaggtgaaaggattcgtcctgctgggactaaccaataacacagagctgcaacttcctctctttctaatgttcaccctcatctacctcgtcactctgattgggaacctggggatgatcatgctgatcctgttcgactctcgtctccacattcccatgtacttctttctcagtaacctgtccctggtagacttttgttactcctcaacaatcactcctaaggtcatggctggattacttataggagacaaggtcatctcctacaatgcgtgtgccgcccagatgttcttttttgttctctttgcgactgtggaaagttacctcttagcttcaatggcctatgaccgctacgcagcagtgtgcaaacccctgcattacaccaccaccatgacaacgagtgtgtgtgctcgtctggccataggctcctatgtctttgcttttctaactgctgctattgacattggagacacattcgatctctctttctgtatgtccaatgtagtccatcactttttctgtgatattccagcagtcatgaccctggcttgctcagataaagacactaatgagctgattcttgttcttatttcaagctttaatatcttttttgcagttctagttatcttgatttcctacatgttcatatttattaccgttttgaagatacagtcaggtgagggataccaaaaggctttatctacctgtgcttctcatcttgttgcagtctccatattttatgggacagtcatcatcatgtatgtacagccaagttcaagtcattccatggatacagacaaaatcgcatctgtgttctatactatggtcatccccatgctgaaccctgtggtctacagcttgaggaacaaagaggtcaagaatgctatcaagaaggttgttgagagggcaaaatattctctaggtttagtct

SEQ ID NO: 3102 - protein, 314 aa, Felis catus
  MOD_RES (314)..(314): Any amino acid
MKNNTEVKGFVLLGLTNNTELQLPLFLMFTLIYLVTLIGNLGMIMLILFDSRLHIPMYFFLSNLSLVDFCYSSTITPKVMAGLLIGDKVISYNACAAQMFFFVLFATVESYLLASMAYDRYAAVCKPLHYTTTMTTSVCARLAIGSYVFAFLTAAIDIGDTFDLSFCMSNVVHHFFCDIPAVMTLACSDKDTNELILVLISSFNIFFAVLVILISYMFIFITVLKIQSGEGYQKALSTCASHLVAVSIFYGTVIIMYVQPSSSHSMDTDKIASVFYTMVIPMLNPVVYSLRNKEVKNAIKKVVERAKYSLGLVX

SEQ ID NO: 3103 - DNA, 939 bp, Felis catus
ctatgggttgaacagaatcttcattttcttagtgactttcctgaaagcattatttacctctttattccttagactgtagacaatagggttcagcatggggactattattgtatagaacacagatgccatttggtcattgtccatagaatggctagaactgggttgtaagtacatgaacatgacagctccatagaagagggtgactgcagtgagatgtgaggcacaggtggagaaggctttcttccgtccctcggctgagcacatcctcaggatggcaatgaatattaacagataggaggtcaagattactatcagggcaaaacagacattgaaagctgctaagataaagagcacaatctcatttatgtagatatcagagcaggaaagcgccaggattggagggatatcacagaaaaagtgatggaccacattggaatggcagaaggagaggctgaaggtgaatccagtgtggatggcagattcaataaaaccccagacatagcagcctactgccatttgagcacacaagctggtggtcacagtggtggtataatgtaagggcttacataccgctgcataccgatcataagccatgacagctagcaggaaacagtctacgctggcaaaacccacaaagaagaacatctgagcagcacatccaccataggagatgattttatcccctgttagaaacccagccatcaccttgggagtaacagctgaggagtaaacacagtctaccagagagaggttactgagaaaaatatacatgggagtgtggagacgggagtccaacagaatcaacatgatcatcccaagatttccaatgagagtggtgagataaataagagtaaatgttatgaagagaaagatttgcagttctgggttgtcagtcagtcccaagagtctaaactcattcaccttagtgccgttctccat

SEQ ID NO: 3104 - protein, 312 aa, Felis catus
MENGTKVNEFRLLGLTDNPELQIFLFITFTLIYLTTLIGNLGMIMLILLDSRLHTPMYIFLSNLSLVDCVYSSAVTPKVMAGFLTGDKIISYGGCAAQMFFFVGFASVDCFLLAVMAYDRYAAVCKPLHYTTTVTTSLCAQMAVGCYVWGFIESAIHTGFTFSLSFCHSNVVHHFFCDIPPILALSCSDIYINEIVLFILAAFNVCFALIVILTSYLLIFIAILRMCSAEGRKKAFSTCASHLTAVTLFYGAVMFMYLQPSSSHSMDNDQMASVFYTIIVPMLNPIVYSLRNKEVNNAFRKVTKKMKILFNP

SEQ ID NO: 3105 - DNA, 945 bp, Felis catus
ttaaaatatgaatcctatagaagactttgccttccctatggcctttttaaaggcactcttgacctctttgttcctcaagctgtagaccacaggatttagcatggggatgaccatggtatagaacacggatgccactttgtctgtgtccatggaatggttggcgctgggctgtaagtacatgaaggtgccggtcccgtagaagatggacactgtagtgaggtgggaggtgcaggtggaaaaggccttctggcgtccttcagatgagcgcatcctcagaatagtgataaatataaacaggtaggagatcaagatgaccaaaacagaaaagagattattcatgcccaccaccaaaaaaataaccatctcactgatgtagttgtctgaacatgagagagccagaagaggaggagcatcacagaaaaagtgatcaaccacactggctctacagaaggagagcctgaaaatattcccagtgtggatggacgcattcaggaaaccacaaatgtagcagcccatgaccagactagcacacataactgtcgtcatggtggtggtgtaatgcaggggtctgcacactgctacgtagcggtcataggccattgaggccaagaggaaactttctacagtgataaaggctacaaagaaaaagaactgggtgacacaagcatcataggagatgaccccgtctcctgtaagtgatccagccatgaccttgggagtgatagcagtagagtaaccaaagtccaccagagacaggtgactgaggaaaaagtacatgggagtatggagacgagagtccaagagaatcagcaccatcatccccaggttccccaaaagagtgacaagataaatgagggcgaagattaagaagagaggaatctgcagttttgggtcattggttaaccccacaagaatgaactcagtcacctcagtgctgttctccat

SEQ ID NO: 3106 - protein, 314 aa, Felis catus
MENSTEVTEFILVGLTNDPKLQIPLFLIFALIYLVTLLGNLGMMVLILLDSRLHTPMYFFLSHLSLVDFGYSTAITPKVMAGSLTGDGVISYDACVTQFFFFVAFITVESFLLASMAYDRYVAVCRPLHYTTTMTTVMCASLVMGCYICGFLNASIHTGNIFRLSFCRASVVDHFFCDAPPLLALSCSDNYISEMVIFLVVGMNNLFSVLVILISYLFIFITILRMRSSEGRQKAFSTCTSHLTTVSIFYGTGTFMYLQPSANHSMDTDKVASVFYTMVIPMLNPVVYSLRNKEVKSAFKKAIGKAKSSIGFIF

SEQ ID NO: 3107 - DNA, 950 bp, Felis catus
ctacttcctactcacacttaacgacggaggacaaagttggttgcgtattttccagagagcattttttacctctttgttcctaaggctgtagatcaaggggttcagcatgggaatcaccaccgagtaaaacacagaagcaattttgtccgtgtccattgactcgctggagctgggctgtaaatacatgaagatgatggttccatagaagatggtgacagcagtgaggtgggaggcacaggtagagaaggctttcttccgtccttccgcagaacgcatcctttgaatggcgatgtatatgaagaagtaagagatgaggatgaccaggagggtgaagaagacgttgaagcccacgacacagaagacagccaagctgctgatgcgagtgtcagaacacgagagagttaagagtggcggaatgtcgcagaagaaatgatttacttcgtgagagccacagaatgagagtctaaaggtgtttgccgtgtgaatggaggcattgaggaagccacagacataggagccagcagtcaggagggcacacacacctgccgtcatggtggtggagtaatggagtggcctacacacagctgcatggcggtcataggccatggaggccaggaggtagcactcgacagtggcaaaacccgcgaagaagaagaactgagcagcacatccattgtaggtgatgactttgctccctgaatgcagtgcagccaccatcttaggagctaccgctgacgagtaacccaggtctacgaaggagaggttactgaggaaaaatacattggagtgtggaggtgggggtctgcgcggatgattgccatcatccccccattcccaaccagagtgatgaggtagatgaataaaaataccaggaggagggggacctgaagatgagggtcgtctgttaatcccaagaggatgaactctgttgcttctgtgccattctccat

SEQ ID NO: 3108 - protein, 315 aa, Felis catus
GEWHRSNRVHPLGINRRPSSSGPPPPGIFIHLPHHSGWEWGDDGNHPRRPPPPHSNVFFLSNLSFVDLGYSSAVAPKMVAALHSGSKVITYNGCAAQFFFFAGFATVECYLLASMAYDRHAAVCRPLHYSTTMTAGVCALLTAGSYVCGFLNASIHTANTFRLSFCGSHEVNHFFCDIPPLLTLSCSDTRISSLAVFCVVGFNVFFTLLVILISYFFIYIAIQRMRSAEGRKKAFSTCASHLTAVTIFYGTIIFMYLQPSSSESMDTDKIASVFYSVVIPMLNPLIYSLRNKEVKNALWKIRNQLCPPSLSVSRK

SEQ ID NO: 3109 - DNA, 958 bp, Felis catus
gaaccataagacacagagggaacatctgcttcttctggttcttgagttttttcaatgcatctttgatctccttgtttcgcaaactgtatatgatgggattcagcatgggaatcacagctccatagagcatggacaccaccttctcttggtcctgtgagtagccagcactagaatggagatatgagaagagaccagagccatagaagagaatcactgtggtcagatgagaggcacaggtgttgaaagccttcatccgcccttgggttgaatggatcttcatgacagcagcaatgatgtagcaataggacaccaggacaacaagagctgatgtcccaccaactgcacacacaacaagaaagttcactacctggctgaggaaggtactagaacaagacaagactagcagaggtggcaggtcacagaaaaagtgtttaatgactcgtggaccacagaaatacagctggaatatggagctggtttggaccaatcccgtgaggaaccctccagtgtatgctgtaatgaccatccccacacacatggtgggtgacatgaaggctgcgtagaacagaggggtggaaatagcagcatagcggtcatatgccatggccgccaggagacagcattcagtggcccccatgctgatgaagaagaaaaactgagtagcacatcccacaaaggagatggtcttctgctgcttgaagaagtcacagagcatcttgggggtgatggaggacgtgtatgagatgtcaacaaaggacaagtttccaaggaagaaatacatgggggagtgcaggcatgactccatcctgatcaagacaacaaggcccaggttccaagtcagagtcacagaatagatccccagaaacaacacaaagaggaaagcctgaagctctggctgctctgaaaatcccaaaaggatgaagtcggttgttatgttgatgttccttcccatggccat

SEQ ID NO: 3110 - protein, 320 aa, Felis catus
  MOD_RES (320)..(320): Any amino acid
MAMGRNINITTDFILLGFSEQPELQAFLFVLFLGIYSVTLTWNLGLVVLIRMESCLHSPMYFFLGNLSFVDISYTSSITPKMLCDFFKQQKTISFVGCATQFFFFISMGATECCLLAAMAYDRYAAISTPLFYAAFMSPTMCVGMVITAYTGGFLTGLVQTSSIFQLYFCGPRVIKHFFCDLPPLLVLSCSSTFLSQVVNFLVVCAVGGTSALVVLVSYCYIIAAVMKIHSTQGRMKAFNTCASHLTTVILFYGSGLFSYLHSSAGYSQDQEKVVSMLYGAVIPMLNPIIYSLRNKEIKDALKKLKNQKKQMFPLCLMVX

SEQ ID NO: 3111 - DNA, 954 bp, Felis catus
agacctttaactatgacaatgggaaaaagctctcttcttacacctcttaaaggcgtctttgatttccttgttcctcagactgtaaatcaaaggattcaacatggggatcaccactgtatagaagactgatgccatcttgtcatggtccagagaatcatcagtgctggggtgcatatagacaaagagtcctgatccaaaaaaacagatcactgctgtcaggtgagaagtacaggtattgaaggccttggacctgcctttagcagagcttgtcttcaggatggtagcaatgatataaccataagatatcatgatgactgagacagatattacaccaaaaatcactgctatcacaaacttcatgacttttaggaaagaggtttcagagcaggataggactaataattgaggcaggtcacagaagaagtggttgataacattgggcccacaaaaattgagctgaagtaaagcacacaattggatcaatgaaccaaagagagcagttatacaggctccaaccatcatctgtacacagagggtgggtgacacgatggcggtgtagagtagaggattacaaatggcagcatatcggtcataagccatggcggccaggagacagcactcagtcagacccaggctagagaagaagaagtactgcatggtgcatcccagaaaggagatggatttaggcttctggaagaagtctgagagcattttcggggttgtggaggtaacatagcagaaatccaagaaagataagttactgaggaagaagtacatgggtgtatgtaggtgagagtccatcttaatcaggatgatgaggcccaggttccaagccactgtcaagaggtaagaacccaagaatactacaaagagagcgatcttgatcttgggataatctgagaatcccaaaaggatgaatctgatgactattgtactgttccttcctccagccat

SEQ ID NO: 3112 - protein, 315 aa, Felis catus
MAGGRNSTIVIRFILLGFSDYPKIKIALFVVFLGSYLLTVAWNLGLIILIKMDSHLHTPMYFFLSNLSFLDFCYVTSTTPKMLSDFFQKPKSISFLGCTMQYFFFSSLGLTECCLLAAMAYDRYAAICNPLLYTAIVSPTLCVQMMVGACITALFGSLIQLCALLQLNFCGPNVINHFFCDLPQLLVLSCSETSFLKVMKFVIAVIFGVISVSVIMISYGYIIATILKTSSAKGRSKAFNTCTSHLTAVICFFGSGLFVYMHPSTDDSLDHDKMASVFYTVVIPMLNPLIYSLRNKEIKDAFKRCKKRAFSHCHS

SEQ ID NO: 3113 - DNA, 976 bp, Felis catus
ctatactgtacatttgaaataaattccataattagttaaaacagaaaaagattctcttcttccttctgtttagggcatctttgatttccttgttcctcaagctatagatcaatggatttagcatggggattaaaacagtgtataaaactgatgccaacttgttttggctcagggaatcaccagagttaggatacatataaacaaagatacctgagccaaagaagagagccacagctgtcaggtgagaagcacaggtgttgaaggccttggacctgccttcagctgaggtgatcttcagaatggtggcaacaatataaccgtaggatatcatgataaccaagacagatgtgagcccaaagatcactgtgagcacagaggtcatgatttgaaagaaaaaggtgtcagagcaggataggatcagcaactggggaagatcacaaaagaaatggttgatgacatttggcccacagaaatgaagctgaagtaaggcatacagttggataaatgagccacagaatccaattacacaagatccccccaccatctgcacacagagggtgggcaacatgatggcggtgtagagcagaggattacaaatggcagcatatcggtcataagccatggcggccaggagacagcactcagtcagacccaggctagagaagaagaagtactgtatagtgcaccccacaaaggagatgtatttctgcttcttgaagaaatctgagagcatcttgggcgctatagtggaaacatagcagatgtccagcagggacaggttactgaggaaaaagtacataggtgtgtgcagatgtgagtccaccctgatgagagtgatgaggcctaggttccaggacacagtcatgaggtagatcgctaggaatattgaaaaaagaacactggcgagctttggaaattcagagaatcccaagagaatgaactttgtaactattgtactgttccttcccccagccat

SEQ ID NO: 3114 - protein, 314 aa, Felis catus
MAGGRNSTIVTKFILLGFSEFPKLASVLFSIFLAIYLMTVSWNLGLITLIRVDSHLHTPMYFFLSNLSLLDICYVSTIAPKMLSDFFKKQKYISFVGCTIQYFFFSSLGLTECCLLAAMAYDRYAAICNPLLYTAIMLPTLCVQMVGGSCVIGFCGSFIQLYALLQLHFCGPNVINHFFCDLPQLLILSCSDTFFFQIMTSVLTVIFGLTSVLVIMISYGYIVATILKITSAEGRSKAFNTCASHLTAVALFFGSGIFVYMYPNSGDSLSQNKLASVLYTVLIPMLNPLIYSLRNKEIKDALNRRKKRIFFCFN

SEQ ID NO: 3115 - DNA, 899 bp, Felis catus
tgaaaatattctcttttcccatctatttaaggcatctttgatttccgtgttccttaggtttcagatcaatagatttaaatcaccacagtgtatacaacagagtgttttggctcagaaaatcatcagaagtagggcacaaatagaccaaggtgcgtgagccataaaagagagtcacagctatccggtgagaagcacagaagttgaaggccttggacctgccttcagatgaagtgatctcagaatggtggcagcaatataaccatagaatatcatgataaccaagacagatgtgagtccaaagatcactgtgagcacagaggtcccgatttgaaaggaaaaggtgtcagagcagaatatgatcagcagctggggaaaatcacaaaagaaatggctgatgacatttggcccacagaaatgaagctgaaataaggcacacagttggataaatgagccaaagaatccagttacacgagatctcacaaccatctgcacacagagggtgggagatatgatggtggtgtagaacagaggcttacaaatggcagcatatcggtcacaagccatagctgctaagaaaaagcgctcagtcagactcggtaaagaagaagtactgcatggtgccccctacaaaggagatgtatttctgcttcttgaagaaatctgagagcgtcttggaagctgtggaggaaacataacaaatatctaagaaggcaagtttattgataaagaaatacatgggtgtgtgcaggtaggagtccatcttgatcagagtgatgaggttgacattgcagaacactgtcacgagggagatgcctaggaaaaaggatgacttcaagtgttggaaattcagagtatcccaataggataaacctggtaattgtagtgctgtttcttccttc

SEQ ID NO: 3116 - protein, 104 aa, Felis catus
KEETALQLPGLSYWDTLNFQHLKSSFFLGISLVTVFCNVNLITLIKMDSYLHTPMYFFINKLAFLDICYVSSTASKTLSDFFKKQKYISFVGGTMQYFFFTESD

SEQ ID NO: 3117 - DNA, 939 bp, Felis catus
tcagcagtaccatctcttcttctgtaaactcctcaaggcatctttgatttccttgttcctcagactgtaaatcaaaggattcaacatggggataaccacagtgtagaatactgatgcaaatctgtcaaaactggaggaaccgccagagctggaactcaaatagacaaagacactcgagatataaaagagggaaactgctgttagatgagaagcacaggtgttgaaagccttggacctgcctttagctgaagtgatcttcatgacggagatgacaatataacagtaggataccatgataatgagagcattaactaccccaaagatcattgttactatagcaagcaatagctgtacaaagaaagtgtcagtgcaggacaggactaacaactggggcatgtcacagaagaagtggttgatgacattaggcccacagaagtgaagctgaagtatggcacacaattgggatacagaaccagagagtccagccagataggaccccagcaccatccgaatacacagggtgggtgacatgactgatgaatagagaagaggattacaaatggcggcatatcggtcataagccatggctgtcatgagacaagactcactcagtcccatgattgaaaaaacaaagtattgaacggcgcaacccacaaaggtgatagtctgctgctcttggaaaaagctggagagcatcttgggggctgtggaggtcacatagcagatatccatgaaggacagattactgaggaagaagtacatgggtgtgtggaggtgagagtccatccttattaagatgatgaggcacaagttccaagtcagagtcataatgtagatgagcaggaatacaacaaagagcactactaggattctggggaaatcagagaatcccaaaaggatgaaataagtgacctctgtaatatttcctcccccagtcat

SEQ ID NO: 3118 - protein, 312 aa, Felis catus
MTGGGNITEVTYFILLGFSDFPRILVVLFVVFLLIYIMTLTWNLCLIILIRMDSHLHTPMYFFLSNLSFMDICYVTSTAPKMLSSFFQEQQTITFVGCAVQYFVFSIMGLSESCLMTAMAYDRYAAICNPLLYSSVMSPTLCIRMVLGSYLAGLSGSVSQLCAILQLHFCGPNVINHFFCDMPQLLVLSCTDTFFVQLLLAIVTMIFGVVNALIIMVSYCYIVISVMKITSAKGRSKAFNTCASHLTAVSLFYISSVFVYLSSSSGGSSSFDRFASVFYTVVIPMLNPLIYSLRNKEIKDALRSLQKKRWYC

SEQ ID NO: 3119 - DNA, 959 bp, Felis catus
atgtccacagctaaggcctggaatagctcttcagtaaccatgttcatcttcctgggatttgcagaccatccagaactccagacccttctctttgtgaccttcctgggtatctatcttgtgacactggcctggaacctggccctcatctttttgatcagaggtgacccccgtctgcacacacccatgtacttcttcctcagcaacttgtctttcatcgacatctgctactcttctacagtggcccccaagatgctcactgatttcttctgggagcaaaagaccatatcattcttgggctgtgctgctcagttttttttctttgtcagtatgggtctcactgagtgcttcctcctgactgccatggcatacgacagatacgcagccatctccaatcccctgctgtacacagccatcatgtcccaaggcctctgcacacgcatggtgcttggggcatatgttggtggcttcctgagctccctgatccaggccagctccatatttcagcttcacttctgcggacccaacattatcaatcatttcttctgtgacctccctccagtactggcactttcttgctctgacacctttcctagtcaagtggtgaattttctcgtggtagtcactattggggggacatcattcctcatcctcatcatctcctacagttacataggaactgctgtcttgaaaatccgttcagtggaaggccgaaagaaagccttcagcacatgtgcctcacacttgatggtggtgactctgttgtttgggacggcccttttcatgtacctgagacccagctccagctactcgcttggcagggacaaggtagtgtctgtgttctattcactggtgatccccatgctgaaccctcttatttacagtttgaggaacagagagatcaaagatgccctatggaaggtgttggagaagaagaaactgttttcctagttcacgattga

SEQ ID NO: 3120 - protein, 315 aa, Felis catus
MSTAKAWNSSSVTMFIFLGFADHPELQTLLFVTFLGIYLVTLAWNLALIFLIRGDPRLHTPMYFFLSNLSFIDICYSSTVAPKMLTDFFWEQKTISFLGCAAQFFFFVSMGLTECFLLTAMAYDRYAAISNPLLYTAIMSQGLCTRMVLGAYVGGFLSSLIQASSIFQLHFCGPNIINHFFCDLPPVLALSCSDTFPSQVVNFLVVVTIGGTSFLILIISYSYIGTAVLKIRSVEGRKKAFSTCASHLMVVTLLFGTALFMYLRPSSSYSLGRDKVVSVFYSLVIPMLNPLIYSLRNREIKDALWKVLEKKKLFS

SEQ ID NO: 3121 - DNA, 966 bp, Felis catus; identical to SEQ ID NO: 26

SEQ ID NO: 3122 - protein, 321 aa, Felis catus; identical to SEQ ID NO: 56

SEQ ID NO: 3123 - DNA, 930 bp, Felis catus
atggccctgagaaattataccaaggtgtctgaatttattttttgtggacttacccagtctcaagagctgagcttgctcttatttttctttttatctgtagtttatgtaacaactgtgttagcaaatgttgccatcatggtcactgtgacctacgagtcccgccttcacacgcccatgtacttcctgctccgcaatctctccgtcttggacatctgcttctcctccatcaccgctcccaaggtcctcgtagacctcctgtcaaggacgaagaccatctccttcaatggttgcatcactcagatcttcttcttccacctcctcgggggggcagacattttttctctctctgtcatggccttcgaccgctacatggccatctccaagcccctgcactacgtgaccatcatgagcagggggcgatgcactgccctcatcgtggcctcctgggtggggggctttgtccactccatcgtgcagatttccctgttgctgcccctccctttctgtggacccaatgttgttgatggcttctactgcgacgtcccccaggtcctcaaactcgcctgcaccaacacctttgctcttgaggtcttaatgatttccaacaatggtctagtcactactttgtggtttgttcttctccttgtgtcctacacagtcatcttgatgatgctgagatctcacgctggggagggaaggaggaaagccatctccacctgcaccgcccacatcactgtggtgaccctgcactttgtgccctgcatctatgtctacgcccggcccttcaccgcccttcccatggacagagctgtctccatcaccttcacggtcatcatcccggtcctgaaccccatgatctacaccctcaggaaccaggagatgaagtcagccatgaagagattgaagggaagacttatgttttctgaaagg

SEQ ID NO: 3124 - protein, 310 aa, Felis catus
MALRNYTKVSEFIFCGLTQSQELSLLLFFFLSVVYVTTVLANVAIMVTVTYESRLHTPMYFLLRNLSVLDICFSSITAPKVLVDLLSRTKTISFNGCITQIFFFHLLGGADIFSLSVMAFDRYMAISKPLHYVTIMSRGRCTALIVASWVGGFVHSIVQISLLLPLPFCGPNVVDGFYCDVPQVLKLACTNTFALEVLMISNNGLVTTLWFVLLLVSYTVILMMLRSHAGEGRRKAISTCTAHITVVTLHFVPCIYVYARPFTALPMDRAVSITFTVIIPVLNPMIYTLRNQEMKSAMKRLKGRLMFSER

SEQ ID NO: 3125 - DNA, 936 bp, Felis catus
atggagctgagaaactgcaccagggtgaaagaatttactttccttggtctaacccagaatcaagagctgagcttggtcttatttcttttcctgcttctcgtgtacgtgacaactctgctgggaaacctcctcatcatggtcactgtgtcctgtgaatctcgccttcacacccccatgtacttcctgctccgtaatttatctattgccgacatctgcttttcctccatcactgctcccaaggttctggtggacctgctgtcacagagaaagaccatctccttcaatggctgcttcacccagatgtttttcttccaccttgtcggaggggtggatgtgttttcattatcagtgatggcattggatcgatatgtggccatctccaagcctctgcactacgtgaccatcatgagtagaggtcgttgcattggattcatagtggcctcctgggtggggggctttgtccactccattgtgcagatttccctgttggttccactcccgttctgtggacccaatgttcttgacactttctactgtgatgtcccccaggttctcaagctctcctgtacagacatttttatacttgagttgctgatgatttccaataatggactgctcaccacactgtggttcttcttcctcttggtgtcatatatggtcatattattagtagtaaggtctcaggcaggggaggggaggaggaaagccatctccacctgcacctcccacatcactgtggtgaccctgcactttgtgccctgcatctacgtctatgcccggcccttcactgccctccccacagataaagccatctctgtcaccttcactgtcatctccccgctgctgaaccccttgatctacacgctgaggaaccaggagatgaagtcagccatgaggagactgaagagaagactcatgccttctgacagggaatag

SEQ ID NO: 3126 - protein, 311 aa, Felis catus
MELRNCTRVKEFTFLGLTQNQELSLVLFLFLLLVYVTTLLGNLLIMVTVSCESRLHTPMYFLLRNLSIADICFSSITAPKVLVDLLSQRKTISFNGCFTQMFFFHLVGGVDVFSLSVMALDRYVAISKPLHYVTIMSRGRCIGFIVASWVGGFVHSIVQISLLVPLPFCGPNVLDTFYCDVPQVLKLSCTDIFILELLMISNNGLLTTLWFFFLLVSYMVILLVVRSQAGEGRRKAISTCTSHITVVTLHFVPCIYVYARPFTALPTDKAISVTFTVISPLLNPLIYTLRNQEMKSAMRRLKRRLMPSDRE

SEQ ID NO: 3127 - DNA, 936 bp, Felis catus
atggagttgggaaatagcacaagggtaaaagaatttatatttttgggacttactcagtcccaaaacctgagtttggtcctatttctttctttgtgcttggtatacatgacaactcttctgggaaacctcctcatcatggtcactgtgacctgcgagtcccgccttcacacgcccatgtacttcctgctccgcaatctctccgtcttggacatctgcttctcctccatcaccgctcccaaggtcctcgtagacctcctgtcaaggacgaagaccatctccttcaatggttgcatcactcagatcttcttcttccacctcctcgggggggcagacattttttctctctctgtcatggccttcgaccgctacatggccatctccaagcccctgcactacgtgaccatcatgagcagggggcgatgcactgccctcatcgtggcctcctgggtggggggctttgtccactccatcgtgcagatttccctgttgctgcccctccctttctgtggacccaatgttgttgatggcttctactgtgacgtcccccaggtcctcaaacttgcctgtacagacacctttgtacttgaactcctgatgatttccaacaatggcttagtcactaccctgtggtttattttcctgcttgcatcctacacagtcatcttgacaatgctaaggtctcagggaggggagggaaggaggaaagccatctccacctgcacctcccacatcactgtggtgaccctgcactttgtgccctgcatctacgtctatgcccggcccttcactgccctccccacagataaagccatctctgtcaccttcactgtcatctccccgctgctgaaccccttgatctacacgctgaggaaccaggagatgaagtcagccatgaggagactgaagagaagactcatgccttctgacagggaatag

SEQ ID NO: 3128 - protein, 311 aa, Felis catus
MELGNSTRVKEFIFLGLTQSQNLSLVLFLSLCLVYMTTLLGNLLIMVTVTCESRLHTPMYFLLRNLSVLDICFSSITAPKVLVDLLSRTKTISFNGCITQIFFFHLLGGADIFSLSVMAFDRYMAISKPLHYVTIMSRGRCTALIVASWVGGFVHSIVQISLLLPLPFCGPNVVDGFYCDVPQVLKLACTDTFVLELLMISNNGLVTTLWFIFLLASYTVILTMLRSQGGEGRRKAISTCTSHITVVTLHFVPCIYVYARPFTALPTDKAISVTFTVISPLLNPLIYTLRNQEMKSAMRRLKRRLMPSDRE

SEQ ID NO: 3129 - DNA, 936 bp, Felis catus
atggatcagggaaactacaccagagtgaaagaatttattttcctgggaattactcagtctcaagagctgagctgggtcttgtttggcttcttgtttttggtgtacatgacaactctgctgggaaacctcctcatcatggtcactgtgacctgtgagtctcaccttcacacccccatgtacttcctgctccgcaatctttctgtgcttgacatctgcttctcctccatcactgctcccaaggtcctagttgatcttctgtcagagaaaaaaaccatttccttccatggctgtgtcacccaaatgttcttcttccatcttcttggaggagcagatgttttttctctctctgtgatggcctttgatcgctatgtagccatctcaagaccccttcactatatgactatcatgagtaagggacgatgtactagcctggtgctggcctcctgggtggggggctttgtccactccatcgtgcagatttctctgttgctgcccctccccttctgtggacccaatgttcttgacacgttctactgcgatgttccccaggtcctcaaactcgcctgcaccgacaccttcactctagagctcctgatgatttccaataacggactggtcagttggttgattttcttctttctcctcatatcttacacagtcatcctgatgatgctgaggtctcatgcaggggagggaaggaggaaagccatctccacctgcacctcccacatcaccgtggtaaccctgcactttgtgccctgcatctatgtctacgcccggcccttcactgccctccccacagatactgccatctctgtcaccttcaccgtcatctcccctttgctcaatcctatgatctacacactgaggaatcaggaaatgaagtcagccatggggagactaaaaaaacgactagggcattcagaaaggatttaa

SEQ ID NO: 3130 - protein, 311 aa, Felis catus
MDQGNYTRVKEFIFLGITQSQELSWVLFGFLFLVYMTTLLGNLLIMVTVTCESHLHTPMYFLLRNLSVLDICFSSITAPKVLVDLLSEKKTISFHGCVTQMFFFHLLGGADVFSLSVMAFDRYVAISRPLHYMTIMSKGRCTSLVLASWVGGFVHSIVQISLLLPLPFCGPNVLDTFYCDVPQVLKLACTDTFTLELLMISNNGLVSWLIFFFLLISYTVILMMLRSHAGEGRRKAISTCTSHITVVTLHFVPCIYVYARPFTALPTDTAISVTFTVISPLLNPMIYTLRNQEMKSAMGRLKKRLGHSERI

SEQ ID NO: 3131 - DNA, 936 bp, Felis catus
atggagcagggaaattacaccagggtgaaagaatttatttttcaaggactgacccagtcccgagagttaagcttggccttatttcttatgttatttctggtgtacacatcaactcttctgggaaacctcctcatcatggtcactgtgacctgcgagtcccgccttcacacgcccatgtacttcctgctccgcaatctctccgtcttggacatctgcttctcctccatcaccgctcccaaggtcctcgtagacctcctgtcaaggacgaagaccatctccttcaatggttgcatcactcagatcttcttcttccacctcctcgggggagcagacattttttctctctctgtcatggccttcgaccgctacatggccatctccaagcccctgcactacgtgaccatcatgagcagggggcgatgcactgccctcatcgtggcctcctgggtggggggctttgtccactccatcgtgcagatttccctgttgctgcccctccccttctgtggacccagtgttgttgatggcttctactgtgacgtcccccaggtcctcaaactcgcctgcaccagcacctttgctcttgaggtcttaatgatttccaacaatggcttaatctctacactatggtttgtcttcctccttgtgtcctacacagtcatcttgacgatgctgaggtctcacgccggggagggaagaaagaaagccatctccacctgcaccgcccacatcactgtggtgactctgcactttgtgccctgcatctacgtctacgcccggcccttcactgcccttcccatggacagagctgtctccatcaccttcacggtcatcatcccggtcctgaaccccatgatctacaccctcaggaaccaggagatgaagtcagccatgaagagactgaggaaaagacttggaccttcagaaaaagaatag

SEQ ID NO: 3132 - protein, 311 aa, Felis catus
MEQGNYTRVKEFIFQGLTQSRELSLALFLMLFLVYTSTLLGNLLIMVTVTCESRLHTPMYFLLRNLSVLDICFSSITAPKVLVDLLSRTKTISFNGCITQIFFFHLLGGADIFSLSVMAFDRYMAISKPLHYVTIMSRGRCTALIVASWVGGFVHSIVQISLLLPLPFCGPSVVDGFYCDVPQVLKLACTSTFALEVLMISNNGLISTLWFVFLLVSYTVILTMLRSHAGEGRKKAISTCTAHITVVTLHFVPCIYVYARPFTALPMDRAVSITFTVIIPVLNPMIYTLRNQEMKSAMKRLRKRLGPSEKE

SEQ ID NO: 3133 - DNA, 886 bp, Felis catus
ctttcagcaacttgttcctcctactatagatcaaggcattcaagacaggggtgacaaaggtgtagacaacagacacccatttctgggttatagctagagctggggcataaatacataaggctacaggagccatactggaggagagccatggtcagatgagaggaaaaggtggagaaggccttgcaccatccctctgcagagcagatcttcaaaatggcacccacaatgaagatgtatgagatggagatcagggaacagggaatggtaagcatgatgacactgacaatgaagatcatggcttcttgtatttgagtgtctccacaggccaactgtatgatcggagtacatcacagtagaagtgagtgattctgttgtggccacaaaatggcagggggggaatcagagctgttggttgtatggctagagtgaaaccaaggaccagggctcccatagccaattaggcacacagctaccatcgcatgctgagggtgtaatgcagggaatcctgaatagctacaaaccgatcataagccatgatccccaagaggaaacagtcagcactgcccaggaagacaaagaagaacatctatgtgccacagtcagtgaaagagatgggcattctccccatggtcaggaggttgaccaaagggagaggggcaacaagtggaagagtataagatctccggaactgccagattagccagaaagaaagacatgggaatgtggagtgaacgttccgcccagatagtgagaaagactgtggtattaccaatgagactgccaatatacattagcaggaaagttacaaaaacatttgtatctccaggatgggtgaaaatggttgaaagtggaactggatctctatggtttagttttcatcccccat

SEQ ID NO: 3134 - protein, 58 aa, Felis catus
  MOD_RES (58)..(58): Any amino acid
MGMWSERSAQIVRKTVVLPMRLPIYISRKVTKTFVSPGWVKMVESGTGSLWFSFHPPX

SEQ ID NO: 3135 - DNA, 930 bp, Felis catus
ctagaacttcctcagcgccttctgtagggcatctttcagttccttgttccgcatactgtagatcaaagggtttaaaatgggagtgatgaaggtgtagaccacggacaccacccggcccatctcaggagagtagctggaactgggagacaagtatataaagctggtgcagccatactgcaggaggaccactaagatgtgcgaggagcaggtggagaaggctcggtggcgcccttctgttgaccggatccgtaaaatggctgccacgatgaagacgtaggagatggagattaatgagagcgggacgcttaggacgatgaagctgacgatgtacagggcagtcttgtgaatgtgtgtgtccgcacaggccaggcgcatgacagcaggcatgtcacagtagaagtggtagatctcattgttgttgcagaatgggagacggaagatcaaaatagtcagtggcagggacagcaggaaccccagcaccagggaccctaccaccagctccacacacaagggccagctcatgacgtgggtgtatcgtagagggtaacagatggctacaaaccggtcataagccatgaccgcaagcaggacacaatcagctccacccaggaagacaaagaaaaacatttgggtcccacagccagggatggaaacaggagtcctgcccattgaaagaaggttcgccaaggccagtggggcaatggaagatgtgtagaagatttccagaactgccaggttcgccaggaaaaagtacatggggatgtggagggagtggttgatctggacaatgaccgcaattgtggtgtttccgctgaggctgatcaggtacatcgtcaggaaggccacaaaaatgcctacttgtaccttagggtcagctgagaatggacgaaagaagaattgtatctttgcagttttatttatttcttccat

SEQ ID NO: 3136 - protein, 309 aa, Felis catus
MEEINKTAKIQFFFRPFSADPKVQVGIFVAFLTMYLISLSGNTTIAVIVQINHSLHIPMYFFLANLAVLEIFYTSSIAPLALANLLSMGRTPVSIPGCGTQMFFFVFLGGADCVLLAVMAYDRFVAICYPLRYTHVMSWPLCVELVVGSLVLGFLLSLPLTILIFRLPFCNNNEIYHFYCDMPAVMRLACADTHIHKTALYIVSFIVLSVPLSLISISYVFIVAAILRIRSTEGRHRAFSTCSSHILVVLLQYGCTSFIYLSPSSSYSPEMGRVVSVVYTFITPILNPLIYSMRNKELKDALQKALRKF

SEQ ID NO: 3137 - DNA, 1007 bp, Felis catus
atgactcctttccttgttccaggtctgatggaagaggaaaaccggatgggggtggtctactttcacttccaccccttctcaaccgacccagcagtggctcccctcctatttgtggccttcttggtgtcgtacttaggaagtctcattggaaacatcaccactgggctcacagtctggcgagatcactccccccacaccccgatgtgcttcttcctcttcgcactggctgtgctggcaattggctactccaccaacattgctcccctgactctggctggcatcctttccacggggcacatgctcgtctctctccctggctgtggggcctagatgttccccttcattcttcttggagggtctgactgtgtctttcttgctgtcatggcctacgacaggtacatggcaatctgccacctagtgcgttaccacatcatcatgagttggtggctctgtgggcagatgactttaggttctttgggcctgggattcctgttgtcactgcctttgaccattctgatctgccaccttccaatctgtggccgcaatgaaatcttctgcttctgtgacatgcctgacgtcatgcacctggcctgtgtggacacccgcatgcacaaggcagctctctatgccatcagtgtggccgcagtggctgtccccttcctcctgatctgcctctcctatggctacattgtggccaccatcctgaggatgaattcagctgagggaaagtgccgggctttctccacctgttcctcccacctcatcgtggttctcctgcagtttggatgttgcacccttatctactttcaccccagctccagttcctcttcagaagagggccgggcagtgtctgttgtctacaccttttttgcaccagtgctaaaccccttgatctatagcataaggagtcaagaggtgaccgatgcgggaagaagacttacagtaagaacgtgctggttcaggaaaccagaaatattccttcctagaagaaatattccccaaaccag

SEQ ID NO: 3138 - protein, 226 aa, Felis catus
  MOD_RES (226)..(226): Any amino acid
MFPFILLGGSDCVFLAVMAYDRYMAICHLVRYHIIMSWWLCGQMTLGSLGLGFLLSLPLTILICHLPICGRNEIFCFCDMPDVMHLACVDTRMHKAALYAISVAAVAVPFLLICLSYGYIVATILRMNSAEGKCRAFSTCSSHLIVVLLQFGCCTLIYFHPSSSSSSEEGRAVSVVYTFFAPVLNPLIYSIRSQEVTDAGRRLTVRTCWFRKPEIFLPRRNIPQTX

SEQ ID NO: 3139 - DNA, 937 bp, Felis catus
atggagggtacaaatcagactgggatgattcacttccacttccgccccttctccaaactccccgaggtgcagacgctgattttcgtggccttcctcgtcatgtacctggtcagcatcggcggcaacggctccatttctctcatcatctggagcaaccgttctttgcacacccccatgtacttcttcctggccagcttggcagctctggagatctgctactcttccaccattgcccctctgactctggccagcgtcctgtccgcagagagagccctcatctccctgcctggctgtggtgcccagatgttcttcttcatcttcctgggcagcgctgactgcattctactagctgtcatggcctatgacaggtttgtggccatctgccaccctttgcgttacaccctcatgatgagctggcggttgtgcgtccagctggccctggggtctctggcgctggggttcatcttggccatgcagctgactgtgctcatcttccgcctccccttctgccgcagccaagaaatcagcctgttctactgcgatgtcctccctgtcatgagactggcctgtgcagatacatgggtccatgaggccaccctgttggtggtcagcctcaccgtcctcaccatccccttcctgcttatcgccctctcctacgttttcatcatggccgccatcctgaagatccgctcggcagaggggaggcacaaggccttctccacctgctcctcccacctgactgtggtcctgctccagtacggatgtggaagcctcatctacttgtgccccagctccaggtactctccagagagaggccaggtagtgtctgtggtttacaccttcgtcacccctgtgctgaaccccttgatctacagcatgagaaacagagagcttacggatgctttgaagagaacaatgatgaggttcctgttgtcct

SEQ ID NO: 3140 - protein, 313 aa, Felis catus
  MOD_RES (313)..(313): Any amino acid
MEGTNQTGMIHFHFRPFSKLPEVQTLIFVAFLVMYLVSIGGNGSISLIIWSNRSLHTPMYFFLASLAALEICYSSTIAPLTLASVLSAERALISLPGCGAQMFFFIFLGSADCILLAVMAYDRFVAICHPLRYTLMMSWRLCVQLALGSLALGFILAMQLTVLIFRLPFCRSQEISLFYCDVLPVMRLACADTWVHEATLLVVSLTVLTIPFLLIALSYVFIMAAILKIRSAEGRHKAFSTCSSHLTVVLLQYGCGSLIYLCPSSRYSPERGQVVSVVYTFVTPVLNPLIYSMRNRELTDALKRTMMRFLLSX

SEQ ID NO: 3141 - DNA, 925 bp, Felis catus
ctctggatgatgagtctttggacaagccattgccttccttagggctgctttcacctccttgtttctaattgtacaaatgaagggattcagaaggggtgtcaggatagtatttggcactgacaccaccttattaatcttagaggaagagtgtgctgtgggtctcaggtacgtgaacaaaacggcaccatagagcagggagactgctgtcaggtgggaggcacaggtcgagaaaatcttctgttggccagtggctgaagggatctgtaggatggtggacaggatacagatataagaagtcgctgtgaagaggagtgaccctgggatcacctggacggtcgccaaaagacccgggagctccaaaatgcttgtgtctgtgcaggctgctttcaaaatgggaccaacatcacagtagaaatggttgatgacattgtcgccacagaatggcaactggatgagcggtagcatctgacaaaagacgatggtaaagcctaccacccaggagctgagggcaagttgcaggcagaggttgctggtcatagtggtggggtagcgaaggggcttgcagatggccaggtaatggtcaaaagacatgacaatgaagataaagaactcggcggttcccgggaaaaagtggaagaaggcagcaggggatgcagatagctgttcttgccaccacaaacgtttctgatagtttgggaatgaccgtggtagggaaccagatctctaggaaggacaaggtgcaaaggaagaagtacattggtatttgtagcctgggctcagcccagacaatggagattttgaacccattgcctgcaagggttaatacgtagatgcaaaagatcacgagaaagagagggatttgtagtccttgggtatcaggaaagcctagaaggatgaactctgtgatggtcgtgccatttgtcat

SEQ ID NO: 3142 - protein, 197 aa, Felis catus
MSFDHYLAICKPLRYPTTMTSNLCLQLALSSWVVGFTIVFCQMLPLIQLPFCGDNVINHFYCDVGPILKAACTDTSILELPGLLATVQVIPGSLLFTATSYICILSTILQIPSATGQQKIFSTCASHLTAVSLLYGAVLFTYLRPTAHSSSKINKVVSVPNTILTPLLNPFICTIRNKEVKAALRKAMACPKTHHPE

SEQ ID NO: 3143 - DNA, 947 bp, Felis catus
ccggttatccttagtatcaaggacatgattctgtttattgtctctctcaatacttctttcaccttttcatttctcaaactataaataaaaggattcaggagaggggtcaccactgtaatgaggacagcagctaccttgtcaaaattcagggaatagttctgattgggtctcacatacacaaagatattgctcccgtaagcaatggcaatgaccgtgatatgagaagcacaggtagaaaaagccttttgacggccttgggccgaggggatgcgcaggatggtagagatgatgtaggtataggacgcagtagtgaatgccagggagctcaggatgacaagggcagataggaggaagttgatctgctcaatgaggtgagtatctacacaggccacctgcagaagaggggcaatgtcacagaaaaaatgattgatttcttttccacagtaaggtagccttgtcactacaatggttggtaccaacacagacaggaaggctcctacccagcagctcagaaccagcaggaggcaggtcctgctgttcatgatgatggtatagcgcagggggttacagatggccacgtagcggtcaaaggacatcactgctaggaggataaactccactgtccccagaaagaagtagaaatatgtttgagtgatacagccagcaaaggatatggttttcttctctcctaggaggcaggctagcaactttggtgtaacgacagtggtgtataaaatatccagaaaagacagattactgaggaaaatgtacattggggtttgcaggtgattatcagtccatattaggaagatgatgacaatgtttcctattgctgttagtgtgtacgtcagcaaaagaaccacaaagaggagtattcgaagctccaggagagtgggaaaggcgatcagggtgaattcagtcaccgtgctccaatttcccatgggcat

SEQ ID NO: 3144 - protein, 316 aa, Felis catus
MPMGNWSTVTEFTLIAFPTLLELRILLFVVLLLTYTLTAIGNIVIIFLIWTDNHLQTPMYIFLSNLSFLDILYTTVVTPKLLACLLGEKKTISFAGCITQTYFYFFLGTVEFILLAVMSFDRYVAICNPLRYTIIMNSRTCLLLVLSCWVGAFLSVLVPTIVVTRLPYCGKEINHFFCDIAPLLQVACVDTHLIEQINFLLSALVILSSLAFTTASYTYIISTILRIPSAQGRQKAFSTCASHITVIAIAYGSNIFVYVRPNQNYSLNFDKVAAVLITVVTPLLNPFIYSLRNEKVKEVLRETINRIMSLILRITG

SEQ ID NO: 3145 - DNA, 948 bp, Felis catus
tcaagttctcctgtgtaataaggacatgattttgctgattgcttctctcaaaactttttttacctttgcattccttagactataaatgaaggggttcagaagaggcgtcaccatagtggtgagaacagcagtcactttgtcaaaatccagcgaacggctctggctgggcctcacatacatgaagatgttgctcccataggcaatggagacgaccgtgatgtgagaagcacaggtggaaaatgccttctgacgtccttgggctgaggggatgcgcaaaatggtagaaatgatgtaggtgtaagacacaatggtgagtaccagcgaggtcaggaggacgagggaagataagaggaagtttatcatctcaatgaaatgagtgtctatgcaggccacctgtagcagaggggcaatgtcacagaaaaaatgactgatttctttatgacagtagggcagtctggacactacaatagttgggcacagcactgagaagaaggctcctacccagcatcccagaaccagtaggagacagacgttgctgttcatgatgatggtatagcgcagggggttacagatggccacgtagcggtcaaaggacatcactgctaggaggataaactccactgtccccaagaaaaagaagaagtatgtttgggttatgcagccagcaaaagatatggtcttcctgtcctctagaagacaagctaatagctttggggtaactgaggtagtgtataaaatgtccagaaatgacaaattactgaggaagaagtacattggggtttggaggcggttatcagcccatattagggaaacgatgacaatatttcctgtgagagttaacatgtaaataaacaagaggaccacaaagagagagatctgaagcttccggataacagggaaggcagtcagggtgaattcagtcactgtggtctgattttgcatatccat

SEQ ID NO: 3146 - protein, 315 aa, Felis catus
MDMQNQTTVTEFTLTAFPVIRKLQISLFVVLLFIYMLTLTGNIVIVSLIWADNRLQTPMYFFLSNLSFLDILYTTSVTPKLLACLLEDRKTISFAGCITQTYFFFFLGTVEFILLAVMSFDRYVAICNPLRYTIIMNSNVCLLLVLGCWVGAFFSVLCPTIVVSRLPYCHKEISHFFCDIAPLLQVACIDTHFIEMINFLLSSLVLLTSLVLTIVSYTYIISTILRIPSAQGRQKAFSTCASHITVVSIAYGSNIFMYVRPSQSRSLDFDKVTAVLTTMVTPLLNPFIYSLRNAKVKKVLREAISKIMSLLHRRT

SEQ ID NO: 3147 - DNA, 941 bp, Felis catus
cccttggaatgtgatggaactatcctgctaactgactctttcaagacttcctttaccttttcattcctcaagctataaatgaaaggattcagaagaggggtcaccattgtagtgaggacagccgtcactttatcaaaatccagtgaatggctctggttgggcctcacgtacgtgaagatggagcttccataggcaatggagacaactgtgatgtgagaagcacaggtggaaaaggccttctgacgtccttgggctgaggggatgcgcatgatggtagaaatgatgcaggtgtaggatgtggtggtgagcaccagtgaactcaggaccacaagggaagataagaggaagtttatcatctcaatgaagtgggtatcaatgcaggccacctgtagtaaaggggcaatgtcacagaagaaatgactaatttctctatgacagtagggcaatctggacaccacaatagttgggcatagcactgagagaaaggctcccacccagcagcccagaaccagcaggagacagaccctactgttcatgatgatggtatagcgcagggggttacagatggccacatagcggtcaaaggacatcaccgctaggaggataaactccacagtccccagaaagaagtagaaataaacttgagtgatgcagccagcaaaggatatggttttcttcttttctaagagacaagctagcaactttggggcaatagtagttgtgaacaaaatgtccaaaaatgacaaattactaaggaagaaatacattggtgtctggagacgattatcagtccatattaaggaaatgatgacaatgtttcctgttatgatgagcatataaaccagcaggagaatgacaaacagcaagacttgaagctcctggatggcaggaagggagaccaatgtgaattcactcaatgtactctggtttctcatagccat

SEQ ID NO: 3148 - protein, 314 aa, Felis catus
MAMRNQSTLSEFTLVSLPAIQELQVLLFVILLLVYMLIITGNIVIISLIWTDNRLQTPMYFFLSNLSFLDILFTTTIAPKLLACLLEKKKTISFAGCITQVYFYFFLGTVEFILLAVMSFDRYVAICNPLRYTIIMNSRVCLLLVLGCWVGAFLSVLCPTIVVSRLPYCHREISHFFCDIAPLLQVACIDTHFIEMINFLLSSLVVLSSLVLTTTSYTCIISTIMRIPSAQGRQKAFSTCASHITVVSIAYGSSIFTYVRPNQSHSLDFDKVTAVLTTMVTPLLNPFIYSLRNEKVKEVLKESVSRIVPSHSKG

SEQ ID NO: 3149 - DNA, 936 bp, Felis catus
ttataaaggcatttttctttttaagcgttttatcagtgcatctttcacttccttgttcctcagactatatatcaggggattcaacatgggaatcacggtggtgtaaaatactgaggatactttctcctggatgagtgagctgcgggaagcaggtttgagatacatggacatgagagtcccataaaatgtaagaacagctgtcaagtgggaactgcaggtgctgaaggctttggacctgccctctgtcgagtgcatgcggaggatgctggagagaataaagacataagaaatgatgattgtcaggctggtgactatcatgttaaatccaccaatgacaaaaatcaaaagttcatcaatataagtgcttgaacaagagagtttaataagtgggatgatgtcacagaaataatgtttaatgatgttcgagccacagaaattcagccttaatatacaacctccatgaatcatagcatcggtaaatccaattgagaagccagaagccaccagcagagaacagactcgaggggacatgatgacattgtagagcagggggctgcagatggcgacatagcgatcataggccattacagctaacatgtagcactcagaaatgacaaacatacagaaaaaaaatagctgagtcatgcatccagaataggagatagctgtatccctgcataaaagctctgccagcaacttgggagtaataacagaagaatagcacaaatctaccaaagacagactactgaggaaatggtacataggggtgtgaagttgggaactgaacctaattattgagatcatgccgagatttcctaccactgtgactgtataaatccctaagaagaggcagaaaagaggcagctgaagctctggttggtcagttagtccccaaagaagaaactcagtcactgtggaatgatttcttgtgcccat

SEQ ID NO: 3150 - protein, 311 aa, Felis catus
MGTRNHSTVTEFLLWGLTDQPELQLPLFCLFLGIYTVTVVGNLGMISIIRFSSQLHTPMYHFLSSLSLVDLCYSSVITPKLLAELLCRDTAISYSGCMTQLFFFCMFVISECYMLAVMAYDRYVAICSPLLYNVIMSPRVCSLLVASGFSIGFTDAMIHGGCILRLNFCGSNIIKHYFCDIIPLIKLSCSSTYIDELLIFVIGGFNMIVTSLTIIISYVFILSSILRMHSTEGRSKAFSTCSSHLTAVLTFYGTLMSMYLKPASRSSLIQEKVSSVFYTTVIPMLNPLIYSLRNKEVKDALIKRLKRKMPL

SEQ ID NO: 3151 - DNA, 945 bp, Felis catus
atgaatccagcaaatcattcccaggtgacaggctttgtcctcctggggctctctcaggtatgggggcttcggttcctcttctttattatcttctctgttgtgtatcttatgaccgtagctggaaatctccttattgtggccatagtgacctgtgactcacgcctccacacaaccatgtactttctcttaggcaacctttctttcctagacctttgctactcttccatcacagcacctaggatgctgtttgacttgctctcagacaaccccatcatttccttcggcagctgcctgactcagctcttcttcttccacttcattggaggcatcaagatcttcctgctgacggtgatggcatatgaccgctatgttgccatctcccagccattgcgctacatgcttgtgatgaaccgcacagtctgtgggctcctcatggtagcctcctgggtggggggcttcatccactccattgtgcagattggactgactatccagctgccattctgtgggcctgacaagctggacaacttttactgtgacgtgcctcagctaatcaaattagcctgcacggatacctttgtcttagagcttctgatggtgtctaacaatggcctggtaactttgatgtgttttctggtgctcctgggatcctacacggcactgctagtcatgctccgaggccactcatgggagggccggagcaaagccctatccacttgtgcctctcacattgctgtggtgaccttaatttttgtgccttgtgtctacatctatgcgaggccatttcggacattccctatggacaaggcggtctctgttctgtacacaatggtcactcccatgctgaatcctgccatctataccctgagaaacaaggaagtgatcgtggccatgaagaaactgtggaggaggcagaaagaccttctgggccccctggagcactga

SEQ ID NO: 3152 - protein, 314 aa, Felis catus
MNPANHSQVTGFVLLGLSQVWGLRFLFFIIFSVVYLMTVAGNLLIVAIVTCDSRLHTTMYFLLGNLSFLDLCYSSITAPRMLFDLLSDNPIISFGSCLTQLFFFHFIGGIKIFLLTVMAYDRYVAISQPLRYMLVMNRTVCGLLMVASWVGGFIHSIVQIGLTIQLPFCGPDKLDNFYCDVPQLIKLACTDTFVLELLMVSNNGLVTLMCFLVLLGSYTALLVMLRGHSWEGRSKALSTCASHIAVVTLIFVPCVYIYARPFRTFPMDKAVSVLYTMVTPMLNPAIYTLRNKEVIVAMKKLWRRQKDLLGPLEH

SEQ ID NO: 3153 - DNA, 935 bp, Felis catus
tagtccctcgcagccatggttctgtgccacatcagggcaactcttagggcctgcttcaccttatcattgcggagactgaagatgaatgggttcaggagaggtgtgatgatacagctcaggacggaggcccctttgtggagcagtgtggactgagcctctgacatacggatgtagagaaaaatggagctgccatagacaatgatgaccactgtaaggtgtgaggcacaagtggagaatgctttttttcgctccgcaggtgtgggggccctgaaaacagtggcaagaatgcaggcgtaggaaaccgaggtcagtgccagcgagcccagtaacactgacgtggagagcacgaaagccaccagctccagtaagcgggtgtctccgcaagagagcctcagcaagggccaactgtcacagaaaaagtggtcaataccattggggccacagaaaggcaagttggccatgaggatggtggggcacaggacccagaggaatccagctaaccaggaggccagaaccagttgggaacagacacggccattcattagagtctcatagtggagaggtcggcagattgccaagtaacgatctagagacatgacagctaagaggaagaagtcggtggtgcctaggaggaagtagaagtaagactggatgatgcaggtggcgaatgagatggagtggtcccccgtaagaatgacaacaagcatcttgggaaccacaacagacacgagcaacagctccaggaaggacaggtgcctcaggaagaagtacatctgtgtgtgcaggtgtcgattcgtccaactgagcccaatgatgagcaggttgcctgtggccgttacagcgtaggctgccatcaaagccaggaacagcaggaactgcaggatgtggcttctagggaaacccagaaggacaaaccctgtcacgtgagtccagtt

SEQ ID NO: 3154 - protein, 312 aa, Felis catus
  MOD_RES (312)..(312): Any amino acid
NWTHVTGFVLLGFPRSHILQFLLFLALMAAYAVTATGNLLIIGLSWTNRHLHTQMYFFLRHLSFLELLLVSVVVPKMLVVILTGDHSISFATCIIQSYFYFLLGTTDFFLLAVMSLDRYLAICRPLHYETLMNGRVCSQLVLASWLAGFLWVLCPTILMANLPFCGPNGIDHFFCDSWPLLRLSCGDTRLLELVAFVLSTSVLLGSLALTSVSYACILATVFRAPTPAERKKAFSTCASHLTVVIIVYGSSIFLYIRMSEAQSTLLHKGASVLSCIITPLLNPFIFSLRNDKVKQALRVALMWHRTMAARDX

SEQ ID NO: 3155 - DNA, 929 bp, Felis catus
atggcagtaggaaatgcctcttcagtgacccagtttatcctgctgggtttaacacaacagccagaactccagctgcctctcttcttcattttcttaggaatctacgtggtcaccgtgatggggaacatgggcttgattattctgattggtctgaagcctcacctgcacactcccatgtactactttctcttcaacctttccttcattgatctctgctactcgtctgtcataatgcctagaatgctgataggttttgtaaagcaaaacaccatctcttacgcagagtgcgtggctcagctctgtttcttctccttctttgtcattgatgagtgctatattttgacatcgatggcctatgaccggtatgtggccatctgtaagcccctgctttacaaggccatcatgtcccaccaggtctgcctcatgctgatggcaggaacatatgcagtggggtttgtgggtgccatggcgcacaccgggtgcatgctgaggctcacgttctgtgatggcaacatcattaatcattacatgtgtgacatacctcctctccttcagctctcctgcacaagcacctacgtcaacgagctggtggttttcattgtggtgggaatcaatgtaataatgcccagtctcaccatcaccatttcttacaccttgatcgtctccaacatcctccgtatccgttctacagggggcaggtccaaagccttcagtacctgcagctcccacatagttactgtttctctcttctttggagcatcggcattcatgtatctaagacctttttctactgggtatttggatcaagataaggtatccacagttttttataccattgtggggccaatgttgaatccttttatctatagtctgaggaacaaagatgtcaaaattgcactgagtaagacttttaagaaaagggtgttctc

SEQ ID NO: 3156 - protein, 310 aa, Felis catus
MAVGNASSVTQFILLGLTQQPELQLPLFFIFLGIYVVTVMGNMGLIILIGLKPHLHTPMYYFLFNLSFIDLCYSSVIMPRMLIGFVKQNTISYAECVAQLCFFSFFVIDECYILTSMAYDRYVAICKPLLYKAIMSHQVCLMLMAGTYAVGFVGAMAHTGCMLRLTFCDGNIINHYMCDIPPLLQLSCTSTYVNELVVFIVVGINVIMPSLTITISYTLIVSNILRIRSTGGRSKAFSTCSSHIVTVSLFFGASAFMYLRPFSTGYLDQDKVSTVFYTIVGPMLNPFIYSLRNKDVKIALSKTFKKRVFS

SEQ ID NO: 3157 - DNA, 930 bp, Felis catus
gcctccgcgcagaagtctttgcagagcccgcttgacctccttgttccgcggagtgtaaatgaaaggggtgagcgtgggggtgatgattgtgtagaagacagcaggggccccagcccctgcccccgcggagcaaggctgcaggtagatgcatacaggtggcatgcagttcagcagcaccacggtgaggtgggaggtgcaggtggagaaggcacgctgccagccttgggcagggcggacccgcagcacggccgccacactaaagacgtccggtatgatgatgaagggaagacacctgccgccacaaggccgatgttggcaagcgtgacgggctcactgatggtggtgtctgcgcaggccagcttcagcacggggggcatgtcacagaagaagcgggcgatgtggtgaggaccacagtagagcaggcgaaaggtgagggcggtgtggacggcagagtgcccagcacctatggcccaagtgatcccagcccgccctgcacacatccgtctgttcatgtccccctgggtagtgtaggggttggcagatagctaggtagcggtcgtaggccgtgatggcgtatagaaagtactcggtgctggccaggaaacggaagcagtaaagctgaaccgcacagccctcagaggagatcaccttcccatgcaccgtcaggagaaggcctgccatgaccttgggcactgtcactgtggacagacaggcatccagggaggagagatgccccaggaagtggtacataggggagcagaggtgaggctcagagcccacagttatgagaatgaggagattcccagtcaaggcgatgctgtagatgaggaggaagagaaggaagaagaggccaggatgttcagctgtatacatgagaccctccaggaagaagtggctcagcacagcctggttgggggcctctgtctccat

SEQ ID NO: 3158 - protein, 183 aa, Felis catus
METEAPNQAVLSHFFLEGLMYTAEHPGLFFLLFLLIYSIALTGNLLILITVGSEPHLCSPMYHFLGHLSSLDACLSTVTVPKVMAGLLLTVHGKVISSEGCAVQLYCFRFLASTEYFLYAITAYDRYLAICQPLHYPGGHEQTDVCRAGWDHLGHRCWALCRPHRPHLSPALLWSSPHRPLLL

SEQ ID NO: 3159 - DNA, 936 bp, Felis catus
tcagtgaggcagcacatccttgcgacctcccagcctccacaatgctgccttcatctctttgttgcggagcgtgtagacgatggggttaagcaagggggtgatgacagtgtagaagacggcgaccactccatccagggtttcctgagagccagggcgaaggtaaatgaaggtgcagggcacatagtaaacaatgacaacagtgaggtgggcagcacaggtggagaaggcgttgcggcgcccatcagcggactggattcgcaggatggcagccactatatacccataggaagtgaggatgagcatgaagcaggtgagggccaagaacccaatgtccacaaaggtgaccagctcattgacggtgatatcagcacaggctagacgcaacatggcgggaatgtcacagaagaagtagtctacctggtttgggccacagaagggcagccggaatatgaagcttgtttggaaaagtgagtggagggtacctcccagccaggtgcccaaggccaggtaattacagacgttccgggtcatgatggtggcataatgtaaaggcttacagatggccaagaagcgatcataagccatgagcgtgtaaaggaagcattcagtacagcccaggaaatggaaagaaaagagttggattacacagcctccaaaggagatgaccctgctatccaagacaaagccagctagcatcttggggacaatggcagaggaaacggtcatgtccaggaaggagagatgacacaggaaccagtacatggggcggtgaagccgggtgtccaccaagacagtgaagatgatgagcccgttgccagagacagtgagggcatagatgaccaggaaagccaggaagagcggcacccccagctgcggtgggtggtgcaggcccaccaaaatgaagtgagacacagaagtctggtttccactgtgcat

SEQ ID NO: 3160 - protein, 311 aa, Felis catus
MHSGNQTSVSHFILVGLHHPPQLGVPLFLAFLVIYALTVSGNGLIIFTVLVDTRLHRPMYWFLCHLSFLDMTVSSAIVPKMLAGFVLDSRVISFGGCVIQLFSFHFLGCTECFLYTLMAYDRFLAICKPLHYATIMTRNVCNYLALGTWLGGTLHSLFQTSFIFRLPFCGPNQVDYFFCDIPAMLRLACADITVNELVTFVDIGFLALTCFMLILTSYGYIVAAILRIQSADGRRNAFSTCAAHLTVVIVYYVPCTFIYLRPGSQETLDGVVAVFYTVITPLLNPIVYTLRNKEMKAALWRLGGRKDVLPH

SEQ ID NO: 3161 - DNA, 936 bp, Felis catus
atgagaaacatgagcgtagtgacaacgttcatcctcacgggtcttccccatgcaccagcactggacatccccctcttgggaatcttcttggtgatttatgtactcactgtggtggagaacctcctcatcctgctggtgatcacggtggattcccacctccacactcccatgtactatttcctggccaacttgtccttcatcgacatgtggttctccaccgtcactgtgcccaaaatgctgatgaccttggtctccccgggaggcggggccatctcctttcacagctgtgtggcccagctctactcctttcacttcctggggagcaccgagtgtttcctctacacagtcatgtcctacgaccgctacctggccatcagtcagccgctcaggtatgccagcctgatgggtgggagagcgtgtgccctcctggccgccaccacgtggctcagcggctctctgcactctgctgtccagaccacactgaccttccgcttgccctactgtgggcccagccagatccagcattatttctgtgacggaccacccatcctcagactggcctgtgcagacacgtccatgaacgagagggtgatcttcgtcaacatcggggtagtggcttcgggctgctttctcctgatagtggggtcctatgtgtccatcgtctgttccatcctgaagatccgcacctccgaggggagatgcagagcctttcagacctgtacctcccactgcattgtggtcctttgtttctttgttccctgtgtttttgtttacctgaggccaggctccaaggatgctgtggacaggattgtggcagttttctacactgtgctgactccccttctaaaccctgtggtgtacaccctgaggaataaggaagtgaagaaagctctattgaagcttcaagacaaagtaacatagtctcagagaaaataa

SEQ ID NO: 3162 - protein, 306 aa, Felis catus
MRNMSVVTTFILTGLPHAPALDIPLLGIFLVIYVLTVVENLLILLVITVDSHLHTPMYYFLANLSFIDMWFSTVTVPKMLMTLVSPGGGAISFHSCVAQLYSFHFLGSTECFLYTVMSYDRYLAISQPLRYASLMGGRACALLAATTWLSGSLHSAVQTTLTFRLPYCGPSQIQHYFCDGPPILRLACADTSMNERVIFVNIGVVASGCFLLIVGSYVSIVCSILKIRTSEGRCRAFQTCTSHCIVVLCFFVPCVFVYLRPGSKDAVDRIVAVFYTVLTPLLNPVVYTLRNKEVKKALLKLQDKVT

SEQ ID NO: 3163 - DNA, 928 bp, Felis catus
attcggtgaatactgacttacttctcaccttgaacagagctttcttcacttccttgttcctcagggtgtacaccacagggtttagaaggggagtcagcacagtgtagaaaactgccacaatcctgtccacagcatccttggagcctggcctcaggtaaacaaaaacacagggaacaaagaaacaaaggaccacaatgcagtgggaggtacaggtctgaaaggctctgcatctcccctcggaggtgcggatcttcaggatggaacagacgatggacacataggacagcactatcaggagaaagcagctcaaggccactactccgatgttgacgaagatcaccctctcgttcatggacgtgtctgcacaggccagtctgaggataggaggagcgtcacagaaataatgctggatctggctgggcccacagtagggcaagcggaaggtcagtgtggtctggacagcagagtgcagagagccgctgagccacgtggtggcggccaggagggcacacgctctcccacccatcaggctggcatacctgagcggctgactgatggccaggtagcggtcgtaggacatgactgtgtagaggaaacactcggtgctccccaggaagtgaaaggagtagagctgggccacacagctgtgaaaggagatggccccgcctcccggggagaccaaggtcatcagcattttgggcacagtgacggtggagaaccacatgtcgatgaaggacaagttggccaggaaatagtacatgggagtgtggaggtgggaatccaccgtgatcaccagcaggatgaggaggttccccaccacagtgagtacataaatcaccaagaagattcccaagagggggatgtccagtgctggtgcatggggaagacccgtgaggatgaacgttgtcactacgctcatgtttctcat

SEQ ID NO: 3164 - protein, 310 aa, Felis catus
  MOD_RES (310)..(310): Any amino acid
MRNMSVVTTFILTGLPHAPALDIPLLGIFLVIYVLTVVGNLLILLVITVDSHLHTPMYYFLANLSFIDMWFSTVTVPKMLMTLVSPGGGAISFHSCVAQLYSFHFLGSTECFLYTVMSYDRYLAISQPLRYASLMGGRACALLAATTWLSGSLHSAVQTTLTFRLPYCGPSQIQHYFCDAPPILRLACADTSMNERVIFVNIGVVALSCFLLIVLSYVSIVCSILKIRTSEGRCRAFQTCTSHCIVVLCFFVPCVFVYLRPGSKDAVDRIVAVFYTVLTPLLNPVVYTLRNKEVKKALFKVRSKSVFTEX

SEQ ID NO: 3165 - DNA, 927 bp, Felis catus
atgcagaactacacttctgtgacggagttcaccctgttgggaattccaaatactgaagggctggagaatatgctgtttgtcctctttctggccttctacctcttcaccttgctggggaacctgctcatcttcctcaccattctggtttcctctaacctgcacacccccatgtatttcttcctgggaaacctgtctgtgtttgacatatttttcccttcagtgagttcccccaaaatgatgctctacctaacggggccaagccggaccatctcttaccagggctgtgcctgccagctcttcttctaccacttcctgggtggcactgagtgcttcctgtacacggtgatggcctatgaccgcttcgtggctatttgtcaccctttgcgatacacagtcatcatgagccacagggtgcgtaccggcttgatgttgggcacttggctgggcggctgtctacatggaagtatcctcacgtttctggtctttaagttacccttctgtggccccaatgaggtggataatttcttctgtgatatcccagggctgctgccgctggcctgtgcagacacctctctagcccagaccgtgagttttactaacgtggatgttgtgactctgacatgctttttccttatccttacttcctacggccacatcgtcatttccatactgaaaatcggcacctctgcaggcaggcgccgagctttttccacctgcagtgcccacctgatatcaatcttcttgttttacggtccagtgatgctcatctatctcaggcccgcttccagcccctggctagattctgttattcaggtgttaaataacattgtcactccttctcttaaccctttgatttacaccttgagaaacaaggatgtgaaattggccttgaggcaagtattcactcaagtggtccacatttctggg

SEQ ID NO: 3166 - protein, 309 aa, Felis catus
MQNYTSVTEFTLLGIPNTEGLENMLFVLFLAFYLFTLLGNLLIFLTILVSSNLHTPMYFFLGNLSVFDIFFPSVSSPKMMLYLTGPSRTISYQGCACQLFFYHFLGGTECFLYTVMAYDRFVAICHPLRYTVIMSHRVRTGLMLGTWLGGCLHGSILTFLVFKLPFCGPNEVDNFFCDIPGLLPLACADTSLAQTVSFTNVDVVTLTCFFLILTSYGHIVISILKIGTSAGRRRAFSTCSAHLISIFLFYGPVMLIYLRPASSPWLDSVIQVLNNIVTPSLNPLIYTLRNKDVKLALRQVFTQVVHISG

SEQ ID NO: 3167 - DNA, 936 bp, Felis catus
tcatttattcttcacagagaagcctctcctgtgaaatatattccaaagggctgatttcacatccttattcctcaggctgtagattagtgggttcagcgtgggggtaacaagattgttcactatctgaattattgcgccaagcaaggcgctgggattgggctgtaggtagatgatgattaccggtccataagcacaaagaattgcagtgaggtgggcactgcaggtggagaaggctctttgcctgccctctgctgagcgaatttttgatatggagatcccaatgcgagtgtaggaaacaaggatgacaaaaaagcaaacgagagacaaaagaccaacatttgtaaaaccaaccctctgggctagagctatatcaccacaggccagaggtaagacggcaggtatgtcacagaagtagtagcccacctggttagagtcacagtagggcaactggaaagtgagggaggttagaataatggcgtgaacacagccacccgtccaggtccctgtggccaagatggagcagaccctgcggttcatgatgaccatgtatctcaaaggataacatatggcaacaaagcggtcataggccatcactgtgtacaggaaacactcagtgcagcccaggaagtggtagaagaagacctgggacacacagccctgaaaagagataccccgactctgccctgaaaggtataacagcatcttgggaacagtggttgaagagaagcccaggtcaaacatggagagatttcccaagaaaaaatacataggagtgtgaagccgagaggaggagatgatagctgtgaggatgagcacatttcccaagagagtacacaaatataatgacaagaacaggaaaaaaaggacagtctctaggccctctgtctccgggattccaagcaggatgaattcagttaccgttgtgtgatttctcat

SEQ ID NO: 3168 - protein, 311 aa, Felis catus
MRNHTTVTEFILLGIPETEGLETVLFFLFLSLYLCTLLGNVLILTAIISSSRLHTPMYFFLGNLSMFDLGFSSTTVPKMLLYLSGQSRGISFQGCVSQVFFYHFLGCTECFLYTVMAYDRFVAICYPLRYMVIMNRRVCSILATGTWTGGCVHAIILTSLTFQLPYCDSNQVGYYFCDIPAVLPLACGDIALAQRVGFTNVGLLSLVCFFVILVSYTRIGISISKIRSAEGRQRAFSTCSAHLTAILCAYGPVIIIYLQPNPSALLGAIIQIVNNLVTPTLNPLIYSLRNKDVKSALWNIFHRRGFSVKNK

SEQ ID NO: 3169 - DNA, 840 bp, Felis catus
tgtttcttaagaaatagattaacgagttcagcatgggtgagacaatattatttaatatttacaccacagcaccaagcaaggggttgggtgagggctgcagatagatgatgattacaggtccataggcacagaggattgcggtgaggtgggcactgcaggtagagaaagctttctgcccgccctctgctgatcggattctcagaatggcaatcccaatgcatgtgtaggagatacagacactgaaccaaagcattaaagccagaaaaccattagtggagcccactttctgggccagggagctgtcagtacacgccaggggtaagacagcaggaatgtcacagaagtactccacccggttggagccacagtaggttaaccgaaaggtgaaggaggtcaggatggtggcgtggagacaagccaccagccaggctgccatgactaagctgacacagacctcagtgggtgacagatggccacaaagcggtcataggccatcacagaatagagacaaccttcgctagaccccaggaaatggtagaagaagagctgtgcagcacagcccttataagaaagggcttgggtttggccagagagataaaatagcatcctgggacaggttatagatgggaacaacgtgtcgaaaatagataggcgtcccagaaagaaatacatgggggtgtgaagggtagaggaagaaacaattgctgtaaggatgagtaaattgccaagcagggtgaagaggtaagcaaatgagaagatgacaaatagcacagtctccagtccctctgtctgaggtattcccagtagaataaactcctggaactctgtgtgattcctcat

SEQ ID NO: 3170 - protein, 133 aa, Felis catus
MRNHTEFQEFILLGIPQTEGLETVLFVIFSFAYLFTLLGNLLILTAIVSSSTLHTPMYFFLGRLSIFDTLFPSITCPRMLFYLSGQTQALSYKGCAAQLFFYHFLGSSEGCLYSVMAYDRFVAICHPLRSVSA

SEQ ID NO: 3171 - DNA, 935 bp, Felis catus
atgaagaatctctcagcagtgactgagttcatcctgctgggcatcccacacacggaagacctggagaccatgctctttgtcctgtttttgggctgctacgtcttcactcttatggggaacctgctcatcctactggcgattgtctcctccactcggcttcacacccccatgtacttcttcctgtgtcaactgtctgtgtgtgacatatttttcccttctgtgagctcccccaagatgctcttctacctctcggggaacagccgggccatctcctatgcgggctgcgtgtcccagctcttcttctaccacttcctgggctgtaccgagtgcttcctgtacacggtgatggcctacgaccgctttgtcgccatctgctaccctctccgctacacggtaatcatgagccacagggtgtgtgccatcctggccgtggggacctctttttttggctgcgttcaggccaccttcctaaccactctcaccttccagttgccctactgtggccccaatgaggtggattacttcttctgtgatatcccggtgatgctgaagctggcttgtgctgacacctcagccctggagagggtggggttcgtcagcgtgggcctcatgcccctcagctgcttccttctcatcctcacctcctacagccgcattgtctgctccatcctgcagatccgctctaccgaaggcagacgccgtgccttctccacctgcagtgcccacctcaccgccatcctgcttttctacatgccggtggtcctcatctacctcaggcccaccccaagcccctggctggatgcaactgttcagatcctgaataacctggtcacccccatgctgaaccccttgatttacagcctcaggaacaaggaagtaatatcctctctggggaaggtgctacatcacttgggcttccttgctgaccaattgta

SEQ ID NO: 3172 - protein, 312 aa, Felis catus
  MOD_RES (312)..(312): Any amino acid
MKNLSAVTEFILLGIPHTEDLETMLFVLFLGCYVFTLMGNLLILLAIVSSTRLHTPMYFFLCQLSVCDIFFPSVSSPKMLFYLSGNSRAISYAGCVSQLFFYHFLGCTECFLYTVMAYDRFVAICYPLRYTVIMSHRVCAILAVGTSFFGCVQATFLTTLTFQLPYCGPNEVDYFFCDIPVMLKLACADTSALERVGFVSVGLMPLSCFLLILTSYSRIVCSILQIRSTEGRRRAFSTCSAHLTAILLFYMPVVLIYLRPTPSPWLDATVQILNNLVTPMLNPLIYSLRNKEVISSLGKVLHHLGFLADQLX

SEQ ID NO: 3173 - DNA, 926 bp, Felis catus
agaagaattgctcaggggtgaccgaattcatcctgttgggaattccacacacagaggggttggagactatagtttttgtcttgttcttgcccttctatgcctgcaccctgctgggaaatgtgtctatcctcgtggctgttctttcttccacttgccttcatgcgcccatgtattttttcttggggaacttgtctgtttttgacatgagtttctcttctgtgacctgtcctaaaatgccactgtaccttatgggccccctcattttgtataagatctagtctcccaggtctccttcttccatttccttggcagcattgaatgcttcttgtatactgtgatggcctatggccactttgctgctatctgttaccctctatggtaggcagccatcatgaaccgtagactcggtggggccctggctgtgggcacatgggtgttggggtatatccattccagcattttgactttgctcaccttcactttgccatgctgcggtcccaataagtggaccacttcttctgtgatattccagcactcctgccattggcctgtgctgatacatccttagcccagagggtgggtttcaccaatgttggcttggtatctctcctctgcttgtttctaatccttctatcctacactcgcgtcaccatctccatcttgtatattcgttcaaccgagggccgccgccgggccttctccacttgcagtgcccacctcattgccatcctttgtgcctatgggcccatcatcactgtctacctgcagcccaccccaaccccatgctgggaactgaggttcaaattctgatgaatctcgtaggaccaaggctgaaccttttaatctataccttgaggaataaggaagttaaaacagccctgaaaacaattttgcacaggacaaaccacgtttctgagagatagtaa

SEQ ID NO: 3174 - protein, 91 aa, Felis catus
KNCSGVTEFILLGIPHTEGLETIVFVLFLPFYACTLLGNVSILVAVLSSTCLHAPMYFFLGNLSVFDMSFSSVTCPKMPLYLMGPLILYKI

SEQ ID NO: 3175 - DNA, 946 bp, Felis catus
agcaggaaatcattccacagtgactgagttcatccttgctgggttaacagagagcccagaactccagctgccccttttcttcctcttcctaggagtctatgtggtcacggtggtggggaacctggccatgatcacactgatagggctcagtgctcacctgcacacccccatgtactatttcctcagcaatttgtccttcattgatctctgccattccactgtcattacccctaaaatgctagtgaactttgtgacagagaggaatttcatctcctaccaagcatgcatgactcaactctacttcttccttgtttttgttatatcagaatgtcatatgttggctataatggcgtatgatcgctatgttgccatctgtaacccattgctttacaatgtcaccatgtcttatcaggtttgctcccggctggtagttggggtgtatatcatgggcttgactggtgcctcagctcacacaggctgcatgctaagagtgcttttctgtaaggctgacagaatcaaccattacttctgtgatcttttcccactgttggagctctcctgctccagtacttatatcaacgaggtggtagttttgtgcttcagtgcatttaatatcctcgcccccagcctcatgattcttagctcctacatcttcatcattgccagcatcctccgcatccgctccaccgaaggtaggtgcaaagccttcagcacctgcagctcccacatctcagctgttgccgttttctttggatccgctgcgttcatgtacctgcagccatcatctgtgagctccatgaaccaagggaaagtgtcttccgtgttttacaccattattgtgcctatgctgaaccccctgatctacagcctgaggaataaagatgtcagagttgtcctgaataagatccttgaaaaaagaaggaaatgggtattttgcttgagaaaa

SEQ ID NO: 3176 - protein, 315 aa, Felis catus
AGNHSTVTEFILAGLTESPELQLPLFFLFLGVYVVTVVGNLAMITLIGLSAHLHTPMYYFLSNLSFIDLCHSTVITPKMLVNFVTERNFISYQACMTQLYFFLVFVISECHMLAIMAYDRYVAICNPLLYNVTMSYQVCSRLVVGVYIMGLTGASAHTGCMLRVLFCKADRINHYFCDLFPLLELSCSSTYINEVVVLCFSAFNILAPSLMILSSYIFIIASILRIRSTEGRCKAFSTCSSHISAVAVFFGSAAFMYLQPSSVSSMNQGKVSSVFYTIIVPMLNPLIYSLRNKDVRVVLNKILEKRRKWVFCLRK

SEQ ID NO: 3177 - DNA, 934 bp, Felis catus
atggaccctggaaataattccacagtaactgagttcatcctcgctgggctaacagagaagaccggattccagctgccccttttcttcctcttcctaggagtctatgtggtcacggtggtggggaacctggccatgatcacactgatagggctcagggctcacctgcacacccccatgtactatttcctcagcaatttgtccttcattgatctctgtcattccactgtcattacccccaaaatgctggtgaactttgtgactgagacgaacataatttcctactcagcatgcatgactcagctctatttcttccttgtttttgctatctcagagtgtcacatgttagctgcaatggcttatgaccgctatgctaccatctgcaaccccttgctttacaatgtcgtcatgtcttcacacatctgcttccggctcacagtgggagtttatattttgggcatcgttggatctacaatccatacgggttttatgatgaggctccttttctgccagagcaatgtgattaaccattatttctgtgatctctttccactcctggagatatcctgttccagcatcttcatcaatgaattattggtcctagtcttgagtgcatttaacattctgactcctgccttcaccatccttgcctcctacatcttcatcattgccagcatcctccgcatccgctccaccgagggcaggtgcaaagccttcaggacctgcagctcccacatctccgctgttgccattttctttggatctgctgcgttcatgtacctgcagccatcatctgtgagctccatggaccgagggagagtgtcctctgtgttttataccaccattgtgcccatgctgaaccccttgatctatagtctgcagaataaggatgtcaaatttgccctgaagaaaattctgggcagtagaaaatgttcat

SEQ ID NO: 3178 - protein, 312 aa, Felis catus
  MOD_RES (312)..(312): Any amino acid
MDPGNNSTVTEFILAGLTEKTGFQLPLFFLFLGVYVVTVVGNLAMITLIGLRAHLHTPMYYFLSNLSFIDLCHSTVITPKMLVNFVTETNIISYSACMTQLYFFLVFAISECHMLAAMAYDRYATICNPLLYNVVMSSHICFRLTVGVYILGIVGSTIHTGFMMRLLFCQSNVINHYFCDLFPLLEISCSSIFINELLVLVLSAFNILTPAFTILASYIFIIASILRIRSTEGRCKAFRTCSSHISAVAIFFGSAAFMYLQPSSVSSMDRGRVSSVFYTTIVPMLNPLIYSLQNKDVKFALKKILGSRKCSX

SEQ ID NO: 3179 - DNA, 936 bp, Felis catus
atggcagcagaaaatctttccacagtgactgcgtttatcctcactgggctaacacaacagccagaactccagctgccccttttctttctcttcctaggagtctatgtggtcacagtggtggggaacttggtcatgatcacactgataggactcagtgctcacctacacacccccatgtactacttcctcagtaatttgtccttcattgatctctgccattccactgtcattacccccaaaatgctagtgaactttgtgacagagatggacaccatctcctactctgaatgcataactcagctctatttcttccttgtttttgctatctcagagtgttacatgttagctgcaatggcatacgaccgctatgttgccatctgtagccccctgctttataatatcaacatgtcccatcaggcttgtttctccctgatttggggagtgtatattatagccctggtttgtgcatttgttcatacagtctgcttgtttagagttcacttctgcaaatttgctgtgatcaaccattatttctgtgatcttctttccctcttaaagctctcctgttctagcacccacgtcaatgaattactgattctagtctttagtgcaattaatatcctcgcccccagcctcatgattcttagctcctacatcttcatcattgccagcatgctccgcatccgctccaccgaaggcagagccaaagccttcagcacctgcagctcccacatctcagctgttgccgttttctttggatccgctgcgttcatgtacctgcagccatcatctgtgagctccctagaccgaggaaaagtgtcttctgtgttttatactgttgttgtgcctatgttgaatcccctgatctacagcctgaggaataaagatgtcaatgtcgcactgaagaaaatgctagagagaagaatattcttgtga

SEQ ID NO: 3180 - protein, 311 aa, Felis catus
MAAENLSTVTAFILTGLTQQPELQLPLFFLFLGVYVVTVVGNLVMITLIGLSAHLHTPMYYFLSNLSFIDLCHSTVITPKMLVNFVTEMDTISYSECITQLYFFLVFAISECYMLAAMAYDRYVAICSPLLYNINMSHQACFSLIWGVYIIALVCAFVHTVCLFRVHFCKFAVINHYFCDLLSLLKLSCSSTHVNELLILVFSAINILAPSLMILSSYIFIIASMLRIRSTEGRAKAFSTCSSHISAVAVFFGSAAFMYLQPSSVSSLDRGKVSSVFYTVVVPMLNPLIYSLRNKDVNVALKKMLERRIFL

SEQ ID NO: 3181 - DNA, 929 bp, Felis catus
atggggaatgcttcagtggtgaccaagttcatcctgctgggcatcccacacacggaagacctggagaccatgctctttgtcctgtttttgggctgctacgtcttcactcttatggggaacctgctcatcctactggcgattgtctcctccactcggcttcacacccccatgtacttcttcctgtgtcaactgtctgtgtgtgacatatttttcccttctgtgagctcccccaagatgctcttctacctctcggggaacagccgggccatctcctatgcgggctgcgtgtcccagctcttcttctaccacttcctgggctgtaccgagtgcttcctgtacacggtgatggcctacgaccgctttgttgccatctgctaccctctccgctacacggtaatcatgagccacagggtgtgtgccatcctggccgtggggacctctttttttggctgcattcaggccaccttcctaaccactctcaccttccagttgccctactgtggccccaatgaggtggattacttcttctgtgatatcccggtgatgctgaagctggcttgtgctgacacctcagccctggagagggtggggttcgtcagcgtgggcctcatgcccctcagctgcttccttctcatcctcacctcctacagccgcattgtctgctccatcctgcagatccgctctactgaaggcagacgccgtgccttctccacctgcagtgcccaccttactgccatcctcctctcctttatgccagtggtcctcatgtacctgcagcccacccccaatccctggctcaatgcaactgttcaggtcctgaataacttggtcacccctatgctgaaccccttgatttacagcttgagaaataaagaagtaaaatattctctgaggaaggtactacagcaggtagccttccttcctgagca

SEQ ID NO: 3182 - protein, 310 aa, Felis catus
  MOD_RES (310)..(310): Any amino acid
MGNASVVTKFILLGIPHTEDLETMLFVLFLGCYVFTLMGNLLILLAIVSSTRLHTPMYFFLCQLSVCDIFFPSVSSPKMLFYLSGNSRAISYAGCVSQLFFYHFLGCTECFLYTVMAYDRFVAICYPLRYTVIMSHRVCAILAVGTSFFGCIQATFLTTLTFQLPYCGPNEVDYFFCDIPVMLKLACADTSALERVGFVSVGLMPLSCFLLILTSYSRIVCSILQIRSTEGRRRAFSTCSAHLTAILLSFMPVVLMYLQPTPNPWLNATVQVLNNLVTPMLNPLIYSLRNKEVKYSLRKVLQQVAFLPEX

SEQ ID NO: 3183 - DNA, 937 bp, Felis catus
atggatacaggaaaccattcttcagtaactgagtttatccttgaggggttaacagaccagccaggactccagctccctctctttttcctgtttctattgatctatatggtctgcatggtgggaaattcgggtttgatctttttaattaggatcagttctcagcttcacacgcccatgtattattttctcagtaatttgtccttcatagatctctgctactccactgtcataattcccaagatgttggtgaactttgtatcagagaagaatttcacctcctttcctgagtgtatgacccagctcttttgcttctgcttctttggtattgatgactcctacatgctgacagcaatggcatatgatcgttatgttgccatctgtaaccccttgctctacaatgtcataatgtccccaagaatctgttttctactggccaccagtgtgtatacagtggggatcattggagccttggtccacaccagctacatatctagtcgatccttctgtggaatgaacatcatccaccattacttctgtgacatcctccctcttctgaatatatcttgctcaagagactacaccaaggaactcttggtgatgattttggttggcgtcaatgtatttgcatgtgctgtagccatcttcatctcttatgccttcattctttccagtatcttatgcatctgctcagctgaaggcaggtccaaagctttcagtacctgcagctcacaccttgcagctgttggggttttctatggctccatcattttcatgtattttaaaccatataccagtgacataatacaggagaaggtggcctctgtgttctataccacagtgattcccatgcttaatccccttatctacagccttaggaacaaggatgtcaaagaatcccttaaaagagttcttaatggtgggtaactttctgggtctg

SEQ ID NO: 3184 - protein, 307 aa, Felis catus
MDTGNHSSVTEFILEGLTDQPGLQLPLFFLFLLIYMVCMVGNSGLIFLIRISSQLHTPMYYFLSNLSFIDLCYSTVIIPKMLVNFVSEKNFTSFPECMTQLFCFCFFGIDDSYMLTAMAYDRYVAICNPLLYNVIMSPRICFLLATSVYTVGIIGALVHTSYISSRSFCGMNIIHHYFCDILPLLNISCSRDYTKELLVMILVGVNVFACAVAIFISYAFILSSILCICSAEGRSKAFSTCSSHLAAVGVFYGSIIFMYFKPYTSDIIQEKVASVFYTTVIPMLNPLIYSLRNKDVKESLKRVLNGG

SEQ ID NO: 3185 - DNA, 916 bp, Felis catus
caaaaccttcctcaatgctttctttacatccttgtttctcagactgtatattaaagggttcagcatggggatcactgtggtgtaaaacactgaggacaccttctcctgttccagggagttactggaagggggcttgaaatacatgaatgtgattgaccccaaagaagatccccacagccatgagatgagagctgcaagttccaaaagctttggaccggccccctgaggattggatgtgaaggatgctatggaagatgaaggcgtaggaaatgaagacagctagcgtgggcaccaaggtgttcagtcccgcaatgataaaaagcagctgctcattgaggtatgtattggagcaggagagattgaggagaggaaggacatcacagaagtaatggctgatgatgtgggatctgcagaaagacagtttcatcatggcacttgtatgggccatggcagagagaaagcccaggatgaaggcaaccagcaccagcagtgagcaaaccggagaggacatggtcacactgtaaagcagggggctacagatagccacgtagcgatcatatgccatcacagtcaggaggtaaccctcagccactacaaaaactacgaagaaaaacagctgtgccatgcattcagaataaaggatcatattcttcttccctaagaagttcaccagcattttgggcgtaatgacagaggaatagcagagatcgatgaaggacaagctgctgaggaagtagtacatgggggtgtgaagccaagggcttactgtaatcaggagaatcaagcccaagttccccaccactgtcactatatagattcccaggaacaggaggaagagaggcagctggagctctggccgctgtgttaaacccactaacacaaacttagttgccgtggaatgatttcctgcaaccat

SEQ ID NO: 3186 - protein, 265 aa, Felis catus
MVAGNHSTATKFVLVGLTQRPELQLPLFLLFLGIYIVTVVGNLGLILLITVSPWLHTPMYYFLSSLSFIDLCYSSVITPKMLVNFLGKKNMILYSECMAQLFFFVVFVVAEGYLLTVMAYDRYVAICSPLLYSVTMSSPVCSLLVLVAFILGFLSAMAHTSAMMKLSFCRSHIISHYFCDVLPLLNLSCSNTYLNEQLLFIIAGLNTLVPTLAVFISYAFIFHSILHIQSSGGRSKAFGTCSSHLMAVGIFFGVNHIHVFQAPFQ

SEQ ID NO: 3187 - DNA, 925 bp, Felis catus
accttcccccaaccacctttctcagtgcgtccttcacatctttgttcctcaggctgtagatcatgggattcagcatggggatcaccgtggtgtaaaacactgaggacaccttcttctgttccatagtattgctagaagggggtttgaaatacatgaatgtgatagatccaaaaaagatacccacagccatgagatgagagctacaggtgccaaaggctttggaccgtccctcagcagagtgaatatggaggatgctcgaaaggatgaaagcgtaagagatgagtacagccactgtaggtactaaggtattaactcctccaataataaacagcagtatctcattgatatgggtactggagcaagagagagtcaacaaggggagaatatcacaaaaataatgcctaacaacatgagacccacagaaggacaatactgacatgtgggtagtatggactgtagccccaaacaaacccagtgaatataccacagccatcattatggagcagaccctatgggacatgataatattgtaaagcagtgggctacagatggctacataacggtcatatgccatggcagtcagaaggtagccttctgcaattacaaaaacaaggaagaaataaagctgagtcatgcatgccaaaaaggagataatgttcttctcagatatgaagttcaccagcatttttggggtaatgactgaggagtagcagagatcaatgaatgacagatgactgagaaaataatacattggagagtgaagttgagaactgatagcaattaagaggatcatgcccaggttccccaccactgtgaccacgtatattccaaggaacagtaaaaagagtggcaactgaagctctgggtgttttgctaacccttcaaggataaagtcagtcatggaggaatgatttgaagtagccat

SEQ ID NO: 3188 - protein, 309 aa, Felis catus
  MOD_RES (309)..(309): Any amino acid
MATSNHSSMTDFILEGLAKHPELQLPLFLLFLGIYVVTVVGNLGMILLIAISSQLHSPMYYFLSHLSFIDLCYSSVITPKMLVNFISEKNIISFLACMTQLYFFLVFVIAEGYLLTAMAYDRYVAICSPLLYNIIMSHRVCSIMMAVVYSLGLFGATVHTTHMSVLSFCGSHVVRHYFCDILPLLTLSCSSTHINEILLFIIGGVNTLVPTVAVLISYAFILSSILHIHSAEGRSKAFGTCSSHLMAVGIFFGSITFMYFKPPSSNTMEQKKVSSVFYTTVIPMLNPMIYSLRNKDVKDALRKVVGGRX

SEQ ID NO: 3189 - DNA, 936 bp, Felis catus
tcaagaaaatgtttttctattcaagctttctttcagggcaaccttaacctccttgttcctgaagctatagatcagaggattgagcataggcaccacaatagtatagaacacagtggacactttcccctggtccatggacaaaacagaagaaggatgaagatacatgaatgcccccgacccaaagaaaacagaaacaacaattatatgtgagctacaagtgctaaaagctttggaccttccttcaggggaatgcatgcgaaggatgctggtgaggatcaaagagtaagagataatgatagtgaggctgggcacacccacatcaaagcccacaacaatgagaactaccagttcattgatgtgagtgtttgtgcaggagagctccagaagggggaggatgtcacacatgtagtggttgatggtgttggcgtcacagaaggtcaacctgagcatgcatcctgtgtgggcccaggcaccaataaacgcccccacatatacaatcacagccagcagagaacagacctgaggggacatggtgaccgtgtataacaagggcttgcaaatggccacatagcgatcataggccattactgtcaacacataacactctgcactgacaaagaaacagtagaaaaagagctgagtcatgcatcctgcataggagatggtgttcagctttgacacaaagtttaccagcagttttggggtaatgacagaagagtaacacaggtcaataaaggataaattaaagaggaaatagtacatgggggtgtgaaggtgagaattcagtccaattagagtgaccaagcccaggtttcctgccacagtgacaatgtagattcctaggaaaagaaagaacagaggcagctggatctctgaatatttggttaaacccacaaggaaaaactcagtgactaaggaactgtttcccatatccat

SEQ ID NO: 3190 - protein, 311 aa, Felis catus
MDMGNSSLVTEFFLVGLTKYSEIQLPLFFLFLGIYIVTVAGNLGLVTLIGLNSHLHTPMYYFLFNLSFIDLCYSSVITPKLLVNFVSKLNTISYAGCMTQLFFYCFFVSAECYVLTVMAYDRYVAICKPLLYTVTMSPQVCSLLAVIVYVGAFIGAWAHTGCMLRLTFCDANTINHYMCDILPLLELSCTNTHINELVVLIVVGFDVGVPSLTIIISYSLILTSILRMHSPEGRSKAFSTCSSHIIVVSVFFGSGAFMYLHPSSVLSMDQGKVSTVFYTIVVPMLNPLIYSFRNKEVKVALKESLNRKTFS

SEQ ID NO: 3191 - DNA, 930 bp, Felis catus
tcaaaaccttctacttagagtttttctcaaagcaagtttaacatctttgtttctcaagctgtaaagtaaagggttcatcatgggaactgtattggtgtaaaagatagatgatatttttccctcatccatagacccagcagaagatggtttaagatacataaatgcacctgatccaaagaacaaggaaacagaaattatgtgggaactgcaggtgctgaacgctttggacctgccctcagtggaaccgatgtggaggatgctggaaaggatgcaaccataagagacaaagatggtgacactgggcacaatgatgttgatgcccaccacgatgaaaaccaccagctcattcacgtaggtgcttgtgcaggagagctggagaagggggaggatgtcacacaaataatggttgatggtgtttgcatcacagaaggtcagtcccagcatgcttcctgtgtgagccacagcacctgaaaatgccatcaaatatgaaccaagcataaggctggaacacgctttaggggacatgacaacattatacaaaagtgggttacagatggccacatagcgatcataggccattgatgtcaacacatagcattcagaaatagcaaaaaaacagaaaaagtaaagctgggtcatgcaccccctgtaggagataatatttttctttgatacaaagttagtcagcattttgggtgtaaacacagaagaataacagaaatctatgaaggacaaattgaagagaaaaaagtacattggagtatgtaggtgtgaattcagcccaattagagttatcaagcccaaatttcccaacacagtgaccacatacatgactagaaacagacagaacagggggagctggagatctggtaggtctgttagccccaccagaatgaatgcagccacaaaagaactgtttccaggagccat

SEQ ID NO: 3192 - protein, 309 aa, Felis catus
MAPGNSSFVAAFILVGLTDLPDLQLPLFCLFLVMYVVTVLGNLGLITLIGLNSHLHTPMYFFLFNLSFIDFCYSSVFTPKMLTNFVSKKNIISYRGCMTQLYFFCFFAISECYVLTSMAYDRYVAICNPLLYNVVMSPKACSSLMLGSYLMAFSGAVAHTGSMLGLTFCDANTINHYLCDILPLLQLSCTSTYVNELVVFIVVGINIIVPSVTIFVSYGCILSSILHIGSTEGRSKAFSTCSSHIISVSLFFGSGAFMYLKPSSAGSMDEGKISSIFYTNTVPMMNPLLYSLRNKDVKLALRKTLSRRF

SEQ ID NO: 3193 - DNA, 927 bp, Felis catus
tcaaaactttcccctattcagagtttttctcagagcaagtttaatgtctttgtttctcaagctgtaaatgaatgggttcatcaagggaactatactggtataaaagacagaagagattttcccctcatccatagacccagcagaagatggtttaagatacataaatgcacctgatccaaagaacaaggaaacagcaattatgtgggaactgcaggtgctgaacgctttggacctgccctcagtggagctgatgcggaggatgctggagaggatgcaaccataagacacaaagatggtgacactgggcacaatcacattgattcccaccacgatgaaaaccaccagttcatttacataggtgcttgtgcaggagagctggagaagggggaggatgtcacacaaataatggttgatggtgtttgcatcgcagaaggtcagtctcagcatgcatcctgtgtgggccatagcacccgaaaatgccatcaaatatgaaccaagcataaggctggaacacgctttaggggacaggaaaacattatacaaaagtgggttacagatggccacatagcgatcataggccattgatgtgagcacatagcattcagaaataccaaaaaaactgaaaaggtaaagctgggccatgcaccccctataggagatgatattcttctttgatgtgaagttaaatagcattttgggtgtaaacacagaagaataacagaagtcgatgaaggacaaattggagaggaaaaagtacatgggggtgtgtagatgtgaattcagcccaattagagttatcaagcccaaatttcccgatgcagtgaccacgtaaatgactagaaacaggcagaacagggggagctggagatctggtaggtctgttagccccagcagaatgaattcagtcacaaaagaagcattcccagg

SEQ ID NO: 3194 - protein, 308 aa, Felis catus
PGNASFVTEFILLGLTDLPDLQLPLFCLFLVIYVVTASGNLGLITLIGLNSHLHTPMYFFLSNLSFIDFCYSSVFTPKMLFNFTSKKNIISYRGCMAQLYLFSFFGISECYVLTSMAYDRYVAICNPLLYNVFLSPKACSSLMLGSYLMAFSGAMAHTGCMLRLTFCDANTINHYLCDILPLLQLSCTSTYVNELVVFIVVGINVIVPSVTIFVSYGCILSSILRISSTEGRSKAFSTCSSHIIAVSLFFGSGAFMYLKPSSAGSMDEGKISSVFYTSIVPLMNPFIYSLRNKDIKLALRKTLNRGKF

SEQ ID NO: 3195 - DNA, 933 bp, Felis catus
tcaaaaccttctcctactgaaggtttttctcagagcagttttaacatctttgtttctcaagctgtagagtaaagggttcatcatgggaaccacactggtataaaagacagaagagattttccccttatgcatagacagagcagacgacggtttgagatatgtaaatgcacctgatccaaagaacaaggaaacagcaattatgtgggaactgcaggtgctgaacgctttggacctgccctcagtggagctgatgcggaggatgctggaaaggatgcaaccgtaagacacaaagatggtgacactgggcacaatgatgttgatgcccaccacgatgaaaaccaccagctcattcacgtaggtgcttgtgcaggagagctggagaagggggaggatgtcacacaaataatggttgatggtgtttgcatcgcagaaggtcagtctcagcatgcatcctgtgtgggccatagcacccgaaaatgccatcaaatatgaaccaagcataaggctggaacacactttaggggacaggacaacattatacaaaagtgggttacagatggccacatagcgatcataggccattgatgtgagcacatagcattcagaaatgataaaaaaacaaaaaaagtagaattgggtcatgcaccccctataggagataatattcttctttgatgtgaaattaatcagcattttgggtgtaaacacagaagcataacagaggtctatgaaggacaaattggagaggaaaaagtacatggggatatgtaggtgtgaattcagcccaattagagttatcaagcccaaatttcctaacacagtgaccacatacatgactagaaacaggcagaacagggggagctggagatctggtaggtctgttagccctaccagcataaattcagtcacaaaagaggcatttgtaggagccat

SEQ ID NO: 3196 - protein, 310 aa, Felis catus
MAPTNASFVTEFMLVGLTDLPDLQLPLFCLFLVMYVVTVLGNLGLITLIGLNSHLHIPMYFFLSNLSFIDLCYASVFTPKMLINFTSKKNIISYRGCMTQFYFFCFFIISECYVLTSMAYDRYVAICNPLLYNVVLSPKVCSSLMLGSYLMAFSGAMAHTGCMLRLTFCDANTINHYLCDILPLLQLSCTSTYVNELVVFIVVGINIIVPSVTIFVSYGCILSSILRISSTEGRSKAFSTCSSHIIAVSLFFGSGAFTYLKPSSALSMHKGKISSVFYTSVVPMMNPLLYSLRNKDVKTALRKTFSRRRF

SEQ ID NO: 3197 - DNA, 933 bp, Felis catus
tcaaaacactctcctaccgagggttcttctcagagcaattttaacatctttgttcctcaaactatagattaaggggttcatcatgggaaccacattggtataaaagacagaagagattttaccctcatccatagacccaacagaagatggtttaagatacataattgcacctgacccaaagaacaaggaaacagcaattatgtgggaactgcaggtgctgaacgctttggacctgccctcagtggaactgatgcggaggatgctggagaggatgcaaccataagacacaaagatggtgacactgggcacaatgatgttgatgcccaccacgatgaaaaccaccagctcattcacgtaggtgcttgtgcaggaaagctggagcacagggaggatgtcacacaaataatggttgatggtgtttgcatcacagaaggtcagtctcagcatgcatcctgtgtgggccatagcacccgaaaatgccatcaaatatgaaccaagcataaggctggaacacgctttaggggacatgacaacattatacaaaagtgggttacagatggccacatagcgatcataggccattgatgtcagcacatagcattcagaaattacaaaaaaacagaaaaagtaaagctgggtcatgcatcccatataagagataatgtttttctttgataggaaattcatcagcatttttggtgtcaatactgaagaatagaagaggtctatgaaggacaaattgaagaggaaaaagtacatgggggtgtgtaggtattaattcagcccaattaaaatgatcaagcccatatttcccaacacagtgaccacatacatgactagaaataggcagaacaggggaagctggagttctgataggtctgttaatcccaccagaatgaattcagtcacagaagaggcatttccaggagtcat

SEQ ID NO: 3198 - protein, 252 aa, Felis catus
MYFFLFNLSFIDLFYSSVLTPKMLMNFLSKKNIISYMGCMTQLYFFCFFVISECYVLTSMAYDRYVAICNPLLYNVVMSPKACSSLMLGSYLMAFSGAMAHTGCMLRLTFCDANTINHYLCDILPVLQLSCTSTYVNELVVFIVVGINIIVPSVTIFVSYGCILSSILRISSTEGRSKAFSTCSSHIIAVSLFFGSGAIMYLKPSSVGSMDEGKISSVFYTNVVPMMNPLIYSLRNKDVKIALRRTLGRRVF

SEQ ID NO: 3199 - DNA, 928 bp, Felis catus
tttgtaattctcttcagggttttcttcagagcaagtttgatatctttattcctgaggctataaatgaaagggttgagcatgggtaccacattggtgtaaaacactgagaaaaatttccttggcttacagacccagaagatgatggcttgacatgagtgagcaacccaaatccatagaacaggccaacagttactatgtgggagccacaggtgctgaaggctttgggccaaccctgagctgatgagatgtgaaggatattgaaaagaatcaaaaaataagaaataaagataataaggctagatgcaatgacaactgagcccacaataacagagataaccagctcactggcataggtactgctgcaggagagctggaggagggggaaaatgtcacacatgtaatggtcaatggcactggagtcacaaaagatcagcctgatcatgcaccctgtgtggaccatggcaccagcaaaacccatcacatatgaaccagacatcagcagagaacagactagaggggacatggtaatggtgtatagcagaggtttacagatggccacatagcgatcataggccatggctgtcaacacatagcattcagagttgacaaaaaagcagaagaaaaataactgagtcatgcatcccattaaggagatgatgttcttgtctgaaataaagctcatcagcatttttggggtagagacaaatgaataacaaagatcaatcagggacagattgaagaggaaaaaatacatgggggtgtgaaggtgtgaattcaggcaaattaaattaattaagctcaaattgcccaccacagtgaccacatagttcaccaaaaacagaaaaaacagaggtagttggagttcaggttggtctgttaatcccataaggataaagtcagtcacagaggagtcattttccacagccat

SEQ ID NO: 3200 - protein, 300 aa, Felis catus
MAVENDSSVTDFILMGLTDQPELQLPLFFLFLVNYVVTVVGNLSLINLICLNSHLHTPMYFFLFNLSLIDLCYSFVSTPKMLMSFISDKNIISLMGCMTQLFFFCFFVNSECYVLTAMAYDRYVAICKPLLYTITMSPLVCSLLMSGSYVMGFAGAMVHTGCMIRLIFCDSSAIDHYMCDIFPLLQLSCSSTYASELVISVIVGSVVIASSLIIFISYFLILFNILHISSAQGWPKAFSTCGSHIVTVGLFYGFGLLTHVKPSSSGSVSQGNFSQCFTPMWYPCSTLSFIASGIKISNLL

SEQ ID NO: 3201 - DNA, 986 bp, Felis catus
attttaatcaagactttcctcagtgcaattttgacatccttattcctcaaactgtagatcaggggattgagcatgggccccacattagtgtagaaaactgaagaaactttcccctgctccatagaccccggagaagaatatttaagatacatgaatgctgctgagccaaagaaaagagaaatagcaatgatgtgagaactacaggtactgaaggcttttgatcgtccttgagcagatctgatatgaagaatgctagtgaggataaagacgtaagaaatcaggatggtaaaactgggtactgtgatattaattcccacgactatcagaactactacctcgttgacataggtgctgctgcaagacagttggaggagaggaagaatatcacacaggtaatggttgatgacattaacactgcagaaggttagtctgagcatgcaccctgtgtgggcagaggctccagcaaaccccatcatatatgcagcaacagtcagcaaggcacagacctggtgggacatggttaccttatacagcaacggattacagatggccacgtagcgatcgtaggccattgaggtcaacatatagcattccgagatgacaaaaaagagaaagaaaaacagctgagtcatgcagccaacataggagatgatattctcccttgatacaaagttcatcagcatcttgggggtgaaagcagaagagtaacagacatcaatgaaggataggttgaagaggaagtagtacatgggggtatggaggtgagaattcagacgaataagagtgaccaagccaacgttgcccaccatggtgacaatgtagatcaccagaaacaggaagaagaggggttgctggagctctggacggtctgttaggccagcaagaagaaattcagtcactaaggactcatttctaaccagtattcttctcttcagaaatctgtgagaacagaagaaaatcccattagagaccccagctctctcctt

SEQ ID NO: 3202 - protein, 329 aa, Felis catus
  MOD_RES (329)..(329): Any amino acid
KERAGVSNGIFFCSHRFLKRRILVRNESLVTEFLLAGLTDRPELQQPLFFLFLVIYIVTMVGNVGLVTLIRLNSHLHTPMYYFLFNLSFIDVCYSSAFTPKMLMNFVSRENIISYVGCMTQLFFFLFFVISECYMLTSMAYDRYVAICNPLLYKVTMSHQVCALLTVAAYMMGFAGASAHTGCMLRLTFCSVNVINHYLCDILPLLQLSCSSTYVNEVVVLIVVGINITVPSFTILISYVFILTSILHIRSAQGRSKAFSTCSSHIIAISLFFGSAAFMYLKYSSPGSMEQGKVSSVFYTNVGPMLNPLIYSLRNKDVKIALRKVLIKX

SEQ ID NO: 3203 - DNA, 933 bp, Felis catus
atggctatggaaaatgactcttcagtgacagagttcatcctggtaggatttacagaccgacctcagctccagttaccccttttctttctctttttactgaactatgtggtcactatggtaggaaatttgagcctagttaatctaatatgcctgaattctcacctgcacactcccatgtactttttcatcttcaacttatccttcatagatttctgccactctttggtcattacccctaaaatgctgatgagctttgtctcagagaagaacatcatttcctttacagaatgcatgactcagctgtttttcttctgtttctttgtgcattctgagtgctatgtgttgacagccatggcctatgatcgctatgtggccatctgtaaacctctggtgtacacggtcaccatgtcccctcaggtctgttctctgctgatgtttggttcttacgtgatggggtttgctggtgccatgatccacataggggacatggtcagattgtccttttgtgattctaacatcatcaaccattacatgtgtgacatcttccccctccttcagctctcctgcagtggcacctatgccagtgagttgctgaattccattattgtgagcacagttgtcataatatccggcttcattattttcatttcttatgctttggtcctgtccaatgtcctccacgtctcatcagctcagggttggcccaaagccttcagcacctgtggctcccacatagtaactgtgggtctgttctatgggtctgggttgttcacacatctcaagacctctccttctgattctgtggaccaggggaaattcttttcagtattttacaccaatgtaatacccatgttgaaccccctcatctatagtctaaggaacaaggatgtcaaatgtgctctgaaaaaaaccctgaagagaattgcaaactaa

SEQ ID NO: 3204 - protein, 310 aa, Felis catus
MAMENDSSVTEFILVGFTDRPQLQLPLFFLFLLNYVVTMVGNLSLVNLICLNSHLHTPMYFFIFNLSFIDFCHSLVITPKMLMSFVSEKNIISFTECMTQLFFFCFFVHSECYVLTAMAYDRYVAICKPLVYTVTMSPQVCSLLMFGSYVMGFAGAMIHIGDMVRLSFCDSNIINHYMCDIFPLLQLSCSGTYASELLNSIIVSTVVIISGFIIFISYALVLSNVLHVSSAQGWPKAFSTCGSHIVTVGLFYGSGLFTHLKTSPSDSVDQGKFFSVFYTNVIPMLNPLIYSLRNKDVKCALKKTLKRIAN

SEQ ID NO: 3205 - DNA, 930 bp, Felis catus
tcaggagagcactgttctcagggttttacccagagcaagtttcacatccttattcctcaaactgtagatcaaaggattaagcatgggaaccacattggtgtaaaagactgaggcaaatttactctggtccatagatgcaggaaaagagcttgttaaataggtgaatgcccctgacccaaaaaacaaagcaacagcaattatgtgggagccacatgtgctgatggctttggatctaccctcagcagaaggaatatggaggatattagagagaatcaaggcataagaaatgaaaatgctaatactggatattgtgatgaccactcccacaacaataaaaaacactagctcattgacatgggtgctggtgcaggagagctgcaggagaggaagaacttcacacagataatggtggatgatgttggaattacagaaagtcagtctccatatgctcccagtgtgggccatggctccagcaaaccctatcacatatgaaccaaacatgagcagagaacagacctgaggggacatggtgaccgtgtacagcagaggcttgcagatagccacatagcgatcataggccattgataccaacacatagcactcagaattgacaaagaaacagaagaaaaaaagttgagtcacgcatcccacgtaagagatgacattttctgacagaaaatcattcagcattttgggggtaaatacagaggaataacagagatctataaaagacaagttgaagagaaaaaagtacatgggagtgtgaaggctagaatttagcccaattaaggtaatcaagcccaagttgcccaccacagtaaacacatagatccctaagaacaggatgaagaggggaagctggagctctggttgttctgataatcccactaggataaactcagtcactgaggagctgtttctcagagtcat

SEQ ID NO: 3206 - protein, 309 aa, Felis catus
MTLRNSSSVTEFILVGLSEQPELQLPLFILFLGIYVFTVVGNLGLITLIGLNSSLHTPMYFFLFNLSFIDLCYSSVFTPKMLNDFLSENVISYVGCVTQLFFFCFFVNSECYVLVSMAYDRYVAICKPLLYTVTMSPQVCSLLMFGSYVIGFAGAMAHTGSIWRLTFCNSNIIHHYLCEVLPLLQLSCTSTHVNELVFFIVVGVVITISSISIFISYALILSNILHIPSAEGRSKAISTCGSHIIAVALFFGSGAFTYLTSSFPASMDQSKFASVFYTNVVPMLNPLIYSLRNKDVKLALGKTLRTVLS

SEQ ID NO: 3207 - DNA, 945 bp, Felis catus
tcaagagaatgtctttttgctcaatgatttcttcagagcaactttgacatctttatttcttaagctatagattagcgggttgagcatgggcacaacggtggtatagaacaaggaggacactttcccctgattcataggtaaaagagaggatggtttgaggtacataaatgcccctgacccaaagaaaagagaaacagcaattatgtgagagctgcatgtgctgaaggctttggacctgccctcagtggaacgaatatggagaatgctggtgaggatgagggcataagaaatgaagatggtaactgtgggcacgccaatatcaatgcccacgacaacgaaaactaccagctcatttacataggtgctggtgcaagagcgctcaagaaggggaaggatgtcacacatgtagtggtcaaccagattgttggcacagaaggtcagcctcaccatgcatgtcgtgtgggccatggccccagcaaaccccatcacatagacacccaacagaagaagcgagcagacctgaggagacatggtggctgtgtacaccagtgggttacagatggcggtgtagcggtcatatgccattgctgacaggatgaaggactcagagacaacaaagaaaagaaaaaagaagagctgagtcatacaccctgcgtaggcgatggtgttctttgagacaaaactcatcagcatcttgggagtgataacagtggaatagcaaaaatctatgaaggacaagttgaagaggaagaagtacatgggggtgtgcaggtgagaattcagcccaatcagggttatcagacccaggttccccatcacagtgaccacatagaaacctagaaacaggaagaagaggggcatccgaagtccgggctggttggttaagcctgcaaggataaattctgtcacagaggagttctcagctgccattctcattaaaggcat

SEQ ID NO: 3208 - protein, 314 aa, Felis catus; identical to SEQ ID NO: 60

SEQ ID NO: 3209 - DNA, 930 bp, Felis catus
gaagaattttctgcctaaggtcttcttcagggcaactttgacatccttgttcctcagactatagattaatgggttgaacatgggcaccacagcagtatagaatatggaggacactttcccctggtcaaggggtaaaatagaaggtggtttgaggtacataaaagctcctgatccaaagaaaagagataccacaattatatgggaactgcaggtactgaaggctttggatctgccctcagtagaactaatatggagaatactagaaagaatgaaaccataggagataaaaatggtcacaatgggtaccccaatgccaatggtcacaacaatgaagaccaccagcaaatttatgtaagagctgttgcaggagagctcaaggaggggaatgatatcgcacatatagtggttgacgaagttgtcagcacaaaaggttataaacattatgtttcccatatgggcaacagctccaaacactcccatcccataaacacctaacaaaaggagtgaacacacctgaggagacatggtaactgtgtatagcagtggtttacagatggcgacatagcggtcatatgccatcgctgacaagatgtaggattcagaaaacacaaagaaacagaagaaaaaaaactgagtcatacaccctgcataggaaatgatgtttctctttgcgacaaaacccattagcattttaggggtcagagtcgtggagtaactaacatctatgaaggacaagttgaagaggaaaaagtacatgggaatatgaaggtgagaattcagcccaatcagggttatcaggcccaggttccccaccacagtgaccatgtagaaacctagaaacaggaagaagaggggcatctggagttctggctcatctgttaagcctgcgaggataaactctgtcacagaggaggcattatctgtagccat

SEQ ID NO: 3210 - protein, 310 aa, Felis catus
MATDNASSVTEFILAGLTDEPELQMPLFFLFLGFYMVTVVGNLGLITLIGLNSHLHIPMYFFLFNLSFIDVSYSTTLTPKMLMGFVAKRNIISYAGCMTQFFFFCFFVFSESYILSAMAYDRYVAICKPLLYTVTMSPQVCSLLLLGVYGMGVFGAVAHMGNIMFITFCADNFVNHYMCDIIPLLELSCNSSYINLLVVFIVVTIGIGVPIVTIFISYGFILSSILHISSTEGRSKAFSTCSSHIIVVSLFFGSGAFMYLKPPSILPLDQGKVSSIFYTAVVPMFNPLIYSLRNKDVKVALKKTLGRKFF

SEQ ID NO: 3211 - DNA, 936 bp, Felis catus
tcaagagaaggttattctgcccacagttttcctcagggcaactttgacatccttattcctcagactgtagattaatgggttgaacattggcacaacaatggtgtagaacaaggaagacactttcccctggtcaaggggtaaaatagaaggtggcttgaggtacataaaagctcctgatccaaagaaaagagaaactgcaattatgtgagaactgcaggtactgaaggccttggacctgccttcagtggagctaatgtggaaaatgctagaaataatgaagccataagatataaaaatggcaacaatgggcaccccaatgccaatggtcacaacaataaagacaattagtacatttatgtaagagctgttgcaagagagctcaaggaggggaaggatgtcacacatatagtgattaacaaggttgtcagaacaaaatgtcagaaataatatatttcctgtatgggccacagctcccaaaatccccatcccatagacacccagtaaaaggagtaaacacacctgagaagacacagtgaccatgtacagcagtggtttacagatggcgacatagcggtcatatgccatcgctgacaggatgtaggattcagaaaagacaaaaaagcaaaagaaaaagagctgagtcatacaccctgcataggaaatgatgttcttcttggagacaaaactcattagcattttggggatgatggcagtagagaaactaaaatctatgaaggacaagttgaagaggaaaaagtacatgggaatatgaaggtgagaattcagcccaatcagggttatcaggcccaggttccccaccacagtgaccatgtagaaacctagaaacaggaagaagaggggcatctggagttctggctcatctgttaagcctgcgaggataaactctgtcacagaggaggcattatctgtagccat

SEQ ID NO: 3212 - protein, 311 aa, Felis catus
MATDNASSVTEFILAGLTDEPELQMPLFFLFLGFYMVTVVGNLGLITLIGLNSHLHIPMYFFLFNLSFIDFSFSTAIIPKMLMSFVSKKNIISYAGCMTQLFFFCFFVFSESYILSAMAYDRYVAICKPLLYMVTVSSQVCLLLLLGVYGMGILGAVAHTGNILFLTFCSDNLVNHYMCDILPLLELSCNSSYINVLIVFIVVTIGIGVPIVAIFISYGFIISSIFHISSTEGRSKAFSTCSSHIIAVSLFFGSGAFMYLKPPSILPLDQGKVSSLFYTIVVPMFNPLIYSLRNKDVKVALRKTVGRITFS

SEQ ID NO: 3213 - DNA, 905 bp, Felis catus
gtgaccgagtttattctcaggggattgacaaatcggccagagctccagctccccctcttcctcctcttccttgggatctacttggtcaccgtcatagggaacctgggcatgttcacgctgatttgtctgaatgctcagcttcacacccccatgtactacttcctcagcaatctgtcccttgtggatctctgctactcctctgtcattaccccgaaaatgctggtgaactttgtgtcagagaagaacatcatctcctatgcggggtgcatgtcacagctctacttcttccttgtgtttgtcattggtgagtgttacatgttgacagtgatggcctatgaccgctatgtcgccatctgcagcccattgctctaccatgtcatcatgtctcctcaagtgtgttccctgctggtgtctgtggtctatgccatgggatttattggtgcaacaatagagactggcctgatgttaaaactgtcctactgtgagctcctcatcagccattacttctgtgacatcctccctctcataaagctctcctgctctagcacctatcatattgagatgacagtgttctttttggctggattcaacatcatagtcaccagcttaacagtccttgtttcctacgtcttcatcctctccagcatcctccacatcagcaccacacagggaaggtccaaagccttcagcacctgcagctctcaccttgcagctgtggtaatgttctatggatctactgcatttatgtacttaaaaccctccacggccagttctgtggccaaggagaatgtggcctccgtgttctacaccacggtgatccccatgctgaaccccctgatctacagcttgaggaataaggaggtaaagactaccgtgcagaaaacactgaggagaatactcttcag

SEQ ID NO: 3214 - protein, 302 aa, Felis catus
  MOD_RES (302)..(302): Any amino acid
VTEFILRGLTNRPELQLPLFLLFLGIYLVTVIGNLGMFTLICLNAQLHTPMYYFLSNLSLVDLCYSSVITPKMLVNFVSEKNIISYAGCMSQLYFFLVFVIGECYMLTVMAYDRYVAICSPLLYHVIMSPQVCSLLVSVVYAMGFIGATIETGLMLKLSYCELLISHYFCDILPLIKLSCSSTYHIEMTVFFLAGFNIIVTSLTVLVSYVFILSSILHISTTQGRSKAFSTCSSHLAAVVMFYGSTAFMYLKPSTASSVAKENVASVFYTTVIPMLNPLIYSLRNKEVKTTVQKTLRRILFX

SEQ ID NO: 3215 - DNA, 936 bp, Felis catus
tcaagaagatatttttctttccaaggtgttcctcagggaaactttgacatccttgttcctcaaactgtagatcagtgggtttaacatgggcaccacaatggtatagaacagagaggacactttcccttggtcaaggggcaaaatagaaggtggtttgagatacatgaaagccccagaaccaaagaaaagagaaaccacaattatatgagagctacatgtactgaaagctttggacctgccctcagtggagtgaatgtgcagaatgctggacagaatcagagcataagagatgaagatggtgataatgggcattccaatgtcaatggccacaaggatgaagaccaccagttcatttacataagtgctgttgcaggacagctcgaggagaggaaggatgtcacacatgaaatgattgagaaggttgtcagcacagaaggtcagacttgctatgcttcccgtatggaccatagcccctgaaagccccatcacgtagacacccaacaaaaggaatagacagacctgaggagacatggtgaccatgtacaccaatggtttacagatggccacatagcggtcatatgccatcactgacaggaggaaggactcagaaatgacaaagaagcagaagaaaaagagttgagtcatacactctgcatgcaagatgatgttcttctttgagacaaaactcttcagcattttgggggtgatggtagtggagtagcagaaatctattaaggagaggttgaagaggaaaaagtacattggggtgtgtaggcaagaattcaaccgaatcagggctatcaaggccaggtttcccagcacagtgaccatgtagaaacctagaaacaggaagaagagagggatctggagttccagctggtctgttaaacctgtaaggataaactctgtcacagaagagttcttagctgccattct

SEQ ID NO: 3216 - protein, 310 aa, Felis catus
MAAKNSSVTEFILTGLTDQLELQIPLFFLFLGFYMVTVLGNLALIALIRLNSCLHTPMYFFLFNLSLIDFCYSTTITPKMLKSFVSKKNIILHAECMTQLFFFCFFVISESFLLSVMAYDRYVAICKPLVYMVTMSPQVCLFLLLGVYVMGLSGAMVHTGSIASLTFCADNLLNHFMCDILPLLELSCNSTYVNELVVFILVAIDIGMPIITIFISYALILSSILHIHSTEGRSKAFSTCSSHIIVVSLFFGSGAFMYLKPPSILPLDQGKVSSLFYTIVVPMLNPLIYSLRNKDVKVSLRNTLERKISS

SEQ ID NO: 3217 - DNA, 921 bp, Felis catus
atggctgccgaaaatcactctacagtgaccgagtttattctcaggggattgacaaatcggccagagctccagctccctctcttcctcctcttccttgggatctacttggtcaccatcatagggaacctgggcatgttcacactgatttgtctgaatgctcagcttcacacccccatgtactacttcctcagcaatctgtcccttgtggatctctgctactcctctgtcattaccccgaaaatgctggtgaactttgtgtcagagaagaacatcatctcctatgcggggtgcatgtcacagctctacttcttcattgtgtttgtcgtggcagagtgttacatgctgacagtgatggcctatgactgctatgtcgccatctatacccctttgctctacaatgtcatcatgtctcctcaagtgtgttccctgctgatggctgcggcctatgccatggctttcattggcgcaacaatagacactggcctgatgttaaaactgtcctactgtgagttcctcatcagtcattacttctgtgacattgtgcccctcatgaagctctcctgctctagcacctatcatattgagatgacagtgttctttttggctggattcaacatcatagccaccagcttaacagtccttgtttcctacgtcttcatcctctccagcatcctccacatcagcaccacacagggaaggtccaaagccttcagcacctgcagctctcaccttgcagctgtgggaatgttctatggatctacagcgttcatgtacttaaaaccctccacggccagttctgtggccaaggagaatgtggcctccgtgttctacaccacggtgatccccatgctgaaccccctgatctacagcttgaggaataaggaggtaaaggctgccgtgcagaaaacactgaggagaaaa

SEQ ID NO: 3218 - protein, 307 aa, Felis catus
MAAENHSTVTEFILRGLTNRPELQLPLFLLFLGIYLVTIIGNLGMFTLICLNAQLHTPMYYFLSNLSLVDLCYSSVITPKMLVNFVSEKNIISYAGCMSQLYFFIVFVVAECYMLTVMAYDCYVAIYTPLLYNVIMSPQVCSLLMAAAYAMAFIGATIDTGLMLKLSYCEFLISHYFCDIVPLMKLSCSSTYHIEMTVFFLAGFNIIATSLTVLVSYVFILSSILHISTTQGRSKAFSTCSSHLAAVGMFYGSTAFMYLKPSTASSVAKENVASVFYTTVIPMLNPLIYSLRNKEVKAAVQKTLRRK

SEQ ID NO: 3219 - DNA, 918 bp, Felis catus
ctgtaatggatcagagaactactcactggtcttctacctggtaggcatcctgtctctgcatgaatctttcttcctccctgtcttcttgattttcctcttaatttacctgctcatcctgctgggaaatgcctgatcctgttggctgtggtggcagagcccagcctccacaagcccatgtacttcttcctgatcagctctgagccttggacattctactacaaccgtcgtccccaaaatgtcatccttattcttacttggggaccacttcctcagcttccctgcctgcttcctgcagatgtacctcttccatagcttctcctactcagaagccttcatcctggtggtcatggcctatgactgctacgtggctgtctgccacccactgcactaccctgtcctcatgactccacagaccaatgctgcactggcagcctgtgcctggctcactgccctcctcctggccaacccagcagtggtgcagacttcccacatggcttttgacaacactgctcacatctatcactgcttctgtgaccacctggctgtggtccaggcctcttgctcggacaccatgcctcatgggcttctgtatcgccatggcagtatccttcctgccccttgtcctggtgcttctctcctatgcccacatcctggcctcggtgcttcacatcagctcccgagaaggatgctcagaagtcttctccacctacagctcctacatcctggtggttggcacctactacttatccattgccatagcctatgtggcctacagagctaacctgccactcgacttccacatcatgggcaatgtggtatatgctattctcacacctgtcctcaaccctctcatctatgcgctgaggaacaaggatgtcaaagcagccatcaccagaatggcatgtccccaggacccag

SEQ ID NO: 3220 - protein, 168 aa, Felis catus
  MOD_RES (168)..(168): Any amino acid
MLHWQPVPGSLPSSWPTQQWCRLPTWLLTTLLTSITASVTTWLWSRPLARTPCLMGFCIAMAVSFLPLVLVLLSYAHILASVLHISSREGCSEVFSTYSSYILVVGTYYLSIAIAYVAYRANLPLDFHIMGNVVYAILTPVLNPLIYALRNKDVKAAITRMACPQDPX

SEQ ID NO: 3221 - DNA, 948 bp, Felis catus
atggaggccacaacttgtaatggatcagtggatggatcaccagtcttctatctggtgggaatcccctctttgccagagaccttcttcctccctatgttttttattttcctcctcttctatcttctcatccttatgggaaatgccctgatcctggtggctgtggtggcagagcccagcctccacaagcccatgtacttcttcctgatcaatctctctactctggacattctcttcaccacaaccactgtccccaagatgctgtccttattcctgcttggagaccacttcctcagcttccctgcttgcttattgcaaatgtacctcttccaaggcttcacatgttcagaagccttcatcttggtggtcatggcctatgaccgctatgtggctatctgccgcccactgcactaccctgtccacatgaccccacagaccaatgcttcactggcagcctgtgcctggcttaccgccctcctcctgcccatcccagcagtagtcaagacctcccagatggcatataacaacattgctcagatctaccattgtttctgtgatcatttagctctggttcaggcttcctgctctgacaccatgccccagaccctcatgggcttctgtattgctatggtggtatccttcctgccccttctcctggtgcttctttcctatgcccacatcctggcctcggtgcttcgcatcagctcccgagaaggacgctcaaaagccttctccacctgcagctcccacctcctggtggttggcacctactattcatccatcgccatagcctatgtggcctacagggctgacttgccgctcgacttccacatcatgggcaacgtagcatattctattctcacaccaatcctcaaccctctcatttacactctgagaaacaaggatgtcaaggcagccattacgaaaatcacatctctcaagacccagtct

SEQ ID NO: 3222 - protein, 316 aa, Felis catus
MEATTCNGSVDGSPVFYLVGIPSLPETFFLPMFFIFLLFYLLILMGNALILVAVVAEPSLHKPMYFFLINLSTLDILFTTTTVPKMLSLFLLGDHFLSFPACLLQMYLFQGFTCSEAFILVVMAYDRYVAICRPLHYPVHMTPQTNASLAACAWLTALLLPIPAVVKTSQMAYNNIAQIYHCFCDHLALVQASCSDTMPQTLMGFCIAMVVSFLPLLLVLLSYAHILASVLRISSREGRSKAFSTCSSHLLVVGTYYSSIAIAYVAYRADLPLDFHIMGNVAYSILTPILNPLIYTLRNKDVKAAITKITSLKTQS

SEQ ID NO: 3223 - DNA, 923 bp, Felis catus
atggagactagagcctataatggatcagaggactcctcaaccatcttctacctggtgggaattccctctctacccaaatctttctttcttcctatcttctttatctttctcctactctacttactcatcctgctgggaaatgccctgatcctggtggctgtggtggcagagcccagcctccacatgcccatgtacttcttcctgatcaacctctcagccttgcgcatccttttcaccacaaccaccatctccaagatactgtccctcctcttactgggggactgcttcctcagcttccctgcctgcttcctgcagatgtacctcttctatagcttctcctactcagaagccttcatcctggtggtcatggcctatgaccgctatgtggctgtctgccacccactgcactaccctgtcctcaggactccacagaccaatgctgcactggcagcctgtgtctgctcactgccctcctccggcccaccccagtggtggtgcagacttcccacatggcttttgacaacactgttcacatctatcactgcttctgtgaccacctggctgtggtttaggcctcctgcttagccccaggctctcatgggcttctgcatcgccatggcagtatccttcctgccccttgtcctggtgcttctctcctatgcccacatcctggcctcggtgcttcgcatctgctcccgagaaggacgctcagaagacttctccacctgcagctcccacctcctggtggttggcacctactacttatccattgccatagcctatgtggcctacagcgctaacctgccactcgacttccacatcatgggcaatgtggtatatgctattctcatacctgtcctcaaccctctcatctatgctgaggaacaagaatgtcaaagcagccatcaccagaacggaatgtc

SEQ ID NO: 3224 - protein, 194 aa, Felis catus
METRAYNGSEDSSTIFYLVGIPSLPKSFFLPIFFIFLLLYLLILLGNALILVAVVAEPSLHMPMYFFLINLSALRILFTTTTISKILSLLLLGDCFLSFPACFLQMYLFYSFSYSEAFILVVMAYDRYVAVCHPLHYPVLRTPQTNAALAACVCSLPSSGPPQWWCRLPTWLLTTLFTSITASVTTWLWFRPPA

SEQ ID NO: 3225 - DNA, 1033 bp, Felis catus
caagttgataaagtcctttcactctggcagttgcccctccactctcatattctgtagtctctggcttctccccaacctcctgggctgatttattgccatagagcatcttttccacatgttgccggatctccctggtctgtactccataaatgataggattcaaggatcctgggagtagcaagtagatggcactgagcaggttctggacatccggagacacagtcttggccactcggaagacaatggaggtagagagaccagagaggtagatagtgaggatgaccagtaagtgggagccacatgtgtgcaaggccttggctcgggctctcccagaagagatccagaaggcagcatagatgatgcgtgtataggaggtccctagcagggctagatccaaggtcacagtgaccaaccgcatggtcagtcccaacccattgttgaaagtcaagtctccacaagctatgctcagcagtgcaatgtactcacaggcaaagtgtcgaatcaccattgtctggcagaatcgacctcgtgacgttagcaccaccaaaggcactgccacttccaggctccgtgtcagagcaagaatggccagcactcccagcaggcgggaagttatcaggtcagtatagtggagtgggtgacagatggccacgtagcggtctagggccatggccagcaggatattgtagtccaggagagaaaagtagataaagaacatctggtccaggcagccatgcagtgacatggggttagcataatgcacaaagccctccagcattttgggcatcacggctgtggcagcacaaatgttgacagccaggagcagggcgatgagcatgtacatgggttgatgcaaactccgttgggccaccaccgtgtggatgaccaggacgtttgcagagatgatcgtcacataaaggaaggtaagaggcaggaccaggaggggctgccactctcgcaatccagggaagcccaccaggaagaagttggtgtaggagatgctgaaggcactggtatctccattctcacccat

SEQ ID NO: 3226 - protein, 345 aa, Felis catus
  MOD_RES (345)..(345): Any amino acid
MGENGDTSAFSISYTNFFLVGFPGLREWQPLLVLPLTFLYVTIISANVLVIHTVVAQRSLHQPMYMLIALLLAVNICAATAVMPKMLEGFVHYANPMSLHGCLDQMFFIYFSLLDYNILLAMALDRYVAICHPLHYTDLITSRLLGVLAILALTRSLEVAVPLVVLTSRGRFCQTMVIRHFACEYIALLSIACGDLTFNNGLGLTMRLVTVTLDLALLGTSYTRIIYAAFWISSGRARAKALHTCGSHLLVILTIYLSGLSTSIVFRVAKTVSPDVQNLLSAIYLLLPGSLNPIIYGVQTREIRQHVEKMLYGNKSAQEVGEKPETTEYESGGATARVKGLYQLX

SEQ ID NO: 3227 - DNA, 908 bp, Felis catus
ttggaacagagttgccaggtgctgcctgatttccttggtcccggccccgtagatgacagggttaactagacatgggagcagcaggtagagggcgctgagtgagttgtgcatggccagggaggcggtgggagccacacggtagatgatggatcaggacatggtggaagagtagacggtgaagatgaccagcaggtgggagccacaggtgttcagggccttggaatgtgctctgcctgatgaaatccagaaggcagcatgggtgatgcgagagtaggaggctccaggtagcagcatgtccaggactctgttgaagatgtggacagtgagacccacagtcttgttcggggagatgtccccactggagagcttcatgagggccatgtgctcacaggcaaagtggtggatcaggtctgagcagcagaagtgaacctgggaggcaagccccacgagggggggggcaacaatgcaagtgctcctggcagctgccgcccccaccaggccagccagcaactgacccgtcactatctcagggtagcacagagggtagcagatggcaatgtagcagtccagggccatgaccaggaggatgttgcagtcaaagacaatgaggaagtagatgcagaacatctggagtagacagcaaggcagggagatgcggttgaagtgggtagagaagctgaacagcatggtgcgcatcacggtggcggcaacacagatgctgacagccaggagaagggaagtgagcaggtacatgggctggtgcaggctctgctgggccaccaccatgtgggtgaccagggcattggcagagatgatcaccaggtagaggctgaggaagggcagcaccagaagggcgcgagtgctcctgcagcccagggaagcccacccagaggaagctggtgtaggac

SEQ ID NO: 3228 - protein, 251 aa, Felis catus
PTPASSGWASLGCRSTRALLVLPFLSLYLVIISANALVTHMVVAQQSLHQPMYLLTSLLLAVSICVAATVMRTMLFSFSTHFNRISLPCCLLQMFCIYFLIVFDCNILLVMALDCYIAICYPLCYPEIVTGQLLAGLVGAAAARSTCIVAPPLVGLASQVHFCCSDLIHHFACEHMALMKLSSGDISPNKTVGLTVHIFNRVLDMLLPGASYSRITHAAFWISSGRAHSKALNTCGSHLLVIFTVYSSTMS

SEQ ID NO: 3229 - DNA, 951 bp, Felis catus
atgatttccttaaaccacactggtattagccacacaatcttccacttcctgggcatccctgggctagaggaccagcatgtgtggatttccatccccttcttcatttcctatgtcattgccctgcttgggaacagcctgctcatctgcattatcctcacaaagcacagcctccacgaacccatgtacctcttcctctgcatgctggccggagcagacgttgtcctctccacgtgcacagtacctcaggccttggccatcttctggttccatgctggggagatctccctggatcgatgcatcactcagttcttcattatccactgcactttcatctctgagtcagggatcttgctggtgatggcgtttgaccgctacattgccatatgctacccactgagatacaccactattcttacacatgcactcattgggaaaatcggtgtgaccatcttcctgagaagtttttgtatgatcttccccataatatttcttttgaaaagattgactttctgccaaaataagattattccacacacctattgtgaacacattggcttggccaaatatgcttgtaatgacattagtgtgaacatctggtatggactttttgtcatcgtgtctacagtggtcttagatgtcctgttaatttttgtttcatatctgctgattctccatgctgtcttccacatgccttcacgagatgctcgccacaaagctctcaacacatgtggctcccatgtctgcatcattgtcctcttttatggccctgcgatcttcacaacccttactcagcggtttggacgccacattccacctcatattcacatattattggctaatgtctgcattcttgttccacctatgctgaatcccatcatttatgggattaagaccaagcaaatccgagagcaggtggttcacatattttttccaaagcagaaatgactttgg

SEQ ID NO: 3230 - protein, 314 aa, Felis catus
MISLNHTGISHTIFHFLGIPGLEDQHVWISIPFFISYVIALLGNSLLICIILTKHSLHEPMYLFLCMLAGADVVLSTCTVPQALAIFWFHAGEISLDRCITQFFIIHCTFISESGILLVMAFDRYIAICYPLRYTTILTHALIGKIGVTIFLRSFCMIFPIIFLLKRLTFCQNKIIPHTYCEHIGLAKYACNDISVNIWYGLFVIVSTVVLDVLLIFVSYLLILHAVFHMPSRDARHKALNTCGSHVCIIVLFYGPAIFTTLTQRFGRHIPPHIHILLANVCILVPPMLNPIIYGIKTKQIREQVVHIFFPKQK

SEQ ID NO: 3231 - DNA, 949 bp, Felis catus
atgactaccttaaaccacactgctgttagtcacatggtcttctgtttgctggccattcctggccttgaggaccagcatgtgtgggcttccatccccttcttcatttcctatgtcatcgccctgcttgggaacagcctgctcatctgcattatcctcacaaagtgcagcctccacgaacccatgtacctcttcctctgcatgccgggcggagcagacattgtcctcttcacgtgcacagtaactcaggccttggacatcttctggttccgtgctggggagatctctctgaatcgctgcatcacttagctcttcttcatccataccaccttcatctctgagtcagggatcttgctggtgatggagtttgagtgctacattgccgtatgctacctactgagatacaccactattcttacatgtgcactgattgggaaagttggattgactatctttctgagaagttatggtacaattttccctataatgtttcttctgaaaagattggctttttgaaaaagtagcatcctcccaaacacagcctgtaagcatactgtcttggcccgtgcttcctgtaatgacatatgactaaacatctggtatgtggttttgtcctaatgtcaacagtggtcttgggtatcgtgctaatttttatttcatatgtgctgattctccacgctgtcgtctgcatcccttctggagacgcttgtcacaaagctctcaatacttgcggctcccatgtctgtgtcattgtcctcttttatggacctgggagctttacaacacttactcagcagtttggatgccacatcacaccccacattcatgttctgctggccagtatctgcattctggctcctcctatgctaaatcccatcatttatgggataaagaccaaacagatccgggaccaggtggtttatgcattgtttacaaagcagaaataattttg

SEQ ID NO: 3232 - protein, 117 aa, Felis catus
MWFCPNVNSGLGYRANFYFICADSPRCRLHPFWRRLSQSSQYLRLPCLCHCPLLWTWELYNTYSAVWMPHHTPHSCSAGQYLHSGSSYAKSHHLWDKDQTDPGPGGLCIVYKAEIIL

SEQ ID NO: 3233 - DNA, 944 bp, Felis catus
tcatttctgctttggaaacaacacataaactacttggtctcatatctgttttattttgaccccataaatgataggattcagcatcggtggaacaagcatgctgacattggccaacagaatgtggacatgtagtgggatgtgacgtccaaagcgctgagtgagaaccaagaagatcccaggcccataaaaaaggacaatgacacagacatgggagccacatatgttgagagctttgtggcaagcatctcgggaagggatacggtagatagcatggagtatcagagtataggaaacaaaaatgaggacaatgtctaggatcactgtggacattaggacaaaaaatccataccagatgtttatacggatatcatcacaggcatacttggccaaaccaatgtgttcacagaatgtatgtggtaggatgttatttctgcaaaaagtgagtctcttcagaagaaatatcatggggaaaattgtacaatgtgctctcaagaaaacagccacaccaattttccctatcagagaatgagtgagtatcatggtgtacctcagtgggtaacatattgcaatgtagcggtcaaatgccataatcagcaagatgccagactcagaaatgaagaaggaatgctggaagtagagctgggcaatgcagctattaagagagatctccctattattgaaccaaaaattgccaatgccttgggttctgtggttgtggcaaagacaatgtcaactccagccagcatgcagaggaaaagatacataggctcatggaggctgctcttggtgaggataatatagatgagcagaccatttccaagaagagcaaagacataggagatgagtaagggggtggaaatccatatgtgtaggtcttctcggcctggaatgcccagcagatagaagactatatggttaacaccagtgtgattgaagctagccat

SEQ ID NO: 3234 - protein, 117 aa, Felis catus
MASFNHTGVNHIVFYLLGIPGREDLHIWISTPLLISYVFALLGNGLLIYIILTKSSLHEPMYLFLCMLAGVDIVFATTTEPKALAIFGSIIGRSLLIAALPSSTSSIPSSFLSLASC

SEQ ID NO: 3235 - DNA, 964 bp, Felis catus
atggcaacccataaccacactggtgccagccactcacttttcattctgcggggcatccctggcctggaagaccagcacatatggatttctcttcccttctttatttcctacctggttgctctccttgggaatagcctccttgtcttcatcatcattactgaacgcagcctccatgaacccatgtacctctttctctgcatgctagctgtggctgacctcatcctgtccactaccactgtgcccaaagccctggccatattctggtttcatgctggggagatctcccttgatggctgcgtcactcaaatcttcttcatccatgccaccttcattgctgaatcagggattctgttggccatggcatttgaccgctatgtggccatctgtgacccactgcgatatactacactgctcagtcatgcagtaatcataaaggttggtctggctgtggtcctgagaagcttctctgtgatactcccagatgtgttcctggtgaagagactgcctttctgccatagcaatgtgttaccacatacctactgtgagcacatggctgttgccaagtttgcttgtgctgatattcgtgtcaatgtctggtatggcttgtctgttcttctctctactgtaatgccagatgccttgctcatcttgttttcgtataccctcatcctcaatgcagtcttccacctcccttcccgaggagctcggcaaaaggctctaggcacatgtggctcccaccttggggtcatttccatgttctatttgtctggcatttttactgtaattacccagcggtttgggcatcatgttcccctccatactcacattctgctggccaatatctgcacattagcccctcccatgctgaaccctatcatttatggggtcaagaccaggcagattcgagtgtgtgtggtcagtactctgtcttcacagtagaaacatgttgagtctgtgtgactga

SEQ ID NO: 3236 - protein, 312 aa, Felis catus
MATHNHTGASHSLFILRGIPGLEDQHIWISLPFFISYLVALLGNSLLVFIIITERSLHEPMYLFLCMLAVADLILSTTTVPKALAIFWFHAGEISLDGCVTQIFFIHATFIAESGILLAMAFDRYVAICDPLRYTTLLSHAVIIKVGLAVVLRSFSVILPDVFLVKRLPFCHSNVLPHTYCEHMAVAKFACADIRVNVWYGLSVLLSTVMPDALLILFSYTLILNAVFHLPSRGARQKALGTCGSHLGVISMFYLSGIFTVITQRFGHHVPLHTHILLANICTLAPPMLNPIIYGVKTRQIRVCVVSTLSSQ

SEQ ID NO: 3237 - DNA, 949 bp, Felis catus
atgttctcctgcaacaccagcacttctggtcattctaccttcctcctcactggctttccaggcctggaagcctctcattattgggtttctatccccatcaacctcatctgtgtgttttccatcctgggtaacggtatcattcttctcctgatctgcacggatccagccttacgtgaacccatgtacatcttcctgtccatgttggcagcctctgatctaggcctctgtgcctctacttttcccaccatgatgtggcttttctggctgggtgctcgtgagctgccctttgatctctgtgcagcgcagatgttcttcatccatgccttcacctatgtggaatctggtgtgctgctggccatggcctttgatcgttttgttgccatccgggaacctctgcactatgccacaattcttacccactcagccatggccaaggtgggggctgccatcctggtgagggctgtcctgctcaacctcccaggacccatcctcctgcggcgtctgcttttcccccagatcagtgtactttctcactgctactgcctgcactgtgaccttgtgggattggcctgctcagacacccagatcaacagcttggttggcctggtctccatcctcttctcactgggccttgattcctccctcattgtgctctcatacgccctgatcctacaaacagtactgggcattgcatcacctggagaacagctcaaggcactcaacacatgtgtctcacacctctgcgttgttctcatcttttatttgcccaaactggggctgtctgtgttacacagagtagagaagcacagctatcctgctctggcagtgctcatggccaacctgcatttcttggtcccgcctatcatgaaccccatagtttactgtatcaagtctaagaagatacgtcagagcctcctaaagcacttccagcataaaagggttgatgtct

SEQ ID NO: 3238 - protein, 317 aa, Felis catus
  MOD_RES (317)..(317): Any amino acid
MFSCNTSTSGHSTFLLTGFPGLEASHYWVSIPINLICVFSILGNGIILLLICTDPALREPMYIFLSMLAASDLGLCASTFPTMMWLFWLGARELPFDLCAAQMFFIHAFTYVESGVLLAMAFDRFVAIREPLHYATILTHSAMAKVGAAILVRAVLLNLPGPILLRRLLFPQISVLSHCYCLHCDLVGLACSDTQINSLVGLVSILFSLGLDSSLIVLSYALILQTVLGIASPGEQLKALNTCVSHLCVVLIFYLPKLGLSVLHRVEKHSYPALAVLMANLHFLVPPIMNPIVYCIKSKKIRQSLLKHFQHKRVDVX

SEQ ID NO: 3239 - DNA, 948 bp, Felis catus
ttaagactgaacaatgccccgcttcagcagtcggagggccccatcccggatctgcttggtcttcatgccatagatgatggggttgagcatgggtggtacaacaaggtagaggtcagccaagaggatatggatgtgccggggcacatgctggccaaagcgctgagtgtagaatgagaagagccctggtgtatagaagagaaggatgacacccaggtgggagccacaagtgccaaaggtcttagctcttgcctctttggaggagaggcctaacacagcccggaggattagtgtataggagacagtgatgcagatggaatctgtgcccacaactagcgtggcagcagtaatgccatagatgttgtttggccgtgtacccccacaagccagctttaccacagccatgtgctcacagtaggagtgggccaccactcggctacagtagctcagccttgccaataagcatgtgagtggggtcatgaggcccaagccacgaaacacagcagcagctgccagcttgcccacagcctctgggggcaacaatgacccatagtgcagtggccggcagatggccaagtagcggtcaaaggccattgctaacaggataccagattcaacagctgaaaagccatggataaagaacatctgagtagcacaggccccaaagtcaatctcagtagcatttgtccaaaaaagtgcaaggagtttgggcacagtagaagtgcagagcaccaggtcaatgatggacagcatgcataggaacaggtacatgggctggtgcagtgcaggctctgatcgcaccaccagcagcactgccatgttgccaagcactgccagggcatacatggagcagaagggaaatgcaatccaaaagtgggatgcctccaggccaggaattcccatgagcagaaaagagtttgggttctgatggctgtggtttgtgaaatgcat

SEQ ID NO: 3240 - protein, 315 aa, Felis catus
MHFTNHSHQNPNSFLLMGIPGLEASHFWIAFPFCSMYALAVLGNMAVLLVVRSEPALHQPMYLFLCMLSIIDLVLCTSTVPKLLALFWTNATEIDFGACATQMFFIHGFSAVESGILLAMAFDRYLAICRPLHYGSLLPPEAVGKLAAAAVFRGLGLMTPLTCLLARLSYCSRVVAHSYCEHMAVVKLACGGTRPNNIYGITAATLVVGTDSICITVSYTLILRAVLGLSSKEARAKTFGTCGSHLGVILLFYTPGLFSFYTQRFGQHVPRHIHILLADLYLVVPPMLNPIIYGMKTKQIRDGALRLLKRGIVQS

SEQ ID NO: 3241 - DNA, 942 bp, Felis catus
tcagcctccaacatcacctcaacccatccgtcagtcttcgtgttgatggggattccaggcctgcagcacctacataattggatctccattcccttctgctcagcttatactctagccttgctaggcaactgcaccctcctcttcatcatccagactgatgcagccctccacgagcccatgtacctctttctggccatgctggcagtcattgatctggttctctcttctacaacacttcccaaaatgctagctattttttggttcagagatcgggagatcaacttctatgcctgtctggtccagatgttctttctccactccttctctatcatggagtcagcaatgcttctggccatggcctttgaccgctatgtggctatctgcaagccactgcactacactacagtcctgactgggtcccttatcactaggattggcatggctgctgtgactcgggctgtgacactaatgactccactcccctttctgctcagacgtttccactactgccgaggccccctaattgcccactgctactgtgagcacatggctgtggtaaggcttgcctgtggggacactcgcttcaacaatatctatggcattgctgtggccatgtttatagtggtgttggacctgctctttgttatcctgtcttatatcttcatccttcaagcagttctacggctctcctctcaggaggcccgttacaaggcctttgggacatgtgtgtctcacataggtgctatcttagctttctacacacctgtggtcatctcctcagtcatgcaccgtgtggctcgccaggctgcccctcatgtccacatactctttgctaatttctatctgctcttcccacccatgattaatcccatcatctatggtgtcaagaccaagcagattcgcaagcgagccttaggactattctcaagaaaggatgtataa

SEQ ID NO: 3242 - protein, 313 aa, Felis catus
SASNITSTHPSVFVLMGIPGLQHLHNWISIPFCSAYTLALLGNCTLLFIIQTDAALHEPMYLFLAMLAVIDLVLSSTTLPKMLAIFWFRDREINFYACLVQMFFLHSFSIMESAMLLAMAFDRYVAICKPLHYTTVLTGSLITRIGMAAVTRAVTLMTPLPFLLRRFHYCRGPLIAHCYCEHMAVVRLACGDTRFNNIYGIAVAMFIVVLDLLFVILSYIFILQAVLRLSSQEARYKAFGTCVSHIGAILAFYTPVVISSVMHRVARQAAPHVHILFANFYLLFPPMINPIIYGVKTKQIRKRALGLFSRKDV

SEQ ID NO: 3243 - DNA, 945 bp, Felis catus
atgacagcctccaatattaccacaacccatccaacttccttcctgctggtaggaattccaggtttggaacacctgcatgtctggatctctattccattctccttcgcctatactctggccctgctaggcaactgcaccctcctcttcatcatccagactgatgcagccctccacgagcccatgtacctctttctggccatgctggcagtcattgatctggttctctcttctacaacacttcccaaaatgctagctattttttggttcagagatcgggagatcaacttctatgcctgtctggtccagatgttctttctccactccttctctatcatggagtcagcaatgcttctggccatggcctttgaccgctatgtggctatctgcaagccactgcactacaccacagtcctgactgggtcccttatcactaggattggcatggctgctgtgactcgggctgtgacactaatgactccactcccctttctgctcagacgtttccactactgccgaggccccctaattgcccactgctactgtgagcacatggctgtggtaaggcttgcctgtggggacactcgcttcaacaatatctatggcattgctgtggccatgtttatagtggtgttggacctgctctttgttatcctgtcttatatcttcatccttcgagcagttctacggctctcctctcaggaggcccgttacaaggcctttgggacatgtgtgtctcacataggtgccatcttgtccacctacacacctgtggtcatctcctcagtcatgcaccgtgtggctcgacaggctgcccctcatgtccacatactccttgctattttctatcttctttttccacccatgatcaaccccatcatttatggcatcaagaccaaacagattcgtgatcatgtgctcagtctatttcaaagaaagaatgtgtag

SEQ ID NO: 3244 - protein, 314 aa, Felis catus
MTASNITTTHPTSFLLVGIPGLEHLHVWISIPFSFAYTLALLGNCTLLFIIQTDAALHEPMYLFLAMLAVIDLVLSSTTLPKMLAIFWFRDREINFYACLVQMFFLHSFSIMESAMLLAMAFDRYVAICKPLHYTTVLTGSLITRIGMAAVTRAVTLMTPLPFLLRRFHYCRGPLIAHCYCEHMAVVRLACGDTRFNNIYGIAVAMFIVVLDLLFVILSYIFILRAVLRLSSQEARYKAFGTCVSHIGAILSTYTPVVISSVMHRVARQAAPHVHILLAIFYLLFPPMINPIIYGIKTKQIRDHVLSLFQRKNV

SEQ ID NO: 3245 - DNA, 955 bp, Felis catus
tcacttgggttgagactctgccttaaggatgtggagaaatctttctcgaatctgtttggtacggacagcatagacaactgggttgaggatgggtgggatgaggaggtaaaagttgggccaaaaggatatggatatggggaggcacatcatgtccaaagcggtgagtgagagaagaaacagcaatggggatatagaagacaagaatggcacaaatatgagaactacatgtccctagggttttaagcctagcctcaggggtgctcaatcccattacagccttgaaaatcatcacataggagacagtgatggctaatgaatccaagatcaataccaggaagccaattcccattccataaaagttgttgactgttgtgtcaccacatgccatggtgactacagccatgtgctcacaataggaatgggcaatgatttgggtccggtaaaggggcagcctcaggcgaatcatcagaggtaggggtccaatgtagagtactccacggaggagggcagccaggcccaaacgacccaccactgcatgagtgagcactgaggtgtggtgtaatgggtcacaaatagcgacatagcgatcaaaagccatggcaaggaagatgcctgactcaacagtggcaaagcagtggatgaagaacatctgagtcaagcaggcatccaggtcaatgttgcgggcaccaaaccagaagatagctagcagtttgggcatggtagaggttgacaggaccaagtcaatgacagccaacatgcataggaagaagtacatgggttggtgcaggctgcgttccatctttatcaccgccaggatggtcacattccccaccacagccaccaggtacatagagctgaaggggatagaaagccagatgtgcagggactccagccctggaattccagtaagccagaaagaactaggcaccaagcaggcattgttagatatgaacat

SEQ ID NO: 3246 - protein, 310 aa, Felis catus
MFISNNACLVPSSFWLTGIPGLESLHIWLSIPFSSMYLVAVVGNVTILAVIKMERSLHQPMYFFLCMLAVIDLVLSTSTMPKLLAIFWFGARNIDLDACLTQMFFIHCFATVESGIFLAMAFDRYVAICDPLHHTSVLTHAVVGRLGLAALLRGVLYIGPLPLMIRLRLPLYRTQIIAHSYCEHMAVVTMACGDTTVNNFYGMGIGFLVLILDSLAITVSYVMIFKAVMGLSTPEARLKTLGTCSSHICAILVFYIPIAVSSLTHRFGHDVPPHIHILLAQLLPPHPTHPQPSCLCCPYQTDSRKISPHP

SEQ ID NO: 3247 - DNA, 954 bp, Felis catus
atgctcacttttcaaaattcctgctcagtacccagctccttccagcttgccggcatcccagggctggagtccctgcatctctggctttccatcccctttggctccatgtacctggttgccgtggtggggaacatcaccattctggctgtggtaaaggtggagaatagcctgcaccagcccatgtacttcttcctttgtatgttggcggttgttgacctggttctatccacttctactatgcccaaactgctgggaatcttctggtttggtgctggtgatattggcctggatgcctgcttggcccaaatgttcctcatccactgctttgccacagttgagtcaggcatcttccttgacatggctttggaccgctacgtagccatttgcaacccgctacatcataccacagtgctcactcatgctatggtgggacggttggggctggctgccctctttcggggggtactctacattggacctctgcctttgatgatccgcctatggctgcccctttacaaggctcatgtcatctcacactcttactgtgagcacatggctgtggtcaccttggcatgtggtgacagcagggtcaacaatgtctatgggctaagcattggttttttggtcctaatcttggattccatggctattgctgtctcttatgtgatgattttccgggccgtgatggggctagccacacctgaagcccgacttaaaaccctggggacatgtggttctcacatctgtgccattctgatcttttatgttcctattgtggtttcttctctcattcaccgatttggtcaccaggtacctcctccaatccacactttactggctaacttctacctcctcattcctccaatccttaatcccattgtttacgctgtccgcaccaagcagatccgggagcggcttctccaaatgctgaagacagaaactaagttcaagtga

SEQ ID NO: 3248 - protein, 317 aa, Felis catus
MLTFQNSCSVPSSFQLAGIPGLESLHLWLSIPFGSMYLVAVVGNITILAVVKVENSLHQPMYFFLCMLAVVDLVLSTSTMPKLLGIFWFGAGDIGLDACLAQMFLIHCFATVESGIFLDMALDRYVAICNPLHHTTVLTHAMVGRLGLAALFRGVLYIGPLPLMIRLWLPLYKAHVISHSYCEHMAVVTLACGDSRVNNVYGLSIGFLVLILDSMAIAVSYVMIFRAVMGLATPEARLKTLGTCGSHICAILIFYVPIVVSSLIHRFGHQVPPPIHTLLANFYLLIPPILNPIVYAVRTKQIRERLLQMLKTETKFK

SEQ ID NO: 3249 - DNA, 975 bp, Felis catus
atgctggggataccctataaccacacagtggaaactcctgccaccttcttccttgtgggtatcccaggtttgccatcttcccatctttggctggctatttcactgggtgccatgtataccatatccctgttaggaaacaccctcatcatgaccgtaatctggatggatttcactctacgagagcccatgtattgcttcctgtatgtactgactgctgtggatattgttatggtctcctctgtggtaccaaagatggtgagcatattctcttcaggagatggctccatcagctttaatgcttgtttcactcagatgtattttgtccatgtagccacatctgtggagacagggctattgctggccatggcttttgaccgctatatagccatctgtaagcccctgcactacaagaggattctcacacctcaactgatgctggtaatgagtgtggccatcaccatcagggctgtcatattcatgactccactgagttggatggtaagtcatctgcctttctgtggctccaatgtggttctccattcctactgtgagcacatagccgtggccaagttggcatgtgctgaccccatgcccagtagtctctacagtgtgattggctcctccattattgtgggctctgatgtggccttcatttctgcctcctataacctgattctccaggcagtatgtggtctctcttcaaagaatgctcaattgaaagcattaagcacatgtggctcccacatgggggttatggctctgtactacctacctgggatggcatccatctatgtggcctggctagggaaggatacagtgcctctgtacatccaagtactgttagctgatttgtatttgatcatcccacctacctttaaccccatcatttatggcctgaggaccaaacaaatgcggaagcgaatatggagcttgctgatacactgcctctttgacctctccaaactgggttcataa

SEQ ID NO: 3250 - protein, 324 aa, Felis catus
MLGIPYNHTVETPATFFLVGIPGLPSSHLWLAISLGAMYTISLLGNTLIMTVIWMDFTLREPMYCFLYVLTAVDIVMVSSVVPKMVSIFSSGDGSISFNACFTQMYFVHVATSVETGLLLAMAFDRYIAICKPLHYKRILTPQLMLVMSVAITIRAVIFMTPLSWMVSHLPFCGSNVVLHSYCEHIAVAKLACADPMPSSLYSVIGSSIIVGSDVAFISASYNLILQAVCGLSSKNAQLKALSTCGSHMGVMALYYLPGMASIYVAWLGKDTVPLYIQVLLADLYLIIPPTFNPIIYGLRTKQMRKRIWSLLIHCLFDLSKLGS

SEQ ID NO: 3251 - DNA, 956 bp, Felis catus
tggttcctgtcatggccactccaaatggaactctggtccatccagcatacttcctgctggtgggaatccctggcctggggcctgacatacacttttggctggctttccccctgtgctttatgtatgccatggccaccctgggaaacctggccattgtcctcatcatccgtgtggaaaggcgtctgcacgagcccatgtacctcttcctggccatgctttccactattgacctagtcctgtcttctgtcaccatgcccaagatggccagcctcttcctgacaggcatccaggagataggattcaatgtttgtctggcccagatgttccttatccatgctctgtcagccatggagtcagctgttctgctggctatggcttttgaccgctttgtggccatctgtcatccactgcggcatgcttctgtgctcacagggcctactgtggccaagattggactagctgccctgaccaggggatttgttttcttcttccctctgcccttcatcctgaagcggttgtcatactgccaaacacatatggtcacacactccttctgtctgcaccaagatattatgaagttgtcctgttctgacaccagggtcaatgtagtatatggactcttcattatcctctcagtcatgggtgtggactccctcttcattggcttctcctacattcttatcctgaagactgtgttggagctggcttctcagggggcagcactcaaggctttcaatacctgcctctcccatctctgtgctgtcctggtcttctatgtgcccctcattgggctctcagtggtgcacaggctggggggccctacctccctgctccatgtgattatggctaatatctatttgctactaccacctgtggtcaaccctgttgtctatggagccaaaaccaaggagatccgttcacgggtcctccatatgttctcacagggtggcaggtga

SEQ ID NO: 3252 - protein, 314 aa, Felis catus
MATPNGTLVHPAYFLLVGIPGLGPDIHFWLAFPLCFMYAMATLGNLAIVLIIRVERRLHEPMYLFLAMLSTIDLVLSSVTMPKMASLFLTGIQEIGFNVCLAQMFLIHALSAMESAVLLAMAFDRFVAICHPLRHASVLTGPTVAKIGLAALTRGFVFFFPLPFILKRLSYCQTHMVTHSFCLHQDIMKLSCSDTRVNVVYGLFIILSVMGVDSLFIGFSYILILKTVLELASQGAALKAFNTCLSHLCAVLVFYVPLIGLSVVHRLGGPTSLLHVIMANIYLLLPPVVNPVVYGAKTKEIRSRVLHMFSQGGR

SEQ ID NO: 3253 - DNA, 954 bp, Felis catus; identical to SEQ ID NO: 23

SEQ ID NO: 3254 - protein, 317 aa, Felis catus; identical to SEQ ID NO: 53

SEQ ID NO: 3255 - DNA, 963 bp, Felis catus
tcagtcttggccttttctctttagcatcctaagcatggcttccctgatgggcttggatttcacactgtagatgatggggttgagcacagggggtaccaccaggtatacataggcaaccagggcatgtgcaatgggggacaagtgcctcccaaaacggtggatcatggacgtggtaatgcctggaatgaaaaagacaaagacagccaggatatgggaaacacaggtgttgaaggctcggatgcgctccctgggagatgccagtcccaggattgtgtgtaggatgagaatataggataggatgatgagcagagagtctatgcctccagtggacaataccacatagagcccatagaagatgtttatggtgatgtcagcacaggctcttctcatcacatcaggatgaaaacagaacgagtgggacaaaaggattttgttagggcagaagttcaagcgtttaagcaggaaaggcactgggaagagagacagggcagcacgggccacaatggccatcccaatcctgatgatgacattattggtgaggacagttgcatagcgaagagggttcgagatggccacaaagcggtcaaatgacatggccaggagcactgacgactccaccacagagaaggaatggagaaagaacatctggaccaggcaggcattgaagcctatgagcctgtggccaaaccagagcacagccaaggtggtgggcagtgtggacagggtgaggcccacgtcggtgagggccagcatggacaagaaatagtacatgggctggtgcaggctgggagtcttcctcacagccaagaggatcaggcagtttccagtgagggccatagtgtacatggaggagaaggggatagagatccatccatgaacagcctcatgccctgggatgccaatcatcaggaaggcatgtggctggaagaaggagatgttgacataggtctgggaagggagcat

SEQ ID NO: 3256 - protein, 320 aa, Felis catus
MLPSQTYVNISFFQPHAFLMIGIPGHEAVHGWISIPFSSMYTMALTGNCLILLAVRKTPSLHQPMYYFLSMLALTDVGLTLSTLPTTLAVLWFGHRLIGFNACLVQMFFLHSFSVVESSVLLAMSFDRFVAISNPLRYATVLTNNVIIRIGMAIVARAALSLFPVPFLLKRLNFCPNKILLSHSFCFHPDVMRRACADITINIFYGLYVVLSTGGIDSLLIILSYILILHTILGLASPRERIRAFNTCVSHILAVFVFFIPGITTSMIHRFGRHLSPIAHALVAYVYLVVPPVLNPIIYSVKSKPIREAMLRMLKRKGQD

SEQ ID NO: 3257 - DNA, 963 bp, Felis catus
tcagccttgcctcttctctctcagtaatctgagcatggcctccctgatgggcttggatttcacactgtaaataatggggttgagcacagggggcaccaccaggtacacataggcaataagagcatgtacaatgtgaggcaggtgcctgccaaaacggtggatcattgacactcctatgactgggatgtagaaaatcagaacagctaatatatgagaaacgcatgtgttgagggcccggacacgctccctgggagaggccagacccatcactgtacgaagaataagggtataggacaggaaaataagcaaagaatctacacccactgtggataaaactacatagagcccatagaggatgttgacagtaatgtcagcacaggcccgtttcatgacatctgcatggaaacagaaggagtgggacaggagaatcttgccaggacaaaagttcagtcgcttcagtaagaagggccctggaaagagggatacagtggcccgagcaacaatggcgatcccgatcctgatgatgacattattggtgaggacagttgcatagcgaagagggttcgagatggccacaaagcggtcaaatgacatggccaggagcaccgacgactccaccacagagaaggaatggaggaagaacatctggaccaggcaggcattgaagcctatgagcctgtggtcaaaccagagcacagccaaggtggtgggcagtgtggacagggtgaggcccacgtcggtgagggccagcatggacaagaagtagtacatgggctggtgcaggctgggagtcttcctcacagccaagaggatcaggcagtttccagtgagggccacagtgtacatggaggagaaggggatagagatccatccatgaacagcctcatgccctgggatgccaatcatcaggaaggcatgtggctggaagaaggagatgttgacataggtctgggaagggagcat

SEQ ID NO: 3258 - protein, 320 aa, Felis catus
MLPSQTYVNISFFQPHAFLMIGIPGHEAVHGWISIPFSSMYTVALTGNCLILLAVRKTPSLHQPMYYFLSMLALTDVGLTLSTLPTTLAVLWFDHRLIGFNACLVQMFFLHSFSVVESSVLLAMSFDRFVAISNPLRYATVLTNNVIIRIGIAIVARATVSLFPGPFLLKRLNFCPGKILLSHSFCFHADVMKRACADITVNILYGLYVVLSTVGVDSLLIFLSYTLILRTVMGLASPRERVRALNTCVSHILAVLIFYIPVIGVSMIHRFGRHLPHIVHALIAYVYLVVPPVLNPIIYSVKSKPIREAMLRLLREKRQG

SEQ ID NO: 3259 - DNA, 971 bp, Felis catus
tcacctgcttcccacagcctgagggtccttgtcacagctgatcttgaacatagctagcatccgagttctgatctttttggtcttggcaccatagatgatgggattgatcacaggaggcagaagtagatagacatcacccataagaacatgcacgatggggtcaaggccttttccaaaacggtgaaccactgagagtccaatgagaggaacatagaaggctaaaaccacaccgatgtgtgacacacaggttccaaaagccttggcccgctctgacttggaaggcagttgtagaactgttcgtataatcagaaaataggacaaggagatgaagaggacatccacgcccataaccagcagaatggcagtaagaccatagacctcattgggcaatgtgtctgcataggccaacttcatcatatcctggtgcacgcaataggagtgtgagagcacattggagtggcagaaggccagccgcttgatgagcagaggcagtgggataaagaagagggatccacggaccacggccaccatgccaatctgggctgttactgtattgttgagcactgctgcgtggcgtagtgggtgacagatggctatataacggtcaaaggccatggccagcaggatggtggactcaatagctgagagggcatgaataaaaaacatctgggcaatgcaggcatcataggtaatctcccgggaatcaaaccagaagagggcgaggatcttgggcatggtggatgtggacaatgccaggtcaatggctgccaacatgcagagaaagaggtacatgggagcatgcaggctgcgctccgtccttacgatgaacaccacgatgcagtttccaaacactgctacagcatacattgaaagcagggggaagccgatccagaaatgggcttcttctaatccggggataccaatgagtacaaaggtggcatgtgtgaaattgcaggaactcatagctggca

SEQ ID NO: 3260 - protein, 320 aa, Felis catus
MSSCNFTHATFVLIGIPGLEEAHFWIGFPLLSMYAVAVFGNCIVVFIVRTERSLHAPMYLFLCMLAAIDLALSTSTMPKILALFWFDSREITYDACIAQMFFIHALSAIESTILLAMAFDRYIAICHPLRHAAVLNNTVTAQIGMVAVVRGSLFFIPLPLLIKRLAFCHSNVLSHSYCVHQDMMKLAYADTLPNEVYGLTAILLVMGVDVLFISLSYFLIIRTVLQLPSKSERAKAFGTCVSHIGVVLAFYVPLIGLSVVHRFGKGLDPIVHVLMGDVYLLLPPVINPIIYGAKTKKIRTRMLAMFKISCDKDPQAVGSR

SEQ ID NO: 3261 - DNA, 941 bp, Felis catus
atgccatccttcaatcagagcattttccaccctgcagtcttctttcttactggcatccctggctttgaaacttaccatgcctggctctccatccctttttgttgtctctatgccattgccatctctgggaatggcatgatcctgtttgtgatcttcactgagtcgagcctccatgaacccatgtactatttcctctccatgctatctttcacggacctaggactatgcctttccacattggtcaccatgctgggtattttctggttcaatgctcgagaaattagttttgatgcctgcattggtcaaatgttctttatccatggtttcacattcatggagtcctcagtactcctggcgatggcctttgatcgcttcactgccatctgtaacccactgagatatgccacaatcttaaccaattcaaggatcatcaaagtgggctttgccattgttattagggggacaacggctctagtgcctttactcctgctcctaaagcgtctttctgccatggccatgttctgcaccattcatattgtttccaccctgatgtgatgacgctttcatgcacagataccaagatcaacagtgcatttggtttggccattgtcatatcaactgctggcctagactctgtgtttatcctcctttcctatgttctgatcatccactctgtgctcaacatggcctccccagaggagcagaaaaaggtctttggtacctgtgtctcacacataagtgctgttgccatcttctacattcccatgatcagcttgtcactggtgcatagatttgggaagcaagcccctccccttgtgcacactctcattgccaatgtttatctgctcatccctcctgtgatgaatcccataatctacagtgtgaaaaccaagcaaattcgtaaggcagtgctcaaaatattcctttctaagatgatttag

SEQ ID NO: 3262 - protein, 184 aa, Felis catus
MPSFNQSIFHPAVFFLTGIPGFETYHAWLSIPFCCLYAIAISGNGMILFVIFTESSLHEPMYYFLSMLSFTDLGLCLSTLVTMLGIFWFNAREISFDACIGQMFFIHGFTFMESSVLLAMAFDRFTAICNPLRYATILTNSRIIKVGFAIVIRGTTALVPLLLLLKRLSAMAMFCTIHIVSTLM

SEQ ID NO: 3263 - DNA, 926 bp, Felis catus
aactttccagaataccacagctatgtccatcattttcctactaactgatgtttctgggttggaagtcttccacacctggatctccattcccttctgctttctctacataaccaacctctctggaaacagcctgattctctttgccattgtcactcagcccagcctccacgaacccatgtattatttcctctccatgctgcccaccactgacctcggcctgtccatatctaccctggtcaccatgttgggtatattctggtttgatgccagggagatcagctttaatgcctgcctgtcacagatgtttttcattcaactttacattgtcatggagtcctcagtgctgttggccatggcctttgatcgttttgtggccatctctaatcctcttagatatgcttctatcttaactgagcttaaaatagcacagattggaatagcaatcatcaccagggggcactaatccagactcctatggtgttgcttcttaaacgattgcccttttgccacagccatgtgctccaccactcatactgcttctaccctgacgtgatgaagctctcgtgcacagacaccaggatcaacagcgcagtggggttcacagccctgatcaccactgctggggtagactcggtcttcattattttttctaacttgttaatcgttaagactgtcttcagcattgcatctttgaaagagaggaagaaagccttcagcacatgtatctcccatattggggctgttgctgtattctacattccattgattagtctgtcctttgttcacagatttggaaatgggccccaccttatgtacatatcctggttgccaatacctacctgttaatccccctgtgctgaaccccatcatctacagtgtgaagaccaaacagatacgcagagctgtgctgaaagttctccatccca

SEQ ID NO: 3264 - protein, 153 aa, Felis catus
TFQNTTAMSIIFLLTDVSGLEVFHTWISIPFCFLYITNLSGNSLILFAIVTQPSLHEPMYYFLSMLPTTDLGLSISTLVTMLGIFWFDAREISFNACLSQMFFIQLYIVMESSVLLAMAFDRFVAISNPLRYASILTELKIAQIGIAIITRGH

SEQ ID NO: 3265 - DNA, 945 bp, Felis catus
ttaaatatgagttcccttggaacataccagtttgagcacagatttttgaatctgctttgttttcacactataaatgatgggattcattacagggggaatgagcaagtaaatattagcaatcagtgtgggcacatatggtggagaatgttttccaaatctgtgaacaaaagacaggctgattaaagggatgtagaatatggccacagccgtgatatgagaaatgcaggtgctgaaggcctttttcctctcctctggggatgcaatgttgagaactgagcaaattatcaggacataggaaatcaggataaaaatagagtccactccagcagtagagataattgcagtgagtccaaacgcactgttgatctttgtgtctgaacacgagagcttcattacatcaggatggaaacagtaggaatgatggagcacatgactgcggcagaacgatagacgcttgagaagaaggactagtggtatcagaatgacagttcccctggtaacgactgccaaaccaatctgtgcaatcctttcatgagttagaatggtagcgtatctcaaggggttggaaatggccacaaaacgatcaaaagccatagccaggagcactgaagattccatgaaagtgaagaggtgaatgaagaacatctgtgataagcaggcattaaagctgatctccctggcattgagccagaatattcctagtactgtcaccagtgtagagatgcataagccaatgtcagtggtggacaacatggagaggaaatagtacatgggctcatggaggcttggctcagtgaggactacgaacaggatcagggtattcccagaaagagcagttaaatagaggcagcagaaggggatggaaatccaggcatgggcccattcaagtccaggcaccccagtcaagaggaaagtagggaaagtagaattatggaaaactggcat

SEQ ID NO: 3266 - protein, 314 aa, Felis catus
MPVFHNSTFPTFLLTGVPGLEWAHAWISIPFCCLYLTALSGNTLILFVVLTEPSLHEPMYYFLSMLSTTDIGLCISTLVTVLGIFWLNAREISFNACLSQMFFIHLFTFMESSVLLAMAFDRFVAISNPLRYATILTHERIAQIGLAVVTRGTVILIPLVLLLKRLSFCRSHVLHHSYCFHPDVMKLSCSDTKINSAFGLTAIISTAGVDSIFILISYVLIICSVLNIASPEERKKAFSTCISHITAVAIFYIPLISLSFVHRFGKHSPPYVPTLIANIYLLIPPVMNPIIYSVKTKQIQKSVLKLVCSKGTHI

SEQ ID NO: 3267 - DNA, 965 bp, Felis catus
tctgtttgttttgcaaggagaagactgagtatagctttgcgaatctgttttgtttttacactatagatgatggggttgagcactggaggaaaaagcaggtatatattagccatcatcgaatggaccactttgggggctgatggaccatagcgatgcaccaaggataggctcatcatggggatgtagaaaatagcgaccgctccaatgtgggacacacaagtgctgaagaccttatggcgttcttcaggggaggcaatacggaccacacagcgaatgatcaagatatatgacaggataatgcatggtgtatctactcctgtggtcaggatgagatcaattaatccacagatgctgttggcctgagtatctgaacatgctaatttaatcacatctgggtggtagcagtaggagtgggaaaggacattttctctacagaaatagagaggcttaaggagcaaaagtagtggtactattaatactacactacgtataatcattaacaagctcatctgaattattctggaattagtgagaatagtagtatacctcagaggatcacagatggccacatagcggtcaaaagccatagccaccagcaccccagattctatgaatgtaaatccatgaagaaaaaacatctggataatgcaggtatctagattgacttctgttgcatcaaaccagaggatacctaatgttgttgacattgtagaaatggccaaccccaagtcagcagttgaaagcatagagaggaaatagtacatgggttcatggagactctgctgggtgatgatgacaaacaggatcatgctgttcccagagagggcaatggcatagagacagcagaaggggatagaaatccacgcatggacagactctaggccaggaattccagtcaataagaaggttggaaatttagatgtcaagttacttaagatctgcatgttttcctggattcatagcat

SEQ ID NO: 3268 - protein, 315 aa, Felis catus
  MOD_RES (315)..(315): Any amino acid
MQILSNLTSKFPTFLLTGIPGLESVHAWISIPFCCLYAIALSGNSMILFVIITQQSLHEPMYYFLSMLSTADLGLAISTMSTTLGILWFDATEVNLDTCIIQMFFLHGFTFIESGVLVAMAFDRYVAICDPLRYTTILTNSRIIQMSLLMIIRSVVLIVPLLLLLKPLYFCRENVLSHSYCYHPDVIKLACSDTQANSICGLIDLILTTGVDTPCIILSYILIIRCVVRIASPEERHKVFSTCVSHIGAVAIFYIPMMSLSLVHRYGPSAPKVVHSMMANIYLLFPPVLNPIIYSVKTKQIRKAILSLLLAKQTX

SEQ ID NO: 3269 - DNA, 973 bp, Felis catus
ggttggctatgttgccatgacccttggctcagggatcttttccacaaaatccttgaataaccctgttcctgatctgcttggttctaactccatagatgatggggttgagcatgggaggaaccaggagatagagattggcaaacatgatatgtactgctcggggcacatgatgtccaaagcggtgggtgagaaaagtgaagagggcagggatatataaagccaagatgacacagatatgggatgcacatgtgccaaaagccttgagctgggcttgaccagaaggcaaccccagaacagttctcaaaatcatcacataggagacactgatgacaatcatatcaaagccaaccacagagaaggccacaaagagcccatatgcacgatttactctagtgtctgcacacaccagctttagcacagccatgtgttcacagtatggctggggaatgatctggttggggcagaagggcatcctggagaccataatgcagaaggggctcaccaaaagcaatgctctcatcatcacagctgctcccaatttacccactacagctggggtcaggacacttgagtgacggagtgggaagcagatggccacataacggtccaaggccatagccatgagtaccccagactccacagaggaaaaggcatggatgaagaacacctggatgaggcaggcatggtattgagtctcatgagcatgaaaccagagtatagccagcattttaggttgggtggaagacgagaggaccaggtcagtgatagccagcatggctagaaagaggtacatgggctcatgcagagtgtggtcaattcggattatatggaggacagtggtattgccaattatagccacaacatacatggcacagagaggaaaggcaatccaaaattgggaattctcgagtcctgggatcccaagtaggatgaaggacacaggataagatgagtggttccctgaagccaacat

SEQ ID NO: 3270 - protein, 314 aa, Felis catus
MLASGNHSSYPVSFILLGIPGLENSQFWIAFPLCAMYVVAIIGNTTVLHIIRIDHTLHEPMYLFLAMLAITDLVLSSSTQPKMLAILWFHAHETQYHACLIQVFFIHAFSSVESGVLMAMALDRYVAICFPLRHSSVLTPAVVGKLGAAVMMRALLLVSPFCIMVSRMPFCPNQIIPQPYCEHMAVLKLVCADTRVNRAYGLFVAFSVVGFDMIVISVSYVMILRTVLGLPSGQAQLKAFGTCASHICVILALYIPALFTFLTHRFGHHVPRAVHIMFANLYLLVPPMLNPIIYGVRTKQIRNRVIQGFCGKDP

SEQ ID NO: 3271 - DNA, 721 bp, Felis catus
gcttatccctgtgcacacttcctactacccttggtgttttctggtttgaagctcgcgaaatcaccttaaatgcctgcattgcccagatgttctttctccatggatttactttcatggagtctggggttctattggccatggcctttgaccgttttgtagccatctgtgatccactgagatatgccaccatcctcaccaatgccaggattgcccagattgggataagcatgttgataaggaacgttgctgtaatgttaccagtggtgctctttgtcaagaggctgtccttctgccgtgctgtggccctctcacattcttactgctaccacgtcgatctcattcaactctcatgcacagacaacagaatcaacagcatccttggtctgtttgcactttttccacgacggggtttgattgtccttgcatcttgatctcctatgtcctgatcattcgatctgttctcaacattgcctcctctgaggggcggcaaaaagccttcaacacctgcatatcccacatcagcgctgttgccatcttctacatccctctcatcagcttgtctcttgtccatcgctatggccattcagcacctctgtttgtccacaccatcatggccaatgtcttccttctcatccctcctgtgctcaaccctatcatctacagtgtgaagactaagcagattcgaaaggctattgtcaaggtcttaattcagaagcaacaa

SEQ ID NO: 3272 - protein, 142 aa, Felis catus
LSLCTLPTTLGVFWFEAREITLNACIAQMFFLHGFTFMESGVLLAMAFDRFVAICDPLRYATILTNARIAQIGISMLIRNVAVMLPVVLFVKRLSFCRAVALSHSYCYHVDLIQLSCTDNRINSILGLFALFPRRGLIVLAS

SEQ ID NO: 3273 - DNA, 960 bp, Felis catus
atgaaagacctatttgtgatgttttctcttaatacctcggaagttgaaatctccaccttcctgttggttgggatcccagggtttgagagtgtacacatttggatctccatccccatctgctttatgtacctcctggccatcctgggcaactgcacccccctgtttgtcatcaggacagagtcttccctgcatgagcctatgtactatttcctctccatgctggccctatctgacctgggcttgtctttctcttctcttccctctatgctgaggatcttcttgttcaatgccatggagatttctgctgatgcatgtattgcccaggaatttttcatccatggattcacaggcatggaatcctcaatgctcttgatcatgtcctttgattgctttccagccatttgcaaccctctgaggtataattccattcttaccagctccagaattttgcatcgtggactgatatttgatattaaaagcattctactagttcttcctcttcctttcactttaaatagactcagatactgtaataaacacctgctctcacactcctactgtctccaccaggatgtcatgaaactggcctgctctgacaatagggttaacttttactatggtctgtttgtcgcactctgcatgatgtcagacagtgttttcattgctgtttcctatgtgttcaacctgaagactgtattgggtattgcatcccatggggagcaacttaaagctcttaatacctgtgtgtcccacatctgtgctgtgctcatcttctttgtgcccatcatcaccttggctaccatacatcactttgccaagcataaatcccctttggctatgattctgatagctgatgcattcttgttggtaccatctttgatgaatcccattgtgtattgtgtaaaaagttggcagattagagtaaaagtcctggaaaaactgagtctaaagtctaaatga

SEQ ID NO: 3274 - protein, 319 aa, Felis catus
MKDLFVMFSLNTSEVEISTFLLVGIPGFESVHIWISIPICFMYLLAILGNCTPLFVIRTESSLHEPMYYFLSMLALSDLGLSFSSLPSMLRIFLFNAMEISADACIAQEFFIHGFTGMESSMLLIMSFDCFPAICNPLRYNSILTSSRILHRGLIFDIKSILLVLPLPFTLNRLRYCNKHLLSHSYCLHQDVMKLACSDNRVNFYYGLFVALCMMSDSVFIAVSYVFNLKTVLGIASHGEQLKALNTCVSHICAVLIFFVPIITLATIHHFAKHKSPLAMILIADAFLLVPSLMNPIVYCVKSWQIRVKVLEKLSLKSK

SEQ ID NO: 3275 - DNA, 969 bp, Felis catus
tcattgagcacaacccaccttcctgggctgtagtctcttgactattctctctctaatctccttcatcttgacactgtagagaataggatttatcaatggaggaaacaggaagtggacataggagagaagagtatgggcaggctgaggtattggcactctaagatggtcaatgagggcaagaaggatcatgggcatgtagaagaggagcacagcagagaggtgggcagcacaggtttggccagccttccagcgatcctcactggatcccaaaccttgcaagactctgccaattaagccataggagaaaaaaataagcagagggtctaatcccataactgacagaaccacaaagaggctatagattgcaccccaagctccagggcaggccaaatgggctatatctgggtgcaagcagtaagaatgggtcaggacctgtgggaggcagtagggcatgtgggccaggaggaatggcaggggcagatggagacccaggcatcggaaagcaatagccaggcaaatcttgctaatgacatcattggtgaggagcgttgggtagtggagagggcggcagatggctagtgctcgatctaaggccatggcgagcaacacagaggactccatgacagaaaagatgtggacaaagaacatctgtaggaggcaagccgaagcagggacagcatgaacgccagcaaaggcaagacccagcagggtgggcatcagggctgtggccaagccaacatcagacacgctaagcaagaagaggaagaagtacattggacggtgcagggtggaatccaaggcaatgatccagagaatagtaccgttgcccagggcagagagaaggtacattgtgatgagtggtattgtccaccaggagggtgcagctgacagacctggcatgcccaccaacaagaaggtgggggccattgaagtgttattgggggctgcctgattggggaatgttgacat

SEQ ID NO: 3276 - protein, 322 aa, Felis catus
MSTFPNQAAPNNTSMAPTFLLVGMPGLSAAPSWWTIPLITMYLLSALGNGTILWIIALDSTLHRPMYFFLFLLSVSDVGLATALMPTLLGLAFAGVHAVPASACLLQMFFVHIFSVMESSVLLAMALDRALAICRPLHYPTLLTNDVISKICLAIAFRCLGLHLPLPFLLAHMPYCLPQVLTHSYCLHPDIAHLACPGAWGAIYSLFVVLSVMGLDPLLIFFSYGLIGRVLQGLGSSEDRWKAGQTCAAHLSAVLLFYMPMILLALIDHLRVPIPQPAHTLLSYVHFLFPPLINPILYSVKMKEIRERIVKRLQPRKVGCAQ

SEQ ID NO: 3277 - DNA, 957 bp, Felis catus
atggcagataataaccactctcacttccaacacccttactttgtcttaacgggaattccagggcttgaacaaaagtattactggatagcattcccactgggtgctatatatgtcattgccctctttggcaatggtgttatcatctctaccatcaagtctgaatcatccctgcatatccccatgtactattttctctgcatgttggcactggcagacatgggacttaccctctgtactctgccctctatgctaggcatattctggtttaactataagtccattgcctttgattcctgccttgttcagatgtacttcattcacaccttctcagccattgaatctggtgtactggtggccatggcctttgatcgggttgtagccatctggaaccccctcaggtatgggaccatcataaccaatggtgtggtctgcagagctgggacagtcatcttgacaagggcagtctgtgtggtcttccctgtgcctttcctcatcaagcgacttcccttctaccactccaacatcctctcccactccttctgccttcaccaagatgtcatgcgccttgcctgtgccagcactcgtatcaacagtctctatggccttattgctgtcatcttcaccaagggttctgactccctctctatcctcctctcctatgtgttcatactccgagcggtaatggccattgcctcaggggagggctggctgaaagcactcaacacctgtgtttcacatatctgtgctgtactcatcttctatgttccactcattgggctgtctgtcatccatcgttttggaaagcatctttcaccactgactcatgtcctcatggctaatgcctaccttcttgtaccccctgtgctaaaccctatagtctataccgtgaagaccaaggagatgagaaagaaaataattcaaatatttgttcaaaccaagatcactgcagagggttag

SEQ ID NO: 3278 - protein, 318 aa, Felis catus
MADNNHSHFQHPYFVLTGIPGLEQKYYWIAFPLGAIYVIALFGNGVIISTIKSESSLHIPMYYFLCMLALADMGLTLCTLPSMLGIFWFNYKSIAFDSCLVQMYFIHTFSAIESGVLVAMAFDRVVAIWNPLRYGTIITNGVVCRAGTVILTRAVCVVFPVPFLIKRLPFYHSNILSHSFCLHQDVMRLACASTRINSLYGLIAVIFTKGSDSLSILLSYVFILRAVMAIASGEGWLKALNTCVSHICAVLIFYVPLIGLSVIHRFGKHLSPLTHVLMANAYLLVPPVLNPIVYTVKTKEMRKKIIQIFVQTKITAEG

SEQ ID NO: 3279 - DNA, 954 bp, Felis catus
ctaggccctgtcttttctcccctggaacatgtgtaagatccgccttcgtatctgcttagtcttcacactatagacaatggggtttagtacaggggggagtaacagatagatattggccatgagtgtgtgtactactggtgatagatgcttcccaaatctgtggatcatggtgacaccaatgagaggaacatagaagaggagcacagcacagatgtgagaaaggcaggtgttgagggctttgaccctttcagttctggaagcaatgcccagcacagtcttcaggatgagcatgtaagaaaagagaatgatgagagcatccagccccaatgtgaagatgactatgatgaggccatagagactgttgatgcgggtgctggcacaggctagccgcattgcatcttggtggagacaatatgaatgagacaagacgttggaacggcaaaaaggtagccgctttataaggaatggcacaggcaaaaccacacagactgcccggatgaggacagctattccgatctttccaatgatgtcatgggtgaggatggaagcatagcgtaatgggtctcggatggccacaaaacggtcaaaggccatggacactaatactcctgattctaccactccaaatccatggatgaaaaacatctgtgtaatgcatgcatcaaagggaatctcagggacattaaaccagaagatgctgagcatggagggcgaggtggacatggagagactaacatcggtgacagccaagatagagaggaagtagtacataggctcatggagactctcatctaccttgatgacagctaagatggttccatttcccaggagagttagtgtgtagagaaatcccaagggaaaggccatccatgggtttttatctgacatcccagggatacctgtcaaaatgaaactgtggtggttggcatgtgatgcagttgaattcattgtcat

SEQ ID NO: 3280 - protein, 317 aa, Felis catus
MTMNSTASHANHHSFILTGIPGMSDKNPWMAFPLGFLYTLTLLGNGTILAVIKVDESLHEPMYYFLSILAVTDVSLSMSTSPSMLSIFWFNVPEIPFDACITQMFFIHGFGVVESGVLVSMAFDRFVAIRDPLRYASILTHDIIGKIGIAVLIRAVCVVLPVPFLIKRLPFCRSNVLSHSYCLHQDAMRLACASTRINSLYGLIIVIFTLGLDALIILFSYMLILKTVLGIASRTERVKALNTCLSHICAVLLFYVPLIGVTMIHRFGKHLSPVVHTLMANIYLLLPPVLNPIVYSVKTKQIRRRILHMFQGRKDRA

SEQ ID NO: 3281 - DNA, 951 bp, Felis catus
atgtcactgttcaaccaaactattcataaccatcagacctttaccctgattgggattccaggaatgccagagaaagacttctggatggccttgcccctctgccttctttacagtaccacattcctaggtaatttcattatccttgttgtcataaaggttgagcgaagtctccatgaacccatgtattattttctggctatgctagctgccactgaccttagcctttcattatcttccatgcccaccatgataagtgttcacttgtttgactggcgctcagtaacccttgatgtctgcatcactcagatgttctttatccacaactttggaggagtggaatcaggtgttctggtcgccatggcctttgatcgctttgtggctattcgcttccctttgcgctatgccaccattctcactcatggagtcatcatcaaaattggagcagcagtcctgctacggagtgtgagtgtagtgctccctgtgcctttcctcatcaaaaggctacctttctgccactccaatgtcctttcccacgcatactgcctccatcaggatgccatgaggcttgcctgtgctgacacccgtgtcaatagcatctatggtctgctggctgtgatcttcatcattgtactagatgccttgatccttttgatttcttactttctaatcctccatgcagtactgggcattgcttccagagaagagagacttaaggctcttaatacctgcttctctcatatctgtgcagtactgctcttctatgtgcctctcattggcatgactctgattcaccgctttgggaagcatttgtcaccagtaatacccacacttatggccaatatctacctgctgctccctcctctgctcaatcctgttgtgtacagtgttaggaccaagcagatccggcagcggattgtccgagcattctgtgggaacaggattggccattaa

SEQ ID NO: 3282 - protein, 316 aa, Felis catus
MSLFNQTIHNHQTFTLIGIPGMPEKDFWMALPLCLLYSTTFLGNFIILVVIKVERSLHEPMYYFLAMLAATDLSLSLSSMPTMISVHLFDWRSVTLDVCITQMFFIHNFGGVESGVLVAMAFDRFVAIRFPLRYATILTHGVIIKIGAAVLLRSVSVVLPVPFLIKRLPFCHSNVLSHAYCLHQDAMRLACADTRVNSIYGLLAVIFIIVLDALILLISYFLILHAVLGIASREERLKALNTCFSHICAVLLFYVPLIGMTLIHRFGKHLSPVIPTLMANIYLLLPPLLNPVVYSVRTKQIRQRIVRAFCGNRIGH

SEQ ID NO: 3283 - DNA, 978 bp, Felis catus
attttcaataatactacatcatcttcctcaaacttcctactcactgcatttcctggtctggaacttgcacatgtctggatctctattcctgtctgctgtctctatgccattgccctcttgggaaacagcacgattctgctcgtcatcattgttgagaggagtcttcacaagcccatgtactatttcctcgccatgctgtcagctgttgatctatgtctgaccatctcaacccttcccactgttcttggggttctctggtttcatgcccgggagattagcttgaaagcttgcctcattcaaatgttctttgtacatggcttctccttcctggagtcttcagtgctggtagccatggcctttgaccgcctcatggctatctgtaacccactgaagtatgctattgtcttcacagacatgataatcttggtgattggactggtcatctgcatacggcaagtaattttaatctttcccatgattctagccttgacgagagtatcttttcacggaggccaagagctttcccacccattttgctaccatccagacatgattaaatacacatattccaacccctggatcagcaattttttgggcatgtttcttcagctctacctgactggcactgacttactgttcattcttttctcctacgttctgattctccgaaccgtcttgagtatcgtggcccctaagaaacaacaaaaagctctcagcacttgtgtctgtcacatctgtgctgtcactgttttctatgtgccaatgatcagcctgtcctttacacaccgccttttcagctccaccccaaaagtggtctgtagcattttggccaatgtttatttgttcttaccacctgtactgaaccctgtcatttacagcttgaagaccaagaccatccgacaggctatgctccagctgctccactttaagggctcacagggccccagtgtgaggagtcatagaggaccctggggttga

SEQ ID NO: 3284 - protein, 325 aa, Felis catus
IFNNTTSSSSNFLLTAFPGLELAHVWISIPVCCLYAIALLGNSTILLVIIVERSLHKPMYYFLAMLSAVDLCLTISTLPTVLGVLWFHAREISLKACLIQMFFVHGFSFLESSVLVAMAFDRLMAICNPLKYAIVFTDMIILVIGLVICIRQVILIFPMILALTRVSFHGGQELSHPFCYHPDMIKYTYSNPWISNFLGMFLQLYLTGTDLLFILFSYVLILRTVLSIVAPKKQQKALSTCVCHICAVTVFYVPMISLSFTHRLFSSTPKVVCSILANVYLFLPPVLNPVIYSLKTKTIRQAMLQLLHFKGSQGPSVRSHRGPWG

SEQ ID NO: 3285 - DNA, 926 bp, Felis catus
ttattttagacataatttcccccaaaccttctcacgaatttgctgcgtcttcacacagtatacaatgggattcaccagaggtggtactagtaagaaaacgtccgcaatgaggatcatggccactggggacttgtgcttgccaaaacggtgcatggaggccaaagcaatgatgggcacatagaagatgagcacagcacagatgtgggagacacaggtgttgagagccttgagccgctccttatgggatccaattcccatcactgtcttcaggatgaatatgtaggacacaacaatgaacacactgtctgacatcatacagagggcaacaaagaaaccatagaaaaagttgactgtgttgtcagagcaggccagcttcatgacatcctggtgtagacaataagagtgagaaagtaggcttttcctacaatatgtcaattttttgagagtgaaagggaatgggaggactaagagcatgcttttaattagaaacaccaggcccattttggcaactctggcattggtgaggatagagctatatctcagagggtgacgtatggccaaaaagcggtcaaaagacatggccaggagcactgaggactccatatctgtaaatccgtggataaagaattcttgagcaaagcaggcatttggggaaattcctgtagcattgaaaacaaatatcctcagcatagtggggagggatgagagggagaggcccaagtcagagacagccaacccagaaaggaaatagtacatgggtgcatggagtgaggactctgtcctgatcacaaagaggatggtgcagttgccaaagatggccaccaggtacatgaagcagatggggacagagatccaagcatgaatatgttccagtcctgggattccaatcaggaagaaggtggtgatctcaatgttagaggaattga

SEQ ID NO: 3286 - protein, 307 aa, Felis catus
NSSNIEITTFFLIGIPGLEHIHAWISVPICFMYLVAIFGNCTILFVIRTESSLHAPMYYFLSGLAVSDLGLSLSSLPTMLRIFVFNATGISPNACFAQEFFIHGFTDMESSVLLAMSFDRFLAIRHPLRYSSILTNARVAKMGLVFLIKSMLLVLPFPFTLKKLTYCRKSLLSHSYCLHQDVMKLACSDNTVNFFYGFFVALCMMSDSVFIVVSYIFILKTVMGIGSHKERLKALNTCVSHICAVLIFYVPIIALASMHRFGKHKSPVAMILIADVFLLVPPLVNPIVYCVKTQQIREKVWGKLCLK

SEQ ID NO: 3287 - DNA, 938 bp, Felis catus
caacaaaaggcatgggccacacgatctcggatctgtttggtcttcacactatagactatggggttcatcaggggaggggctagaaggtacacaaagcccatgatcacttggacaagatgaggtgccttgttcccaaaccggtggatgatggacaaaccaatcatgggagtgtagaagaggagcacagcacatatatgggaaacacacgtgttgagagctttgaatctctcagccctggatgcaatagacagcacagtacgcaggatcagggcataggagaagagaatgagcagtgagtctacacccactgttgaaacaatgacaaacatgccatagatgctgttggctttgatgtctgcacaggccaatttcattacttcttgatggagacaataggaatgtgagagaagtgcagagccacaataggagaatcttttgagcataaaaggcaatgggaaaatgagtgctacactgcgacccagggaaaccaggccaatcctgccaatgactgtgttggtgagaatggaagcatagtgcaaggggcgacaaatggccacaaagcggtcaaaggccatagacagcagcacagaggactctaggaaggacaaacagtgaatgaaaaagagctgggcaaaacaggcatcgtgaccaatatctcgcgccccaatccaaaagatgcctagcactgtagggagggtgcaaagagacagacccaggtcagtcacagccagcatggacaggaagaggtacataggctcatggagtgagggctctgttttaatgataaaaaggatagtacagttgcccaggatggaaaccaggtaaatgaagcacaatgggatggagatccagatgtgcatgtgctccagcccaggaatgccactcagcagaaaggtggaggaaatgttgctgctgctttccaagggtcccaaagacat

SEQ ID NO: 3288 - protein, 313 aa, Felis catus
  MOD_RES (313)..(313): Any amino acid
MSLGPLESSSNISSTFLLSGIPGLEHMHIWISIPLCFIYLVSILGNCTILFIIKTEPSLHEPMYLFLSMLAVTDLGLSLCTLPTVLGIFWIGARDIGHDACFAQLFFIHCLSFLESSVLLSMAFDRFVAICRPLHYASILTNTVIGRIGLVSLGRSVALIFPLPFMLKRFSYCGSALLSHSYCLHQEVMKLACADIKANSIYGMFVIVSTVGVDSLLILFSYALILRTVLSIASRAERFKALNTCVSHICAVLLFYTPMIGLSIIHRFGNKAPHLVQVIMGFVYLLAPPLMNPIVYSVKTKQIRDRVAHAFCX

SEQ ID NO: 3289 - DNA, 960 bp, Felis catus
ctatcgaaaacacttaagggattttacaatctcaagcttcttagcaatgcggatacggatttgcttggtcttcatactgtagacaatggggttcatgagaggtgggaccagcagatacacataagacatgaggaggtgtacaatacggggcagatgttcaccaaagcggtgcacgagagacaagccaatcatggggatgtagaagagtagcacagcacagatatgagagacgcaggtgttgagggcctgaagtcgctcctggcgggaggcaatgcttagcacagtgcggaggatgagggcataggagaggaagatgagcagtgaatccacaccaacagtgaaggccacaacaaagagcccatatatgtgattgacaatgatgctagagcaggccaacttcatgatctctaggtgcagacaataggcatgggccagcacatgggagccgcagtactggaagcgtttaaggaggaatggcaggggcaggatgagcagggcacttctaagaattgagctcagccccatcttgatgatacgtgcaggtgtcaagaccatggagtaacgcaatggattgcaaatggccacatagcggtcaatggacatggacagtagaactgaagactctaccagtgacaaggtatggatgaagaagagctgagtgaagcaggcggggatggtaatctctctgacatcaaaccagaagatgcccaacacagtgggcagtgtagataggcaaaggcccaagtctgtcagggccagcatggccaagaaatagtacatgggttcatggagggtgacgtcggtatggatgatgtggaggatggtaaggtttcctacaataactgtcaagtagatggagcagaagggaatagagatccagccatggagagcttccagaccttggaagcctgttaggaagaaagtggctctttggaggctgccattataaaatattgtcat

SEQ ID NO: 3290 - protein, 319 aa, Felis catus
MTIFYNGSLQRATFFLTGFQGLEALHGWISIPFCSIYLTVIVGNLTILHIIHTDVTLHEPMYYFLAMLALTDLGLCLSTLPTVLGIFWFDVREITIPACFTQLFFIHTLSLVESSVLLSMSIDRYVAICNPLRYSMVLTPARIIKMGLSSILRSALLILPLPFLLKRFQYCGSHVLAHAYCLHLEIMKLACSSIIVNHIYGLFVVAFTVGVDSLLIFLSYALILRTVLSIASRQERLQALNTCVSHICAVLLFYIPMIGLSLVHRFGEHLPRIVHLLMSYVYLLVPPLMNPIVYSMKTKQIRIRIAKKLEIVKSLKCFR

SEQ ID NO: 3291 - DNA, 942 bp, Felis catus
ttacatctgcttctgacataattttgctacaactcttactctaatctgtctcgttttcacacagtacacaatgggattcatcattggaggcacaagtaaaagaacatttgccatgagaacattgaagagaggggagacatgtcggacaaaccgatggacaatggaaaggttaatgatgggcagatagaagatgatcactgcacagatgtgtgaaacacaagtattgagggccttgagctgctcctttcgggatgcaattcccagcacagtcttgaggatcaggaagtaagacacagcaataagcataaagtctaccataacccacagtactccaaaaaagccatatatgacatcaattcggttgtcagagcaggccaacttcatgacatcctggtggagacagtaggaatgggataattggcttttattacaatatttcaaacttctcaaagtgaaggggaagggtagcactaggaggacactcttaagggatatcactattcctattttgacaactctgataggagtaagaatggatctgtatctcagagggctgtggatggctaggaagcggtcaaacgacatgatcaagagcactgaagattccactgctgcaaatccatggatgaagaattcttgggcaaagcaggcattggcagaaatttcaggggcattgaataagaagatcctccacatggtgggtagagaagagaaggacaggcccatgtcagacatggctaacatggaaaggaagtagtacatgggctcatgcaaagagggctctgtcttgatgaccaaaaggatggtgcagtttcccagaatagcaaaaatatacatgctacatatggggatagagatccagatgtgtgcatattccagccctggcatcccaaccaagaagaaggtggtgatttcaacatctgatgtattaataatggacat

SEQ ID NO: 3292 - protein, 313 aa, Felis catus
MSIINTSDVEITTFFLVGMPGLEYAHIWISIPICSMYIFAILGNCTILLVIKTEPSLHEPMYYFLSMLAMSDMGLSFSSLPTMWRIFLFNAPEISANACFAQEFFIHGFAAVESSVLLIMSFDRFLAIHSPLRYRSILTPIRVVKIGIVISLKSVLLVLPFPFTLRSLKYCNKSQLSHSYCLHQDVMKLACSDNRIDVIYGFFGVLWVMVDFMLIAVSYFLILKTVLGIASRKEQLKALNTCVSHICAVIIFYLPIINLSIVHRFVRHVSPLFNVLMANVLLLVPPMMNPIVYCVKTRQIRVRVVAKLCQKQM

SEQ ID NO: 3293 - DNA, 930 bp, Felis catus
tcaaccttgttatcacatagttttgccaggatccgatttctaatctgctgactcatcactgagtacacaatgggattcattagagggtaccagaaggaaaatatcagctataatggccctaatgactggggaaacattttttggcaaagcgatgaagggcggccaaggcacatagaagatgaacacagcacagatgtgggagatgcaggtgttgagaaccttgaggcggcccttgtgtgaggcaatgcctagaataagtttcaagatcaacatgtaagacacagaaatgcaccccaagtacaataaggatgtaagagccacaaagagtccatagataacattgaccctgttgtcagaacaggccagcttcatgacattcaggtggaggcagtaggagtgggatagaaggcttttcctacagaatttcagcctctttagaataaaggggaaagggaggacaaacatgatacataatgcagcaaatatgaggccgattttaaagactctggcactggtcaggatggaggtgtatctcagagagctgtagatggctatgaagtgatctatggacatgatgagaagaactgatgactctatagctgagaatccatgaatgaaaaactcttgggcaaagcagcccttgggggaaattccagtggcattgaacaagaagattctcagcatggttggaagggaggagatggaaagtcccaggtcagaaaaggccagcatggagagaaaataatacattggggcatgcagagaggtctctgtttttatgaaaaagaggacagtgcagttccccaggatggcaaggaggtacatgaggcaaatggggatcaagacccaaatgtgagcatgctccatgcctgggatcccaatgaggaagaaggtagagatttccatttcagaggtgttcaagactgacat

SEQ ID NO: 3294 - protein, 296 aa, Felis catus
MSVLNTSEMEISTFFLIGIPGMEHAHIWVLIPICLMYLLAILGNCTVLFFIKTETSLHAPMYYFLSMLAFSDLGLSISSLPTMLRIFLFNATGISPKGCFAQEFFIHGFSAIESSVLLIMSIDHFIAIYSSLRYTSILTSARVFKIGLIFAALCIMFVLPFPFILKRLKFCRKSLLSHSYCLHLNVMKLACSDNRVNVIYGLFVALTSLLYLGCISVSYMLILKLILGIASHKGRLKVLNTCISHICAVFIFYVPWPPFIALPKNVSPVIRAIIADIFLLVPSNESHCVLSDESAD

SEQ ID NO: 3295 - DNA, 659 bp, Felis catus
ctgacacagcttccctaaaaccatatttcttatctgttggctcttcacacagtatacaatgggattcatcaatggaggtaccaacaggaaaacatcagccatgaagatcctaactattggggagctgtgtttggcaaaccggtagataacagttagagagaaaatgggaacatagaagatgagcacagcacagatgtgggacacgcaggtgttgaggaccttgagcctttgtttctgtgatgctatgctcaatactgctttcagtatcatcatataggacatgaaaataaatcctaagtctagggtgcctgtgacagccacaaataagccatagatgacattgaccttgttgtcagagcaggccagcttcatgacatcctgatggaggcagtaggaatgggaaaggagggtcttcttacagtatcttagatgttttagggtcaaagggaaagggaggatcaacagaacatttttgaaagaaaaagcaagcccaattttggtgactctggcactggtcaggatggaagtgtatctcagagggttgcagatggcaataaatcgatcaaaggacatgatgagaagaactgatgattccatagctgagaatccatgaataaaaaattcttgggcaaagcaggcatcaggggaaattcctggag

SEQ ID NO: 3296 - protein, 219 aa, Felis catus
PGISPDACFAQEFFIHGFSAMESSVLLIMSFDRFIAICNPLRYTSILTSARVTKIGLAFSFKNVLLILPFPLTLKHLRYCKKTLLSHSYCLHQDVMKLACSDNKVNVIYGLFVAVTGTLDLGFIFMSYMMILKAVLSIASQKQRLKVLNTCVSHICAVLIFYVPIFSLTVIYRFAKHSSPIVRIFMADVFLLVPPLMNPIVYCVKSQQIRNMVLGKLCQ

SEQ ID NO: 3297 - DNA, 875 bp, Felis catus
acacagtatacaatgggattcatcaatggaggtaccaacaggaaaacatcagccatgaagatcctaactattggggagctgtgtttggcaaaccggtagataacagttagagagaaaatgggaacatagaagatgagcacagcacagatgtgggacacgcaggtgttgaggaccttgagcctttgtttctgtgatgctatgctcaatactgctttcagtatcatcatataggacatgaaaataaatcctaagtctagggtgcctgtgacagccacaaataagccatagatgacattgaccttgttgtcagagcaggccagcttcatgacatcctgatggaggcagtaggaatgggaaaggagggtcttcttacagtatcttagatgttttagggtcaaagggaaagggaggatcaacagaacatttttgaaagaaaaagcaagcccaattttggtgactctggcactggtcaggatggaagtgtatctcagagggttgcagatggcaataaatcgatcaaaggacatgatgagaagaactgatgattccatagctgagaatccatgaataaaaaattcttgggcaaagcaggcatcaggggaaattcctggagcattgaacaagaatatccttagcatggtagggagagatgagagggacagtcctaggtcagagagagccaacatggagagaaaatagtacatgggttcgtgcagagatggttctgtttttatgaaaaacagaatggtacagttccccaggatggcaatgaggtacatgaagcaaataggtatggagacccaaatgtgggcatgctccatccctgggatcccaatcaggaagaaggtagaaattttcagtttcagagctgttga

SEQ ID NO: 3298 - protein, 292 aa, Felis catus
STALKLKISTFFLIGIPGMEHAHIWVSIPICFMYLIAILGNCTILFFIKTEPSLHEPMYYFLSMLALSDLGLSLSSLPTMLRIFLFNAPGISPDACFAQEFFIHGFSAMESSVLLIMSFDRFIAICNPLRYTSILTSARVTKIGLAFSFKNVLLILPFPLTLKHLRYCKKTLLSHSYCLHQDVMKLACSDNKVNVIYGLFVAVTGTLDLGFIFMSYMMILKAVLSIASQKQRLKVLNTCVSHICAVLIFYVPIFSLTVIYRFAKHSSPIVRIFMADVFLLVPPLMNPIVYCV

SEQ ID NO: 3299 - DNA, 963 bp, Felis catus; identical to SEQ ID NO: 24

SEQ ID NO: 3300 - protein, 320 aa, Felis catus; identical to SEQ ID NO: 54

SEQ ID NO: 3301 - DNA, 936 bp, Felis catus
atgtctgtcttcaatagctctgccctgtaccctcgctttctcctgacaggcctctcaggccttgaaagcagatacagcttgatttccatccccatcttcttggtgtatgccacctcaattgcaggaaacatcaccatcctacttatcatcagaactgagccttccctccaccaaccaatgtactactttctatcaatgctggcacttactgacctgggcctatctactacaaccttgcctacgatgttcagcattttctggttccatgcccgggagatctcttttaatgcctgtctcgtccagatgtacttcattcatgttttctcgattattgagtcagctgtgctgttggccatggcctttgaccgctttgtagcaatccgagagcccctgcgctatgtggccattctaaccaatggtgtgatcactgggattgggttggcaattgctggaagggccttggctctggtctttccggcttcctttctcctaaagaggcttcaatatcgttctgtcaatattctctcttacccattctgcctgcaccaggaccttataaagacaactgtatccagccgtcaggtcagcagcatctatggcctcatggtggtcatctgctccatgggacttgattcagtgctccttctcctctcctatatcctcattcttggcacagtattgaatatagcctccaagacggagagggtgaaagccctcaacacctgcatctcccacatctgtgctgtgctcactttctatacaccaatgattgggctatctatgatccatcgctatgggcagaatgtgtccccaattgtccatgtgctcatggccaatgtctacttgctggtcccacccctcatgaaccccattgtctacagtgtcaagaccaagcagattcgggatagaatcctcaagaaattcaagcaacagaaa

SEQ ID NO: 3302 - protein, 312 aa, Felis catus
MSVFNSSALYPRFLLTGLSGLESRYSLISIPIFLVYATSIAGNITILLIIRTEPSLHQPMYYFLSMLALTDLGLSTTTLPTMFSIFWFHAREISFNACLVQMYFIHVFSIIESAVLLAMAFDRFVAIREPLRYVAILTNGVITGIGLAIAGRALALVFPASFLLKRLQYRSVNILSYPFCLHQDLIKTTVSSRQVSSIYGLMVVICSMGLDSVLLLLSYILILGTVLNIASKTERVKALNTCISHICAVLTFYTPMIGLSMIHRYGQNVSPIVHVLMANVYLLVPPLMNPIVYSVKTKQIRDRILKKFKQQK

SEQ ID NO: 3303 - DNA, 939 bp, Felis catus
atgttttatcccaacaggagcatttttcacccagacacattcttcctcgttggaatcccagggctggaaagagcccatgcctggatctccctgcctttctgctctgtttaccttgtggctttgctgggcaatgccaccattttgctagtcatcaagatggagcagaccctgcggagagagcccatgttctactttctggccctcctttcaactatcgatttggctctttccacaacctctatgccccgcatgctgggtatcttctggtttgatgctcatgagattaactttggggcttgtgtggcccagatgtttctgatccatgccttcactggcatggaggccgaggtcctggtagccatggcctttgaccgttatgtggcgatctgtgctccactccactataggaccatcttgacatcccgggtgctggtgggcatcagcatgtgcattgtgattcgtcctgttctgtttacacttcccatgatctatctcatctaccgcctacccttttgtcaggctcgtgtaatagctcattcctactgtgaacacatgggcattgcaaaactgtcctgtggaaacatccgtatcaatgccatctatgggctctttgtggtgtctctctttcttctgaacctgttccttattggcatctcctatgtttacatactccgagctgttttccgcctcccatcacacgatgctcggttaaaagccctaagcacgtgtggctctcacgttggggtcatctgcgttttctatatcccctcagtgttctccttcctcactcaccgatttggacacaacataccacgctacattcacattcttgttgccaacctctatttggttatcccaccttcgctcaaccccatcatttatggtgtaaggaccaaacagatacgagagcgagtgctctgtgtctttgctaaaaagtag

SEQ ID NO: 3304 - protein, 312 aa, Felis catus
MFYPNRSIFHPDTFFLVGIPGLERAHAWISLPFCSVYLVALLGNATILLVIKMEQTLRREPMFYFLALLSTIDLALSTTSMPRMLGIFWFDAHEINFGACVAQMFLIHAFTGMEAEVLVAMAFDRYVAICAPLHYRTILTSRVLVGISMCIVIRPVLFTLPMIYLIYRLPFCQARVIAHSYCEHMGIAKLSCGNIRINAIYGLFVVSLFLLNLFLIGISYVYILRAVFRLPSHDARLKALSTCGSHVGVICVFYIPSVFSFLTHRFGHNIPRYIHILVANLYLVIPPSLNPIIYGVRTKQIRERVLCVFAKK

SEQ ID NO: 3305 - DNA, 934 bp, Felis catus
gtttctttaatattattttcttcacacggtcataaatctgtttggttctgactccgtagatgacagggttgagcattggtggcactacgacataaagattggccaggagtatgtggatatagcgggggacgttatggccaaagcgatgtgtcataaaggaaaagagggctggtgtatagaaggcaagaattacacaaacatgagaaccacaagtgctgagggacttgagtcgggcttcacgggaaggaagacggaaaacggcacggagtatctgaacataagaaagggcaatggctatgatgtcaaatactagattacaaattgcacataagccataaataatattgatcttgatgctggcacaagacagacgagccagacccatgtgttcacagtaggtatggggaatgacatgattcccacagaagggcagtcgcaaaataagaaacacaaatggaatcacaaaaataaatgccctcactaacacaccaacaccaatcacagagacaatcttgttggtgaggacggtgctgtatcgaagcggatcgcagatggccacatagcggtcataagccattgccaacaagactgctgactccataagtgtgaagctgtgaatgaaaaacatctgcatgaggcaggcttcaaagatgatctctctgaggttgaaccagaagatcccgagcatcttggggatggtagctgtggacagacccaaatcaatagcagccaacatggtcaggaagtaaaacataggctggtgtaggctgctctcaacccagatcacaaataggatagtgaagttccccatgagggcaatcatgtacacagcacaaaaaggaaagccaatccagacatgcaatgtttccaaccctggaatccccagcaacaagaaggagacgaggtggaactgggtgtcattgagaaggaacat

SEQ ID NO: 3306 - protein, 312 aa, Felis catus
  MOD_RES (312)..(312): Any amino acid
MFLLNDTQFHLVSFLLLGIPGLETLHVWIGFPFCAVYMIALMGNFTILFVIWVESSLHQPMFYFLTMLAAIDLGLSTATIPKMLGIFWFNLREIIFEACLMQMFFIHSFTLMESAVLLAMAYDRYVAICDPLRYSTVLTNKIVSVIGVGVLVRAFIFVIPFVFLILRLPFCGNHVIPHTYCEHMGLARLSCASIKINIIYGLCAICNLVFDIIAIALSYVQILRAVFRLPSREARLKSLSTCGSHVCVILAFYTPALFSFMTHRFGHNVPRYIHILLANLYVVVPPMLNPVIYGVRTKQIYDRVKKIILKKX

SEQ ID NO: 3307 - DNA, 942 bp, Felis catus
atggcctcacttaataacaccctatttcatccatattctttcttccttctggggatccctgggctggaacacatgcatatctggatgggtctccctttctttgctgtgtacctgatagctgttcttgggaatatcagcatcctttctgtgattgagactgagagcaccctccaccagcccatgttctacttcctggccattctgtcatctatcgacctgggcctgtccacatccacgatccccaagatgcttggaatcttctggttcagcctgagagaaatctcctttgagggatgtctcatccagatgttcttcatccatctattcactggcatggagtcggctgtgctcgtggccatggcctatgatcgctatgtggccatctgtaaccctcttcggtacacactggtgctgacaaacaaggtggtattcatcattgcattgataattctactgaggcctttgtcttttgccataccctttgttccactcatcctacggttaccattttgtgggcaccaacttatccctcacacttattgtgagcacatgggcattgcccgcctgtcctgtgccagcatcagggtcaacatcatctatggcttatatgccatctctaacctggtgtttgacatcatagccattgtcatttcttatgcccagatccttcatgctgtctttcgactgccttcccatgatgctcggctcaaagcgctcagcacctgtggctctcacgtgtgtgtcatgttggctttctacacccctgcgtttttttcatttatgacccacaggtttggccggaatataccacgttatattcacatccttctggctaatttctatgtagtcattccaccggctctcaaccctgtaatctatggtgtcagaactaaacagattagagaacaggtgctgaaggtattttccaagaaaaaaacataa

SEQ ID NO: 3308 - protein, 313 aa, Felis catus
MASLNNTLFHPYSFFLLGIPGLEHMHIWMGLPFFAVYLIAVLGNISILSVIETESTLHQPMFYFLAILSSIDLGLSTSTIPKMLGIFWFSLREISFEGCLIQMFFIHLFTGMESAVLVAMAYDRYVAICNPLRYTLVLTNKVVFIIALIILLRPLSFAIPFVPLILRLPFCGHQLIPHTYCEHMGIARLSCASIRVNIIYGLYAISNLVFDIIAIVISYAQILHAVFRLPSHDARLKALSTCGSHVCVMLAFYTPAFFSFMTHRFGRNIPRYIHILLANFYVVIPPALNPVIYGVRTKQIREQVLKVFSKKKT

SEQ ID NO: 3309 - DNA, 952 bp, Felis catus
ttatttcacaggctttgaaaaagtgaaaaatttaagaaacctgtcccgtatcttcttggtccttaccccgtagataatagggttcaccatgggtgggaccagaagatagatgttggccacaaatatgtggacatggggagccacatggtgcccaaacctgtgggtaaggaaagagaagaaggctggagtataagacactaagatgacacagatatgggagccacaggtacccaaggtcttgaatcgggcatccttggatgggaggtggaagacagtgtgcagtatgagaacataagaacaaatgatcaatatgaagtccaggccaccagtaaggaaggcaacgatgaggctgtaggctctacggattcttgtctcagcacaggcaatcttgatgagggccatgaactcacagtaggtgtgggaaatgatattggttctgcagtagggaagccaacgtagcaggaaggggtgaggactgagaagtgctgtgccccggagtactatagctagacccatccccccaattacagcatgtgtcagaatagctgaatgtcttaatgggttacaaatggctacataacggtcaaaagccatggccagaaagaagccagattccatggtagagcaagagtgaatcaggaacacttgagtgaggcaggcttcaaagcgaatctctccatcatggaaccagaaaaggctaagaagttttggtacagctgtagtacacacaaccagatcagccacagccagcatgcagaggaagaggtacattggctcatggaggctggggtctgtcttaatgataaacagaagagagcagtttcccaggagggccaaaaggtataccacacaaaaggggatggatatccagatgtgggcagcctccaacccaggaatgccaatgaggatgaaggttgatggatggacatcagtcttattgtatgctgacata

SEQ ID NO: 3310 - protein, 316 aa, Felis catus
MSAYNKTDVHPSTFILIGIPGLEAAHIWISIPFCVVYLLALLGNCSLLFIIKTDPSLHEPMYLFLCMLAVADLVVCTTAVPKLLSLFWFHDGEIRFEACLTQVFLIHSCSTMESGFFLAMAFDRYVAICNPLRHSAILTHAVIGGMGLAIVLRGTALLSPHPFLLRWLPYCRTNIISHTYCEFMALIKIACAETRIRRAYSLIVAFLTGGLDFILIICSYVLILHTVFHLPSKDARFKTLGTCGSHICVILVSYTPAFFSFLTHRFGHHVAPHVHIFVANIYLLVPPMVNPIIYGVRTKKIRDRFLKFFTFSKPVK

SEQ ID NO: 3311 - DNA, 831 bp, Felis catus
atgtcccttcccaatgacacacagtttcatccctccttctttttgctgctggggatcccaggactggaaactgtccacatgtggattggctttcccttttgcgctgtgtacatgattgcactcataggaaacctcactattttgtttgtggtccaggttgacagcagcctacatcagcccatgttctacttcctggccatgttggctagcattgatttgggtctgtccacagctaccatccccaagatgcttgggatcttctggtttggtctcagggagataatcttcgatgcttgtctcacccagatgttttttatccacaacttcactggtatggagtcagcagtcctgttggcaatggcttatgaccgctatgtggccatatgcaacccacttcgatatagcaccattctcaccaacaaggttgtctctgtgattggtgttggtgtgttagtgaggtcatttatttctgttattccatttgtgtttcttattttgcgactgcccttctgtgggaatcatatcattccccatacctattgtgaacacatgggtctggctcgtctgtcttgtgccagcatcaagatcaatattatttatggcttatgtgcaatttgtaatctagtatttgacatcatagccattgccctttcttatgttcagatactccgtgccgttttccgtcttccttcccgtgaagcccgactcaagtccctcagcacatgtggttctcatgtttgtgtaattcttgccttgtatacaccagccctctttttcctttatgacacatcgctttggccataaacgtcccccgctatatccacatactcc

SEQ ID NO: 3312 - protein, 267 aa, Felis catus
MSLPNDTQFHPSFFLLLGIPGLETVHMWIGFPFCAVYMIALIGNLTILFVVQVDSSLHQPMFYFLAMLASIDLGLSTATIPKMLGIFWFGLREIIFDACLTQMFFIHNFTGMESAVLLAMAYDRYVAICNPLRYSTILTNKVVSVIGVGVLVRSFISVIPFVFLILRLPFCGNHIIPHTYCEHMGLARLSCASIKINIIYGLCAICNLVFDIIAIALSYVQILRAVFRLPSREARLKSLSTCGSHVCVILALYTPALFFLYDTSLWP

SEQ ID NO: 3313 - DNA, 929 bp, Felis catus
atgttccacacaaacacttccgctttccacccagacaccttttttctcacaggcatcccaggatttgagggtttccatggctggatctccctacctttttgctccatttacttaatggctctgttaggcaatgttacaattttgctgatcatctggtctgaccgtactctgcgggatcctatgttctactttctagccatcttatcagccatagatctggccctctccacatcgtcagtgccccgaatgctgggtatcttctggtttgatgcacatgaaattggttttggagcctgcgtggctcagatgttcctgatacacacctttacaggaatggagtctgctgttctgttggccatggcttttgatcgctatgtggctatctgtgtaccactccactacacaaccaccctgacaccccgggtgctagcaggcattggtgtgggcattataatgcgtcctgtcctgctcatgttgcccattctatacctaacccatcgtctgcccttttgtgagactcgaattattgcgcattcctactgtgagcacatgggcattgccaagttggcctgtgccagcattcgagttaatgccatttacgggctttttgtggcttcttttcttattttggacgtggtacttgttggaatctcttatgcctacatcctccgtgcagttttcctcctcccatctcgagatgctcgtcacaaagccttgagcacatgtgggtcacatgttggggtcatgtgtgttttctatacaccgtgtctcttctccttcctcacccaccggtttggcaagaaaattccccattatgttcacatccttgttgccaatctctacgttgtattcccacctgccctcaatcctattatctacggtgtgaggacaaagcagattcgtgagcatgtgatccatgctctcacctc

SEQ ID NO: 3314 - protein, 310 aa, Felis catus
MFHTNTSAFHPDTFFLTGIPGFEGFHGWISLPFCSIYLMALLGNVTILLIIWSDRTLRDPMFYFLAILSAIDLALSTSSVPRMLGIFWFDAHEIGFGACVAQMFLIHTFTGMESAVLLAMAFDRYVAICVPLHYTTTLTPRVLAGIGVGIIMRPVLLMLPILYLTHRLPFCETRIIAHSYCEHMGIAKLACASIRVNAIYGLFVASFLILDVVLVGISYAYILRAVFLLPSRDARHKALSTCGSHVGVMCVFYTPCLFSFLTHRFGKKIPHYVHILVANLYVVFPPALNPIIYGVRTKQIREHVIHALTS

SEQ ID NO: 3315 - DNA, 935 bp, Felis catus
atgtcctctgtcaatgacactgcttcaaatccctctgccttccttctgctgggtatacctggtctggaagctttccatatctggattgctttccctttctttgttgtttatctgatagcacttgtgggaaatgtcacaatcctggttgtgatcaagactgagcagagtcttcatcaacccatgttctaatttttggctcttctctcctttattgatctaggcctttccacttctaccattcccaagatgctatcttctggttcaacttcagggagataaaatttgaaggctgcttcatccaaatgttctttatccatacctacactggcatggaatccgttgtactgctggcatggcaactgactgccttgttgccatctgttacctactgacatataccactattctcaccaacagagtggtagccatcatggcctctgttgtagtggggaggccagtccttcttgtcatccctttctgccctcttctcaaatggttgcccttttgtggatactacattattcctcacacctactgtgaacacatgggaatcgtgcatctttcctgtgctaacataagggtcaacatcatctatggcttatataccattgctgccctgatttctgacttgatccttattgccctctcctatgttcagatcctacgagctgttttccaccttccttccagggatgccagactccaaagcacttagcacatgtggctcccatgtctgtgtcatcttagcattttacacgccagcatttttctcttttatgactcactgatttggtagtaatattccttgctacatccacatccttctggccaatctgtatgtagttgttcccccttgtttaaatccagtcatttatggaaccaggacaaagcaaattcaggactgagttgtgaaaatacttgtaaataaagaatga

SEQ ID NO: 3316 - protein, 62 aa, Felis catus
MSSVNDTASNPSAFLLLGIPGLEAFHIWIAFPFFVVYLIALVGNVTILVVIKTEQSLHQPMF

SEQ ID NO: 3317 - DNA, 947 bp, Felis catus
tcagctgattttagtcatgaataattgttgaacacattctcggatctgtctggtccttactccatagatgagagggttcagcataggtggtaccaacaagtacatgttggccagcaggatgtgggtgtggcgtggtatatgcttactaaaacggtgggtgaggaaggaaaaagagcagggatgtagaaggtgaggatgacacacacatgggacccacaagtgctgagggtcttcaacctggcatcattagaagggagattaaatacagtacgaagtatctgtacataggacagagagatgcatgtcacatcagtcccaacaattaagacaatgactgccaaactataaagactattgatggaaatgtcagcacaagccaatttcaccacagccatgtgctcacagtatgtgtgggggactacattggactggcaatatggccatctccttaccagaaatggatgtggtatcattagtactaacccacgtagaagtgccactatgccaactcgagccaccacagtatttgtaagaatggatgtgtgtctcagcggattgcagattgccacataccggtcaagtgccatggccacaagaagccctgactccaccccagagaaagcatggatgaaaaacatctgagtgagacaggcatggaagccgatttcatgataattgaaccagaacatacccaacatcttgggaagagtggaggttgacaagatgaggtctgtgatggccaacatggaaagaaaatagaacatgggttcatggagaacagtctcagttttgatgataaaaaggataagtatgtttcccatgagcgccacaatatacattgagcagaaagggatggctatccaaatatgcaaatattctaggccaggtatgcccatcaggaagaaggtactaggattggtgaatgcagtggagttaaagtcaatcat

SEQ ID NO: 3318 - protein, 289 aa, Felis catus
MIDFNSTAFTNPSTFFLMGIPGLEYLHIWIAIPFCSMYIVALMGNILILFIIKTETVLHEPMFYFLSMLAITDLILSTSTLPKMLGMFWFNYHEIGFHACLTQMFFIHAFSGVESGLLVAMALDRYVAICNPLRHTSILTNTVVARVGIVALLRGLVLMIPHPFLVRRWPYCQSNVVPHTYCEHMAVVKLACADISINSLYSLAVIVLIVGTDVTCISLSYVQILRTVFNLPSNDARLKTLSTCGSHVCVILTFYIPALFPSSPTVLVSIYHATPTSCWPTCTCWYHLC

SEQ ID NO: 3319 - DNA, 944 bp, Felis catus
tcaaacacatttgattattaagaatttaaagaatccttcccggattctcttggtttttacaccataaataatagggttcatcataggtggaataagaagatatatattggctataaaaatatggatatgtggagcgatgtggtggccaaacctatgagtgagaaaagagaaaaaggctggtgtataaaacactaagatgacccatacatgggagacacatgtacttaaggtcttgaggcgggcagctttcgaaggcagattaaagacagtgaaaagaataaggacataagaacagatgatcaatatgaaatccaatccccctgtcaggaatgccacaattaggctgtaggctctacgaatcttggtttcagtgcaaactagctttatcacagccataaactcacagtacgtatgggagatgacattcgttctgcagtaggaaagccacctcagtagaaagggatgtggactgaggagtacagctcctctaaagacaatgcccaaaccgaagcctataatcactgcaggggtcaggatagtggaatgtcttaatgggtggcaaatggctatgtagcggtcaaaagccatggccaggataaatccagattccatagtagacagagaatgaataagatacatttgagtgaggcaggcttcaaagtagatctctctgtaattgaaccagaagaggctaagtatcttgggaagtgtagaagaagtaagaatcaaatcagccactgaaagcatgcatagaaagaggtacataggttcgtgtagtttgtggtctgtcttgacaattaatagaagggcaacatttcccattagtgacacgaggtagactagacaaaaagggatagaaatccatatgtgaacagcctccaatcctggaatgccaagcagtagaaagctggtagggtgaagactggtcctgttgtaatttaaca

SEQ ID NO: 3320 - protein, 313 aa, Felis catus
LNYNRTSLHPTSFLLLGIPGLEAVHIWISIPFCLVYLVSLMGNVALLLIVKTDHKLHEPMYLFLCMLSVADLILTSSTLPKILSLFWFNYREIYFEACLTQMYLIHSLSTMESGFILAMAFDRYIAICHPLRHSTILTPAVIIGFGLGIVFRGAVLLSPHPFLLRWLSYCRTNVISHTYCEFMAVIKLVCTETKIRRAYSLIVAFLTGGLDFILIICSYVLILFTVFNLPSKAARLKTLSTCVSHVWVILVFYTPAFFSFLTHRFGHHIAPHIHIFIANIYLLIPPMMNPIIYGVKTKRIREGFFKFLIIKCV

SEQ ID NO: 3321 - DNA, 945 bp, Felis catus
tcaagcaactttgaccattaatgtcctaataacatgttcccgtattttcttggtccttactccatatacaatagggttgagaaaagggggcaccaaaaggtacatatttgcaataaatatatggacatgtgcaggcacatttttcccaaaacggtgagtgaaaatggaaaaaccagctgtggaatagaagacaagaataacacagacatgtgacccacatgtgcccagagccttaaagctagcttctcgggatggcaggcggaatacagagcgcaggatgaaggcataggatacagcaatgagaattgcatcacatgagccaatgatagaagccatactgaggctataactcttggtggcccctatgtccatacatgccagcttcaccacggccatgaactcacaataggtgtgggcaataattcgtgatctgcagtagggaagttgtttgagcaggatgggatgtggagaaaagaacgctacacccctaatcaccacaataatactcattatggtgatgcgtgcatgggtgagaatggtagtatggtgcagtggatgacaaatggccacataacggtcaaaggccatggccaggaaaaagccagattccatagcagtaaaactatgaatgaagaacatttgggctagacagacatcaaaggcaatgtcatggactccaagccagaagagacacagcatccgaggcagtgtagatgtggagaggaccaggtcagtgacggagagcatgcacaaaaagaagaacataggctcatggagactccgctctgccttcatcacggccaggatggtcacattccccaccacagccaccacgtacatggagcagaagggaatcccaatccagacatgcaggtgctctagtcctgggatgcccatcagcaagaaggtgacaggagaaggatgagaggtattgaaaggagacat

SEQ ID NO: 3322 - protein, 314 aa, Felis catus
MSPFNTSHPSPVTFLLMGIPGLEHLHVWIGIPFCSMYVVAVVGNVTILAVMKAERSLHEPMFFFLCMLSVTDLVLSTSTLPRMLCLFWLGVHDIAFDVCLAQMFFIHSFTAMESGFFLAMAFDRYVAICHPLHHTTILTHARITIMSIIVVIRGVAFFSPHPILLKQLPYCRSRIIAHTYCEFMAVVKLACMDIGATKSYSLSMASIIGSCDAILIAVSYAFILRSVFRLPSREASFKALGTCGSHVCVILVFYSTAGFSIFTHRFGKNVPAHVHIFIANMYLLVPPFLNPIVYGVRTKKIREHVIRTLMVKVA

SEQ ID NO: 3323 - DNA, 950 bp, Felis catus
atggcatccatcaatacatcatatttgacccccagaactgtaatcttgatcagaattcctggactagaacatgtgcagttttggactgggtttcccttctttgctgtgtgcatagtggctcttctgggaaatattattttactaatcatcattgctacagaacgtagcctgcatcagcccgtgtataacttcctggcagtgctggcggccactgacataggactctgcgcagccattgctcccaagatgttggccatcttctggttcagatcttgctccatggcctttgacagctgcctgacccagctgttcttcattcatgccttgcagtgcatggagtctggcattctgttggccatggcttttgaccactacattgccatctgtgatccactgagacccatccaacctcacgccttccatcctggatcagatgatagcaacagtggcgatccgagctacagtgctggttggtctgtcacccattctgatcaaaagatttcatgtttttcattccattctgattgccccactcttactgtgagcacatggccatggtcaagctagctgcagaagacatccgagtcaatataacatgtggtctcctagtaggttttacaatactgggatttgacatgatttttgtcctcatttcctatatccttattttccaggctgtttttcatctacaccaaaaggaggcacggctcaaagcatttaacacatgcacagctcatatttttgttttccttgagttttatattcttgccttcttctcctttttcagccaccgttttggacatgttgctccttctacccacatccttctttctaccatctatctccttgtgccacctgcactcaaccctattgtctatggtgtaaaacataaggtaattcgtaagcgtgtggcacagatttttcttctgagtcatggatcccaccagtga

SEQ ID NO: 3324 - protein, 188 aa, Felis catus
MASINTSYLTPRTVILIRIPGLEHVQFWTGFPFFAVCIVALLGNIILLIIIATERSLHQPVYNFLAVLAATDIGLCAAIAPKMLAIFWFRSCSMAFDSCLTQLFFIHALQCMESGILLAMAFDHYIAICDPLRPIQPHAFHPGSDDSNSGDPSYSAGWSVTHSDQKISCFSFHSDCPTLTVSTWPWSS

SEQ ID NO: 3325 - DNA, 939 bp, Felis catus
atgggatctaccaacatgtcatatctgaacccaaagactgtgaccctgattgggatccctggactagagcatgtgcagttttggatcggatttcccttccttggagtgtgcctggtggctgtgctggggaacatcttcttgttaatcatcatccttacagaacgcagtcttcaccaacccatgtacatcttcctagcagttttggcagccactgacctaggtctctgtgtagccatcgctcccaagatgttggccatcttctggtttggcttgtgctccatggcttttgatgcttgcctcactcagctcttctttatccatgccttgcagggcatggaatctggtatcctgttggccatggcctttgaccgctatgttgccatctgtgatcctttgaggcacacatccatcctcacacctctctttctagttcaaatcgtactggtggtagtagtccgggcaacggtgcttgttggaattttacccattctgcttaaacgcctgcaacttttccaatctgtggtcattgtccattcctactgtgagcacatggctgtggtcaagttggctgcagaagatgtccatattaataaatcatatgggctctttgtggcctttgcaattctaggttttgacatgatctttgtcttcatctcctacattcttatatttcaggctgtttttcgtcttccccagaaggaggcacgacgcaaagcattcaatacttgtactgcccatattgttgtcttcctggagttttatatccttgccttttttccttcttcagccaccgttttggacatgtatcaccctatgttcatatcctcttgtctaccatctatctgcttgtgccccctgcccttaaccccattgtctatggtgtgaagaccagggagatccgcatgcgagttgctcagatttgtattctgaagcctgaca

SEQ ID NO: 3326 - protein, 294 aa, Felis catus
MGSTNMSYLNPKTVTLIGIPGLEHVQFWIGFPFLGVCLVAVLGNIFLLIIILTERSLHQPMYIFLAVLAATDLGLCVAIAPKMLAIFWFGLCSMAFDACLTQLFFIHALQGMESGILLAMAFDRYVAICDPLRHTSILTPLFLVQIVLVVVVRATVLVGILPILLKRLQLFQSVVIVHSYCEHMAVVKLAAEDVHINKSYGLFVAFAILGFDMIFVFISYILIFQAVFRLPQKEARRKAFNTCTAHIVVFLEFYILAFFPSSATVLDMYHPMFISSCLPSICLCPLPLTPLSMV

SEQ ID NO: 3327 - DNA, 945 bp, Felis catus
tcagtttctatgacagcggaggatccgtagtacccgctcccgcatttgcttagtccgggctccataaatcaaggggttggccatgggaggcactaggaagtagaggttgtcaatgataatctggatatagggagccatatggtagcctaaaatctgggccaggacagagaagacaacaggagaataaaagagagctatgacacaaagatgggagccacatgtactgagagctttgccccctgcctcccaagaggggatccgaaagacagcatgaaggatcagcccataggacagaatgataaaaagcaaatcaaatcccacagatgttacaataaccatgaggccatagacaatgtggttggagatgtccccacaggctatctgtaccacagccatgtaggcacagtaggagtaagagatgatgtgggtttggaagctttccagtctttttgccaggatgggtgctggagtcagcactgccaccgcccttgtcaggacagccagagccatcttcacaagtatgttgttagcaaggatggttgtatatctcagagggtaccagatagccacaaatctgtcaaaagccatggctaggaggatcccagactccatgacataaaatgaagggatgaaaaacatctgtgcgaggcaggcattaaagctgatgtctttggcattcatccagaagatccctagcatgcggggcacagtgacactgaccagggacaggtcaacaacagacagcatggccaggaggagaaacatgggctcatgaagactcttctccacccagatgatgcataagatggcggcattcccaatcattgtaatgacaaataccaagaaaaaaggcacagagaaccagccatgggaagattccaagccaggaattccagccaggacaaatgtcaagggttgaggaatggagttgttgcaagaggacat

SEQ ID NO: 3328 - protein, 314 aa, Felis catus
MSSCNNSIPQPLTFVLAGIPGLESSHGWFSVPFFLVFVITMIGNAAILCIIWVEKSLHEPMFLLLAMLSVVDLSLVSVTVPRMLGIFWMNAKDISFNACLAQMFFIPSFYVMESGILLAMAFDRFVAIWYPLRYTTILANNILVKMALAVLTRAVAVLTPAPILAKRLESFQTHIISYSYCAYMAVVQIACGDISNHIVYGLMVIVTSVGFDLLFIILSYGLILHAVFRIPSWEAGGKALSTCGSHLCVIALFYSPVVFSVLAQILGYHMAPYIQIIIDNLYFLVPPMANPLIYGARTKQMRERVLRILRCHRN

SEQ ID NO: 3329 - DNA, 945 bp, Felis catus
tcaagtgacttttacctttagagaactaaggacatggtctcgaatttttttggttctaataccataaacaatggggttaaggaaaggtggtaccagaaggtacatattggcaataaagatatgaatttggggggccacattgtggccaaagcggtgagtgaggaaggtaaagacagctgtggagtagaaaacaaggatgacacagacatgagagccacaggttcctagagctttaaaacttgcttcctgtgatggaaggcgaaagactgcacggaggattagggcataagagacagcaatgaaaaagccatcgcaggaaccaatgacagaggctacactgaggctgtaacgtttggtagctcctgtgtccacacatgccagcttcaccacggccatgaactcacagtaggtgtgggtaatgactcgtgttctgcagtagggcagctgcctgagcaggataggatgtggggaaaagaaggccactccccggagtaccacagaaactcccattttggcaatgcgagcatgggtgagaatcgtggtatggtgcagcggatgacaaatggccacgtaacggtcaaaggccatggccaggaaaaaacctgattccatagcagtaaaactatggatgaagaacatttgagccaggcaagcatcaaaggcaatgtcacgcgctccaagccagaagagacagagcatgcgaggcagtgtagatgtggagaggaccaggtcagtgacggagagcatgcacagaaagaggaacataggctcatggagactccgctctgccctcaccacggccaggatggtcacattccccaccacagccaccatgtacatggagcagaagggaatcccaatccagatatgcaggtgctctagtcctgggatgcccatcagcaagaaggtgtctggagatgtttgagatttattggctggtcccat

SEQ ID NO: 3330 - protein, 314 aa, Felis catus
MGPANKSQTSPDTFLLMGIPGLEHLHIWIGIPFCSMYMVAVVGNVTILAVVRAERSLHEPMFLFLCMLSVTDLVLSTSTLPRMLCLFWLGARDIAFDACLAQMFFIHSFTAMESGFFLAMAFDRYVAICHPLHHTTILTHARIAKMGVSVVLRGVAFFSPHPILLRQLPYCRTRVITHTYCEFMAVVKLACVDTGATKRYSLSVASVIGSCDGFFIAVSYALILRAVFRLPSQEASFKALGTCGSHVCVILVFYSTAVFTFLTHRFGHNVAPQIHIFIANMYLLVPPFLNPIVYGIRTKKIRDHVLSSLKVKVT

SEQ ID NO: 3331 - DNA, 945 bp, Felis catus
tcagacaactttgacctttagtgctctaagaacatgctcctgtattttcttggtccttactccatacacaatggggttgagaaaagggggcaccaaaaggtacatatttgcaataaatatatggacatgtgcaggcacatttttcccaaaacggtgagtgaaaatggaaaaaccagctgtggaatagaagacaagaataacacagacatgtgatccacatgtgcccagagccttaaagctagcttctcgggatggcaggcggaatacagagcgcaggatgaaggcataggatacagcagtgagaatggcatcacatgagccaatgatagaagccacactgaggctataacgtgtggtggctcctgtgtccacacatgccagcttcaccacagccatgaactcacagtaggtgtgggcaatggttcgtgttctgcagtagggcagctgcctgagcaggatgggatgtggagaaaagaaggctacgccccgaatcaccacaataatacccatcatggtgatgcgcgcatgggtgagaatggtagtgtggtgcagtggatgacaaatggccacgtaacggtcaatggccatggccaggaaaaaacccgattccatggtggtaaagctatggatgaagaacatttgggtcaggcaagcatcaaatgtaatgtcatgggctccaagccagaaaagacaaagcatgcggggcagtgtagatgtggagaggaccaggtcagtgacggagagcatgcacaaaaagaagaacataggctcatggagactccgctctgccttcaccacggccaggatggtcacattccccaccacagccaccacatacatggagcagaagggaatcccaatccagacatgcaggtgctctagtcctgggatgcccatcagcaagaaggtgataggagagggacgagaggtgttgagaggaggcat

SEQ ID NO: 3332 - protein, 314 aa, Felis catus
MPPLNTSRPSPITFLLMGIPGLEHLHVWIGIPFCSMYVVAVVGNVTILAVVKAERSLHEPMFFFLCMLSVTDLVLSTSTLPRMLCLFWLGAHDITFDACLTQMFFIHSFTTMESGFFLAMAIDRYVAICHPLHHTTILTHARITMMGIIVVIRGVAFFSPHPILLRQLPYCRTRTIAHTYCEFMAVVKLACVDTGATTRYSLSVASIIGSCDAILTAVSYAFILRSVFRLPSREASFKALGTCGSHVCVILVFYSTAGFSIFTHRFGKNVPAHVHIFIANMYLLVPPFLNPIVYGVRTKKIQEHVLRALKVKVV

SEQ ID NO: 3333 - DNA, 951 bp, Felis catus
atggcgtccgttaatatgtcatatctagaccccacaacactgatgctaattgggatccccggactacaggacgtgcaattttggattgggttttccttctttgcaatatgcctggtggctcttctgggaaatactattttactaatcatcattcctacagaacacagcctgcatcaacccatgtacgttttcctggcagtgctggcagccactgacatagggctctgtgtagccattgctcccaagatgttggccatcttctcgtttggctcatgctccatggcttttgatgcttgcttagcccagctttttttcattcatgccttgcagggcatggaatctggcatcctgctggccatggcctttgaccgctatgttgccatctgtgatccactgaggcacgcgtccatcctcacaccatccatcctggtcactatggtgctggttgtggcaattcgggcaatggtgcttgttggcattttaccaattttaatcaaaagactacaccttttccattccactgtaattgctcactcctactgtgagcacatggctgtggtcaagctagctgcagaagacatccgagtcaataaaacatgtggtctcctcgtaggttttacaatactgggatttgacatgattttcatcttcatttcctatatccttattttccaggctgtttttcatctacaccaaaaggaggcacggctcaaagcatttaacacatgcacagctcatatttttgttttccttgagttttatattcttgctttcttctcctttttcagccaccgttttggacatgttgctccttctacccacatccttctttctaccatctatctccttgtgccacctgcactcaaccctattgtctatggtgtaaaaaataaggtaattcgtaagcgtgtggcacagatttttcttctgaatcgtcactcccagcagtaa

SEQ ID NO: 3334 - protein, 316 aa, Felis catus
MASVNMSYLDPTTLMLIGIPGLQDVQFWIGFSFFAICLVALLGNTILLIIIPTEHSLHQPMYVFLAVLAATDIGLCVAIAPKMLAIFSFGSCSMAFDACLAQLFFIHALQGMESGILLAMAFDRYVAICDPLRHASILTPSILVTMVLVVAIRAMVLVGILPILIKRLHLFHSTVIAHSYCEHMAVVKLAAEDIRVNKTCGLLVGFTILGFDMIFIFISYILIFQAVFHLHQKEARLKAFNTCTAHIFVFLEFYILAFFSFFSHRFGHVAPSTHILLSTIYLLVPPALNPIVYGVKNKVIRKRVAQIFLLNRHSQQ

SEQ ID NO: 3335 - DNA, 888 bp, Felis catus
ttggaggaatcgatctctgatcgtcttggttcttatagatcattcaccatggatggagcaaggaggtagatgctagccacaaagatgtgaatatgaggagccatatggccaccaaatctgtgagtgaggaaggagaaaaaggctggagcatagaccactaagatcacacacacatgggatccacgtgtttccaaggtcttgagcttagcacctttggatggaagatggaagacagtgtaaaggatgataacataggaacataggattaatatgaaatctaaacctccagcaaggaaggcagcagccagcctgcagattctgcagatccttgtctcttcacaaggtagcctgatcagagccataaattcacagtaagtgtgagagatgacagtagttctgcagtaaggaagccactgaggcatgaaaggttgaggactgaagagcaaaaccccatggaggacaatagctagccccaagttcttgatgactctatgtgtcaggatagcaaaatgtctcagaggatcacagattgccatatactggtcaaaggccatggccaagataaaccctgaggccatgttgcatagtgaatgaatgagaaacacttgtgtgagtgttcttcaaaatagatctccctaccatggaaccaaaaaatgctgaggatttgggcacagtgatggagatgaacaagtcagccacagagagcgtacagaggaagaagtacatggggtcatgcaggttggaatctgttctgacaataaagagaagaattacccagcagagcactcaggtagataggcagaagggccatgagagccaagtgtggatttcctccatccctagaaggccaaggagaagaaaagtactggggtggaaattggtattatt

SEQ ID NO: 3336 - protein, 83 aa, Felis catus
  MOD_RES (83)..(83): Any amino acid
MEPKNAEDLGTVMEMNKSATESVQRKKYMGSCRLESVLTIKRRITQQSTQVDRQKGHESQVWISSIPRRPRRRKVLGWKLVLX

SEQ ID NO: 3337 - DNA, 947 bp, Felis catus
atggtcttcttcaatggtagtagctacagaccttttcttctgagtggttttcctggtctggaagactcacatccaatgatttccattttgttttgtgtcctctacctgattgccctaatgggtaacatcaccatcttagtggttattaaagtggaacggtcacttcatacacccatgtacttttttctctccatgctggctgctagtgaccttggaatctgtgctaccaccctgcccaccctgctcaagcttttctggtctaatgttcgggaaatagactttgatgcctgcctcatccagatgttctttatccatgtgttttccttaatggagtcaggcatcctcctcaccatggcttttgaccgctatgtggccatctccaacccactcaggtacactactgttttgactgattctaccattgccaaaataggtgtggggcttctgctacgggctgttgctgtcatcttcccaggaccctttctcatcaaacgactgaggttttgtaaggctaatgtgctctcccactcatactgcctgcacccagatataatcaagctctcttgttctgaccaccgaataaatagcatctatggcctcatcatcattctcatcacctttggtgtggactctgtactcattctcctctcttatttgaagatcctgattactgtgctaggcatcgcctcccgggaacaacaatttaaggcccttaacacttgtgtctcccacatctgtgctgtgcttctggtttatgtccctatgctgggtgtatctattatccatcgctttgggaaacatgttccatctatggtgcacattatcatgggttatatatacctattgattcctcctgttctcaaccctgttgtatactgtgttaaaacccgagagatacgtacccgtattctaggtaatctactgaaattatagctgaagtactttag

SEQ ID NO: 3338 - protein, 310 aa, Felis catus
MVFFNGSSYRPFLLSGFPGLEDSHPMISILFCVLYLIALMGNITILVVIKVERSLHTPMYFFLSMLAASDLGICATTLPTLLKLFWSNVREIDFDACLIQMFFIHVFSLMESGILLTMAFDRYVAISNPLRYTTVLTDSTIAKIGVGLLLRAVAVIFPGPFLIKRLRFCKANVLSHSYCLHPDIIKLSCSDHRINSIYGLIIILITFGVDSVLILLSYLKILITVLGIASREQQFKALNTCVSHICAVLLVYVPMLGVSIIHRFGKHVPSMVHIIMGYIYLLIPPVLNPVVYCVKTREIRTRILGNLLKL

SEQ ID NO: 3339 - DNA, 955 bp, Felis catus
ctacatcatagtagaactgatttttgtgcggagaagtaggtagaggactccttgacggatctgtttggtcttcacactatagatgattggattgagcacaggtggaaccaataagtagatgtgagccatgaagatacggatcagtggggaggagtgtttggcaaaacggtggacaatagataacccaatcataggcacatatagaatgagtacagcacagatgtgggacgcacacgtgttgagagccttaagccgcccttcacgtgacgcaatttttaatacagagttaaggatgtacacataagacacaaaaatacccagagagtccattccccacagcacactgattagaaccaacccatatataacattaaacttggtgtcagcacaggcaaggcggatcatgtcctggtgcagacaatatgaatgagaaaggatgtgagagtggcagaaaggaaagaaggccagccgagccagaagtggaatcatggcacaggcactcctaagcagggctgcaattccaattttcatgataagtcttggggtgagaatggtagcatatcgtagagggtggcagatagccacgtagcggtcaaaggccatggccaagagcacagatgattccgtgaaggagaaagtgtgaatgaaaaacatttggaccacacaggtactgaactggatttccctggaaatggaccacaacaccctgaacagtgatatcatggtgggcatggacatgcccatgtcggtgagggaaagcatggccagaaagtagtacatgggctgatggagcctggggtctgtccgaacaatatgcaggatggtgcagttacccatgattccaacaaggtacaggagacagaatggaatggatatccagtggtggaattcctcatagccagggatacctgagagatagaatgtggaggacagggtattactggagtttaaggtt

SEQ ID NO: 3340 - protein, 317 aa, Felis catus
TLNSSNTLSSTFYLSGIPGYEEFHHWISIPFCLLYLVGIMGNCTILHIVRTDPRLHQPMYYFLAMLSLTDMGMSMPTMISLFRVLWSISREIQFSTCVVQMFFIHTFSFTESSVLLAMAFDRYVAICHPLRYATILTPRLIMKIGIAALLRSACAMIPLLARLAFFPFCHSHILSHSYCLHQDMIRLACADTKFNVIYGLVLISVLWGMDSLGIFVSYVYILNSVLKIASREGRLKALNTCASHICAVLILYVPMIGLSIVHRFAKHSSPLIRIFMAHIYLLVPPVLNPIIYSVKTKQIRQGVLYLLLRTKISSTMM

SEQ ID NO: 3341 - DNA, 990 bp, Felis catus
tggctacttgggacagactcatgacaggctctacctccagtatggaacagtttgtttcattccacctcactgggattcctggctccaagaatgttaatcattttatttccatcccctttcatgtgtgctacttgattggaatagtgggcaactgtacaatccttcacattatccacatagacaagagtctccacaagcccatgtactacttcctggccattctgtcccttactgacatgggcctgtctatctctaccctgcccacagtattaaaaaatcttctggtttgatactaggaagattgaggtgaatgcttgtgtatcccagatgtattttattcatactttttccctgatggagtcagctgtgcttctagccatggtttttgaccgctatgttgccatttgtgatcctttgaggtattccagcaaactcactccacagcacactgtctacataggggtcttcattataatcagatgttctgttgtcctccctgttattcttgtttgtattcccacactttccttctgtcactcccatgttctctctcactctttctgcttgcatcaagatgtcatccagttggactgtgatgacatctcattcaacattttatatggcttgtttgttgttggattttattggggtgtagattctttaggaatcttgttatcttatgcattcatcctccattctgtgctaggcattgcatcctagggagggaagctcaaagctctcaatacatgtgcttcccacatttgtgctgtattcattctatatgtgcccatgatcgggctatccttagtgcatcgctttgcaaaacactcctccccctttttccacatgaacatgtccaatatttacctcttagttccaacagtacttaactcaatcatttatagcatcaagacaaagcagattccctaaggtttcctaagggtactatcacccaaaagggttgggcttgctcacacttaaatgggataa

SEQ ID NO: 3342 - protein, 95 aa, Felis catus
ATWDRLMTGSTSSMEQFVSFHLTGIPGSKNVNHFISIPFHVCYLIGIVGNCTILHIIHIDKSLHKPMYYFLAILSLTDMGLSISTLPTVLKNLLV

SEQ ID NO: 3343 - DNA, 955 bp, Felis catus
atggcaacctttaactccagtaataccctgtcctccacattctatctctcaggtatccctggctatgaggaattccaccactggatatccattccattctgtctcctgtaccttgttggaatcatgggtaactgcaccatcctgcatattgttcggacagaccccaggctccatcagcccatgtactactttctggccatgctttccctcaccgacatgggcatgtccatgcccaccatgatatcactgttcagggtgttgtggtccatttccagggaaatccagttcagtacctgtgtggtccaaatgtttttcattcacactttctccttcacggaatcatctgtgctcttggccatggcctttgaccgctacgtggctatctgccaccctctacgatatgctaccattctcacccccaagacttatcatgaaaattggaattgcagccctgcttaggagtgcctgtgccatgattccacttctggctcggctggccttctttcctttctgccactctcacatcctttctcattcatattgtctgcaccaggacatgatccgccttgcctgtgctgacaccctgtttaatgttatatatgggttgcttcttgtcgttgtgctgtggggaatggactctctgggtatttttgtgtcttatgtgtacatccttaactctgtattaaaaattgcgtcacgtgaagggcggcttaaggctctcaacacgtgtgcgtcccacatctgtgttgtactcattttatatgtgcctatgatggggctatctattgtccatcgttttgccaaacactcctccccactgatccatatcttcatggctcacatctacttattggttccacctgtgctcaatccaatcatctatagtgtgaagaccaaacagatccgccaaggagtcctctacctacttctccgcacaaaaaccggttctactatg

SEQ ID NO: 3344 - protein, 185 aa, Felis catus
MLPFSPPRLIMKIGIAALLRSACAMIPLLARLAFFPFCHSHILSHSYCLHQDMIRLACADTLFNVIYGLLLVVVLWGMDSLGIFVSYVYILNSVLKIASREGRLKALNTCASHICVVLILYVPMMGLSIVHRFAKHSSPLIHIFMAHIYLLVPPVLNPIIYSVKTKQIRQGVLYLLLRTKTGSTM

SEQ ID NO: 3345 - DNA, 972 bp, Felis catus
tcattttggtttgttacagagccctagtacatgcatccttatctcctttgtctttactccataaacaatggggttcatagtgggtggcaccagtaagtagaggtttgccaggaggataaggacatgcttgggtacatgatctccaaagcgatgggtaaagaaggaaaagaaggccagagtataaaatatcaagatgacacatatatgagctccacatgttgcaaatgcttttgtccgggcttccctagaaggtagttggaagactgttctcaggattagccagtaggacagggagatgaggaaaaagtctagccctgtggtgaggagagcagcagtgagcccataaatgctattgagggcaatgctattgcaggccaacttggcaatgcccatgttctcacagtaggtatggtggatgatgttttcccggcaaaaacgtagccggagaatgaggaggacaccaggagtgaccacagccacactccgagtcaccagagccagacccaccttgctaatgagagaacctgtaagaaaggttgcataatggagtggtgtacagatagccacgtagcgatcaaaagccatggccaagagaacagcagattcagagaggaacagagcatgaacaaaaaacatctgtgtgagacatgcagggaatgttaatggggaaggacccttccagaagataagaagcatttggggcactgtcacagtacaaaggagaacatcattgagtgccagcatggccaggaagagatacatgggttcatggaggttcctgtccccaaccaccactgccataaccaggccattgcctatcacagccaaaaggtacatgaagctgaaggggatggagatccagatttggaagtcttctaatcctgggactccagtcagcagaaaggcagtgaggtgagtggatgtagaattggatattcttgtagacaggtggcccaagtctgttacatgaaa

SEQ ID NO: 3346 - protein, 323 aa, Felis catus
FHVTDLGHLSTRISNSTSTHLTAFLLTGVPGLEDFQIWISIPFSFMYLLAVIGNGLVMAVVVGDRNLHEPMYLFLAMLALNDVLLCTVTVPQMLLIFWKGPSPLTFPACLTQMFFVHALFLSESAVLLAMAFDRYVAICTPLHYATFLTGSLISKVGLALVTRSVAVVTPGVLLILRLRFCRENIIHHTYCENMGIAKLACNSIALNSIYGLTAALLTTGLDFFLISLSYWLILRTVFQLPSREARTKAFATCGAHICVILIFYTLAFFSFFTHRFGDHVPKHVLILLANLYLLVPPTMNPIVYGVKTKEIRMHVLGLCNKPK

SEQ ID NO: 3347 - DNA, 942 bp, Felis catus
ctacattttcagggaacaccacttcttcatcctgcttcggatctgctgggtctttacactgtagatgattggattcatcaggggtggaaagagaatatagatgttgcccatgaggacatgaacggaaggggagagatgctttccaaagcgatgcaccatggtgaggccaatgatggggatgtaaaagaccaggacagcacagatgtgggacacacaggtctgcaaggacttgagcctctcctcgcgggatgcaattgccagcactgtgtgcaagatgaaaacgtaggagatgagaataagcacagcgtctaacaacaaggtacagatcaccagagccaaggcatagaggctgttgaagcggatgtcagagcaggcgagccggagcaggtcctggtgcaggcagaaagagtgggagaggatgtgagggcggcagtaatggaagagcttcaggcgaatgatgacagggagaatggacaaagctgccctcatcaaaatggccaccatgaagtgaatgactctactgttagtcaggagggatgtgtatctcagaggattgcagattgcagtgaagcgatcaaaggccatggcaagaaggaccccagactctatggaggacagaccatggataaagtaagtttgggcaatgcaagcatcttgactaacttcttggttgagcccccacaggacccccagcaccgtgtgcactgtggacagccccatgcacaggtcagtgagagccagcatggccaggaagtagaacatgggctggtgcaggctgggctctgtccggatcacatgcagcaccacgcagtttcccaggaaaaccatggcatagatggaggagaagggaatggaaaaccagggatagtagtggtccaggccagggaaccccgtgagaatgaatattgaggtattgataatggaagcagaagaagcaggcat

SEQ ID NO: 3348 - protein, 313 aa, Felis catus
MPASSASIINTSIFILTGFPGLDHYYPWFSIPFSSIYAMVFLGNCVVLHVIRTEPSLHQPMFYFLAMLALTDLCMGLSTVHTVLGVLWGLNQEVSQDACIAQTYFIHGLSSIESGVLLAMAFDRFTAICNPLRYTSLLTNSRVIHFMVAILMRAALSILPVIIRLKLFHYCRPHILSHSFCLHQDLLRLACSDIRFNSLYALALVICTLLLDAVLILISYVFILHTVLAIASREERLKSLQTCVSHICAVLVFYIPIIGLTMVHRFGKHLSPSVHVLMGNIYILFPPLMNPIIYSVKTQQIRSRMKKWCSLKM

SEQ ID NO: 3349 - DNA, 910 bp, Felis catus
gtctctgatgccagccccacccagccagaagaggcttagcatcctcagccggatctgcttggtcttaatggtgtagacattgacaccggaggcgtgagaaaatgaagacaggagagcagcacacggctggaaggggaagcccccttcccaaatctgtggatcatggacaggccaatgataggcgtgtagaagagcaacacagcacagacaaaggcgacacaagtgttgagggctttgaggcgctcaacattggaagcaatggatagcattgtttggagatcagcccatagtagagcacaatgagcatcacaaagagaccataggcactgttgatgtgggtgtctgcacaggccagcatgacatctgggtgtagacagtaagagggggaaagcaggtgattctggcagtaaggcagctccttcagcatgatgggggccgggatgtggagcccgaagctgtgcgccacactggccaggcccaagcaggcaatgtgggagctggtgagcatggtgctgtaacgcagggggttgctaatggccacaaaatggtcaaaggccatggtcagcagcacagaggactccatgagggagaaagtgtggatgaagaagagctgggccaggcacatatccaccgccacctgtctgagacccagcatgtagaaggggagcatggtggaggggagcgtggaggcagacaggcccaggtcagtcgctgtcagcatcgacaggaagtagtacatgggctggtgcagagtgggctctgacttcaccacccacaggatcaggctgttccctgccagagaggccacgtacatggcacacagagggatggagagccagctgtgcacagcctcaaggcctgggagccctgctaggaggaaggaactaccagtgtggttggagtctgacat

SEQ ID NO: 3350 - protein, 249 aa, Felis catus
MSDSNHTGSSFLLAGLPGLEAVHSWLSIPLCAMYVASLAGNSLILWVVKSEPTLHQPMYYFLSMLTATDLGLSASTLPSTMLPFYMLGLRQVAVDMCLAQLFFIHTFSLMESSVLLTMAFDHFVAISNPLRYSTMLTSSHIACLGLASVAHSFGLHIPAPIMLKELPYCQNHLLSPSYCLHPDVMLACADTHINSAYGLFVMLIVLYYGLISKQCYPLLPMLSASKPSTLVSPLSVLCCSSTRLSLACP

SEQ ID NO: 3351 - DNA, 942 bp, Felis catus
tcagagtttttttaggtggagcgtcttcagaatgcatgcccgaatctctttggttttaacaccgtagacaattgggttgagcattagaggaacaagaaagtgtagataggagagaaacatgtatatacctgagctggtagcttctttttcccaaagtgatggatcatcgacaggctgaccagtggggtataaaatagtaatacagcacagctgtgggaaatgcaggtgttaaaggcttggagcccctcagtgttagaagaaatgctcaatactgtcctcaagattagcatgtaggagaggagaatgagtacagcatccaaagccagtgtggagagcatgacaaagagcccaaagccactgtccacaagagtgctagaactggctagccttaaaacatcaggatgaacacaatatgaatgagacagagcattcataggctgaaattgccgtcttccaaggatcaagaacaggggcagatggagagcagcactacgtatcacaatggccagcccaatggccccaatgcgcttggttgtgagaatggtggcatagcataaaagctctcgaatagccacatggtggtcaaaagccatggccaagagcacagatgattcaataactgagaaagtatggatgaagaagagttgtgtaaagcaggttgcatctcccacctctctctggcccaggacaaagacagctgtcactgaaggcagggtggaagctgagaggcccaggtctgccattgaaagcatggacaggaagaggtacctaggtgtgtggaggctagggacaggcttgacaatgtacattatggtgattttgcccagcaaagacacaacatagatagagcagataggaatagctgtccagcagtgagaggtctccagtcctcttcagtatgaagatgaagctgctggcattattgttgttaagaactgccat

SEQ ID NO: 3352 - protein, 52 aa, Felis catus
MAVLNNNNASSFIFILKRTGDLSLLDSYSYLLYLCCVFAGQNHHNVHCQACP

SEQ ID NO: 3353 - DNA, 967 bp, Felis catus
atgttataaatgtgacttgggattctcctggtcttctttcggtgaagagtttctgaattttatctcgtatctgcttggttttcgctacatacacaacagggttcatcacagggggaatgagaaaatgcatgttagccatggtcacgtagatacatgagggaagtttggggccgaagcggtgcagtatggacaggcagatcatgggtgtgaaaaagagaatcacagcacagatgtgggaaatgcaggtgttgagagccttgagacggccaccataggatgcaatgctcagtacagttttcagtatcaggacatatgaaaagaggatgaagagaaaatcaagtcccatagtggatagcaccacaaacagtccaaagatgctgttgatcctggtgttggaacaagagagctttatgatatcaggatgcaggcagtaggaatgagatagtacattggaatcacagaagcacagcgtcctcaagaggatggggagaggcacctgcacagtgaatgttcgcactataatggccaaacctatcctggcaattacaccgttggtgagaatggaagaatagtgcaatggacgagaaatggccacatagcggtcaaaggccattgccagtatgatagctgactcaaaatcctggaaggtgtgaataaaaaacatttgggtgaagcaagcagagaaggtgagctctcgagcatccagccagaagatccccagcattgtggggaaagtgaaaagggacagacccagatcagagacagctagcatggccaggaagagatacataggcacatggagggtctggtccttgcagataactgttatgatggtcatgttgctcaccaaggtaatgaagaacatggcacagaagggtatggagatccagatgtgcacagcctccagcccaggtatgcctgtcaccacaaaggtggagactatggatgtggtgctattggtgggcaa

SEQ ID NO: 3354 - protein, 323 aa, Felis catus
  MOD_RES (323)..(323): Any amino acid
LPTNSTTSIVSTFVVTGIPGLEAVHIWISIPFCAMFFITLVSNMTIITVICKDQTLHVPMYLFLAMLAVSDLGLSLFTFPTMLGIFWLDARELTFSACFTQMFFIHTFQDFESAIILAMAFDRYVAISRPLHYSSILTNGVIARIGLAIIVRTFTVQVPLPILLRTLCFCDSNVLSHSYCLHPDIIKLSCSNTRINSIFGLFVVLSTMGLDFLFILFSYVLILKTVLSIASYGGRLKALNTCISHICAVILFFTPMICLSILHRFGPKLPSCIYVTMANMHFLIPPVMNPVVYVAKTKQIRDKIQKLFTERRPGESQVTFITX

SEQ ID NO: 3355 - DNA, 957 bp, Felis catus
atgttggcttttaataacactttctttaattggcccactttctccttcattggtattcctggtctggaagctgcacatatatggatctccatccccttctgtgtcctgtacctcatagcccttgtgggtaatgctgttcttcttatcctagttagagcagagaagaaccttcatgaacctcagttctattttttggctatgctagcccttactgatctaggcctttcattgtcaacaatgcctagtgtcttggctatcttctggtttgatgtccgtgacattggccttaatgcctgcctaacccagatgttcttcatccacaccctctcctcagtagaatcaggtgtcctggtggccatggcttttgaccgtttggtagctatctgtgctccactaaactataccaagatccttacccactacaccgttgcctgccttagtggagctgccctcatacgaggtgccactctgctggctcctctgccttttttccttaggacttttcctttctgtggggccaatatcctgtcacactcctattgctactacccagatatgctgaacttagcctgtggggacattaccttcagcagtgcctatggattggtttttgttctctgcacatttgcagtggatgttgtcttcatcttagcttcatacatgaagatcttggacaccattatgaagctggagactcaagacagaaactggaggtcactgcacacctgtgcctgtcacctatgcatggtgcttgtgttctacctgcccctaatcagcttggcagtgctacatcgttatacccaggacacttccccaattctgtataccaccatgagtaatgcctacctcctcatgacaccactgctcaaccctctcgtctatagtctcaaatcccggcagatccaggctgccctgcgcaagcgattttgggtgcaacgtgtcattgctggggaatga

SEQ ID NO: 3356 - protein, 318 aa, Felis catus
MLAFNNTFFNWPTFSFIGIPGLEAAHIWISIPFCVLYLIALVGNAVLLILVRAEKNLHEPQFYFLAMLALTDLGLSLSTMPSVLAIFWFDVRDIGLNACLTQMFFIHTLSSVESGVLVAMAFDRLVAICAPLNYTKILTHYTVACLSGAALIRGATLLAPLPFFLRTFPFCGANILSHSYCYYPDMLNLACGDITFSSAYGLVFVLCTFAVDVVFILASYMKILDTIMKLETQDRNWRSLHTCACHLCMVLVFYLPLISLAVLHRYTQDTSPILYTTMSNAYLLMTPLLNPLVYSLKSRQIQAALRKRFWVQRVIAGE

SEQ ID NO: 3357 - DNA, 834 bp, Felis catus
aaacagtctacattttggacttcaaatttgttttcttttcacactagaaacaaaagagttgaggacaggtgtgaggaaaaggataatgttggacatagtgatgtggggtaaaggggagttgtatctgcctgtcctgtggatcagaactaagccaataagtgggtcctagacaatgaggaccatgacaatgtggtagacatgtgtgttgagttccttaagtcatccttccccagaagcaatgccaagaactgtcttcaagatcaaagcataagacagaaacaataaagacagagtcaacaccaaaggtgcagagaaccaatgccaacccatgggtgatgttcacatgaatggacacacaagctagcttcatcacttcagggtggaagcagaatgagtgggataggatgatgttcttacagaagggaagccatttgagctggatgagtaagaaggccatcagtgccactcctcgagccatagcagccaatcccacctgagtaatgcaggaatgggtcaggaccacagtgtagcatagcgggttgcatatggcaacaaagcaatcaaaagccatggcttacaggagggctgactccacagaagagaagtgtggatgaagaacgtcggagctaggcaaccatggaactcaatcctgtggttaaggagaaacatattaggtatagtaggcagtgtagatgctgacatgcctgtgtcggtggctgccaacatggataagaatacatactgaggctcatgaaggctgggattcttgtgtattatggtaattatgatgcggttctccaggatggcaattatatacgtgatgctcagttggat

SEQ ID NO: 3358 - protein, 106 aa, Felis catus
IQLSITYIIAILENRIIITIIHKNPSLHEPQYVFLSMLAATDTGMSASTLPTIPNMFLLNHRIEFHGCLAPTFFIHTSLLWSQPSCKPWLLIALLPYATRYATLWS

SEQ ID NO: 3359 - DNA, 946 bp, Felis catus
ctacttcagcaagtttctcctggccctgagtaccttgtgtactgcagaccttatctgtttggtttttaggctataaaccaagggattaaggactggggtcaagaagagaaagagattggccatggtgacatggagaagaggagatgtgaatgtaccaaacctatgaattagagccaggacaatgagtggcacataaaagatgcagacagtgaaaatgtgggaaatgcaagtattaagcgctctgagctgaccatcttctgaagcaatacccagcactgttttcaaaataaggatgtatgaaatgacaatgaacacagagtcaactccaaaggagcagagcacaagagacagtccatagatgatattgactctgacagggccacaggccagcttcataacatcagggtggtagcagtaacaatgtgataggataacatccctgcagaaagacaatcgcttgagcaggattggcaagggtaccatcaacaccacagccctaaccatggctgcaattcccatccccatgatccgaggagaggttaagaccacagtgtagtgcaatgggttgcaaatagctacaaatcggtcaaaggccatggccaacaggatggctgactccatggaggagaaggtatggatgaagaacatttgtgtcagacaagaatggaactcaatttctctgtgattcaagaggaagacactgagtaccgtaggtagagttgataaagacagacccacatctgtggttgccagcatcgataggaagatgtattgagggtcatgaaggctggaggtggttttgataacaaagaggatgatgcagttccccaggagagcaattagatacatgacacacagtgggatagagatccatatttgtacagcctccagtccaggaatgcctgttaggagaagagtgggtggctggaaccagctactgtttata

SEQ ID NO: 3360 - protein, 314 aa, Felis catus
INSSWFQPPTLLLTGIPGLEAVQIWISIPLCVMYLIALLGNCIILFVIKTTSSLHDPQYIFLSMLATTDVGLSLSTLPTVLSVFLLNHREIEFHSCLTQMFFIHTFSSMESAILLAMAFDRFVAICNPLHYTVVLTSPRIMGMGIAAMVRAVVLMVPLPILLKRLSFCRDVILSHCYCYHPDVMKLACGPVRVNIIYGLSLVLCSFGVDSVFIVISYILILKTVLGIASEDGQLRALNTCISHIFTVCIFYVPLIVLALIHRFGTFTSPLLHVTMANLFLFLTPVLNPLVYSLKTKQIRSAVHKVLRARRNLLK

SEQ ID NO: 3361 - DNA, 840 bp, Felis catus
cccatctgtttcatgtacatagtttctgttttaggcaacaccttcttattattcctgatcttcactgaacgcagtcttcatgaacccatgtaccttttcttgtccatgttagccctggcagatatctttctctccacagtcaccacaccaaagatgctagcaatcttctggttccaagatgggggtatttcttttggttgctgtgtgtcccaaatgttttttctccacttcatctttgtggcagagtctgccatattgctggccatggcatttgaccgctatgtagccatctgccatccactaagatatactacaattctaaccccctcagtcattggaaaaatgggcattgcctctgtgatcaggagtttcttcatctgcttccccttggtttttctggtttatcggcttgcttactgtgggaggaatattattcatcactcatattgtgaacatatgggcattgccaggctagcctgtgatagcatcaaaatcaacatctactatggggtgattgtggccctattttctacatgcctggatgtggtgtttatcattgtttcctatgcccttatactctgtactgtttttagaattccttcccaagatgcccgactcaagactctgggtacttgtggctcccatgtctgtgttatcctgctgttctatactccagcctttttttcattctttgctcaccgatttgggggccaccatataccactccatgtacatatcctccttgccaatctttatgtggtggtaccacccactctcaatcccatcatttatggagttaagaccaagaaagttcaggagaagtttgtccatgtcttttct

SEQ ID NO: 3362 - protein, 280 aa, Felis catus
PICFMYIVSVLGNTFLLFLIFTERSLHEPMYLFLSMLALADIFLSTVTTPKMLAIFWFQDGGISFGCCVSQMFFLHFIFVAESAILLAMAFDRYVAICHPLRYTTILTPSVIGKMGIASVIRSFFICFPLVFLVYRLAYCGRNIIHHSYCEHMGIARLACDSIKINIYYGVIVALFSTCLDVVFIIVSYALILCTVFRIPSQDARLKTLGTCGSHVCVILLFYTPAFFSFFAHRFGGHHIPLHVHILLANLYVVVPPTLNPIIYGVKTKKVQEKFVHVFS

SEQ ID NO: 3363 - DNA, 940 bp, Felis catus
attttttgaaattaaacaatctctgaactcttcttcgtatttgttgggtcttgatactgtaaataatggggttcatcaagggtgggaaaaggatataggtgttgcccaggaggacatgtacccatggtgagaggtgtttcccaaagcgatgcaccatagtcagaccaatgattgggatgtagaaaacagaaacagcacagatgtgagatacacaggtctgcaaggacttgattctctcttcccgtgatgcaatagctaagactgcatgcaagatcataatataggagataagtatgagcactgcatccaacaacaggttgctaattaccagggcaagaccataaatgctgttgaaacggatgtctgaacaggccattctaattaagtcttggtgcaggcagaaagagtgagaaaggatgtgggggcggcaataatttaagaactttaggcgaatgatgactggaggtatgagtaaagaactcctacataagattgtcaccccaattttcatgattttgtcattagttaggatggaagaatagcgtagtgggttgcaaatggcaatgtaacggtcaaaagccatagcaaggaggacagaggattccatgaaggacaaaccatggatgaagtaggactgggcaatgcaggaatctaggctgatctcacgaacgaatccccacaggatccccagaaccgtgtacatggtagacagccccatgcacagatcagtgagggccagcatggccaggaagtagaacataggctggtgcaggctgggctctgtccggatcacatgcagcaccatgcagtttcccaggaaaaccgtggcatagatggaggagaaagggatggagatccagagatagtgaacttctaggccaggaaaaccagtgagaataaatctggaactattaacattaaagatagagataggagacat

SEQ ID NO: 3364 - protein, 314 aa, Felis catus
  MOD_RES (314)..(314): Any amino acid
MSPISIFNVNSSRFILTGFPGLEVHYLWISIPFSSIYATVFLGNCMVLHVIRTEPSLHQPMFYFLAMLALTDLCMGLSTMYTVLGILWGFVREISLDSCIAQSYFIHGLSFMESSVLLAMAFDRYIAICNPLRYSSILTNDKIMKIGVTILCRSSLLIPPVIIRLKFLNYCRPHILSHSFCLHQDLIRMACSDIRFNSIYGLALVISNLLLDAVLILISYIMILHAVLAIASREERIKSLQTCVSHICAVSVFYIPIIGLTMVHRFGKHLSPWVHVLLGNTYILFPPLMNPIIYSIKTQQIRRRVQRLFNFKKX

SEQ ID NO: 3365 - DNA, 952 bp, Felis catus
atgctcaagctcaatggcacagtcttcatgccctcagtgctgacactggttgggatccctggcttggaatctgtgcagttctggattggaattcctttctgtgccatgtacatcactgctctgtttgggaattccctgctcctggtcatcatcaaatcggaacgcagcctccatgagcccatgtacctcttcctggcaatgcttggagcaacagacattgctctcagtacctgcatcctacccaaaatgctaggaatattctggttccatttaccagacatatatttcgatgcctgtctctttcagatgtggcttatccacaccttccagtgtatcgaatcaggaattctgctggccatggccctggaccgctatgtggccatctgtgatcccctgagacatgcaatcatctttacccaccaactagtcactcagattggggtagcagtgacactcagagcagtcatcttttcagctccatgtctcatcctcatcaaatgtcggctgaaacacttctggaccaatgtggtctcccattcatactgtgagcacatggccgtcgtgaagttggcagcagaagatattcaaatcaacaagatctatggtctgtttgtggctttcattatacttggatttgacataatcgttatcatactctcctacatccgaatatttataactgtcttcaatctgcctcagagagaatctaggctcaaagcctttaacacctgcattgcccatatttgtgtcttccttgagttttatctcctaggtttcttctccttctttacacacaggttcgggttccacattccaccctacattcatattcttctgtccaatctttatctgcttgtccctcctttgctcaatcctattgtgtatggggtgaaaaccaaacagattcgagatcggttgtccaagattttttcactctaaggatccattttga

SEQ ID NO: 3366 - protein, 312 aa, Felis catus
MLKLNGTVFMPSVLTLVGIPGLESVQFWIGIPFCAMYITALFGNSLLLVIIKSERSLHEPMYLFLAMLGATDIALSTCILPKMLGIFWFHLPDIYFDACLFQMWLIHTFQCIESGILLAMALDRYVAICDPLRHAIIFTHQLVTQIGVAVTLRAVIFSAPCLILIKCRLKHFWTNVVSHSYCEHMAVVKLAAEDIQINKIYGLFVAFIILGFDIIVIILSYIRIFITVFNLPQRESRLKAFNTCIAHICVFLEFYLLGFFSFFTHRFGFHIPPYIHILLSNLYLLVPPLLNPIVYGVKTKQIRDRLSKIFSL

SEQ ID NO: 3367 - DNA, 955 bp, Felis catus
ttagttttcagaaatcttcttgcttgggaagaagagaccaaccactcggtcacgaatctgcttggtcttgacgccatacaccaggggattgactgcaggaggcaccaaaagatacaaactcgcaaaaattatatgaatgcttggaggtaccttcttgccaatgcggtgagttaggaaactaaacagtgcaggggtgtaggagacaagtatagtgcacacatgggcagcacaggtgcccagcgctttcgagcgggcattctgggaagacagctggaagactgcctggaggattttggtataggatgcggctatgagccctaggtcccacaccatcactgaaagggccacagagattccgtacactctgttaatgagggtgttggcactggccaacttcaccacagccatgtgctcacagtaggcatgactgatgacatatttagtataatatggtagccttttaataagaagaggacctggaaaaaccataaggatagctcgggtcataccagctagacccattttaatgaccgttggtgttgtcaggatggttgtataacgcaatgggatacaaatagctacatagcggtcaaaggccatggcaaccaagagggatgattcaattacgcagaatgtgtgaatgaaatacaactgtgtcaggcaggtgtcaaagtcaatccaatgtgcatccatccagaagataccaagcatcttgggggccgtggaagaggcaagagccatgtcattcactgccagcatacaaaggaagaaatacataggctggtggaggcttggttctagtttgatggtgatgatgattacactgttccccagcagggccagggcaagcagggaggcagaccgggatgccaatccagcagtgaaaatcttgcaaaccaggaataccaaccaggaaaaaagatgagatgtagcgatgtgtagcattgtctgccat

SEQ ID NO: 3368 - protein, 314 aa, Felis catus
MLHIATSHLFSWLVFLVCKIFTAGLASRSASLLALALLGNSVIIITIKLEPSLHQPMYFFLCMLAVNDMALASSTAPKMLGIFWMDAHWIDFDTCLTQLYFIHTFCVIESSLLVAMAFDRYVAICIPLRYTTILTTPTVIKMGLAGMTRAILMVFPGPLLIKRLPYYTKYVISHAYCEHMAVVKLASANTLINRVYGISVALSVMVWDLGLIAASYTKILQAVFQLSSQNARSKALGTCAAHVCTILVSYTPALFSFLTHRIGKKVPPSIHIIFASLYLLVPPAVNPLVYGVKTKQIRDRVVGLFFPSKKISEN

SEQ ID NO: 3369 - DNA, 939 bp, Felis catus
ttatgaagagaacatctttaccacatgaatgcggatctgcttggtcttggcaccatagacgagtggattgagaaatggggggaccagcaagtagaggctagaaaagaggatgtggatataagggggaacatgagcaccaaacctatgtgtgaagaaggagaagaaggcaaggaggtagaactggaggaagacacagatgtgagcgatgcacgtattgaatgctttcaaacgagcctccttctggggcaaacgaaaaactgtgaaaaagatctgtgcataagacaaagtgatgaatgtgaggtcgaaccctgcaactataaatgccacaaacaaaccatagattttgttgacccgtacattttctgcagccagtttcacaatggccatatgctcacagtagcagtgggagatgatggttgtatggtaaaactgaaaccggaactttatcagtactaaagatggggctacaagaagggcagccctgagtgttaccacagccgctatttgggtgactaggtggtgggtgaagatggcagaatgtcttagtggataacagatggccacataacggtccagagccatggccaacaggatgcctgactctatgccttgaaatgtgtggatgagccccatttgaagcaaacaggaatcaaaataaatgtctggcacatgaaaccagaagattccaagcatcttgggcacaatgctcgtgccaagtacaatatctgtgactcccagcatgcctagaaaaatgtacatgggctcatggaggctgcgctctgacctgatgatgatcagaagcaagaaatttccaatgatagcaatgagatacatgacacagaatggaatcccaatccagcactgcactgtctctaggcctgggatccctatcagtgtcaacacagaaggcatgaagactgtgatgttggaaacggacat

SEQ ID NO: 3370 - protein, 312 aa, Felis catus
MSVSNITVFMPSVLTLIGIPGLETVQCWIGIPFCVMYLIAIIGNFLLLIIIRSERSLHEPMYIFLGMLGVTDIVLGTSIVPKMLGIFWFHVPDIYFDSCLLQMGLIHTFQGIESGILLAMALDRYVAICYPLRHSAIFTHHLVTQIAAVVTLRAALLVAPSLVLIKFRFQFYHTTIISHCYCEHMAIVKLAAENVRVNKIYGLFVAFIVAGFDLTFITLSYAQIFFTVFRLPQKEARLKAFNTCIAHICVFLQFYLLAFFSFFTHRFGAHVPPYIHILFSSLYLLVPPFLNPLVYGAKTKQIRIHVVKMFSS

SEQ ID NO: 3371 - DNA, 946 bp, Felis catus
cctggtctttggaacacaacatctttaccgccttatctcgaatgtgtttggtcttcaccccatatacaaagggattgaggaaaggtggaaccagtaggtaaaggttagacaaggtgatatgtacatatgatggaatagaagatccagatctgtgagtgaaaaaggaaaaaaaggcaaggagatagaattggaagaagatacatatgtggggaatacatgtattaagggccttaagacgtgcccctttctgggacaggtgaaagacagtgataaatatttgtacataggagagggtgattaaaaggaagtccaggccaccaacaataaaagctccaaggagaccgtagaatttactgatggaaacgtcttcagtggcaagcttcacaagggccatgtgttcacagtaagtgtgggatattaacttggttcggtaaagtttcagacgacactttatgagcaagaggcatgggattaccaaaaaggcaggcctcaaggtcaccccaattccaatatgtgtgaccagttgtcgagtgaatatgatagcatgcctcagtggataacagattgctacatagcggtccagagccatagccaaaaggactcccgattcaataccttgaaatgtgtggataagccacatctgaaagaggcaagcatcaaaatagatctctggcaagtggaaccaaaaaattccaagcatcttggggacaatgctggtgctaagtacaatgtctgtggctcccaacatggccagaaagaaatacataggttcatggagactgggttcagatttgatgatgatcaaaagcagagaatttcccaccaaagcaatgatgtacataacacagaatggaatcccaatccaacactgaatagtttccagaccagggatcccaatgaaagtcagcacagagggtatgaacatggtgccatttgcaataggcat

SEQ ID NO: 3372 - protein, 316 aa, Felis catus
  MOD_RES (316)..(316): Any amino acid
MPIANGTMFIPSVLTFIGIPGLETIQCWIGIPFCVMYIIALVGNSLLLIIIKSEPSLHEPMYFFLAMLGATDIVLSTSIVPKMLGIFWFHLPEIYFDACLFQMWLIHTFQGIESGVLLAMALDRYVAICYPLRHAIIFTRQLVTHIGIGVTLRPAFLVIPCLLLIKCRLKLYRTKLISHTYCEHMALVKLATEDVSISKFYGLLGAFIVGGLDFLLITLSYVQIFITVFHLSQKGARLKALNTCIPHICIFFQFYLLAFFSFFTHRSGSSIPSYVHITLSNLYLLVPPFLNPFVYGVKTKHIRDKAVKMLCSKDQX

SEQ ID NO: 3373 - DNA, 898 bp, Felis catus
ttttcagagaaaagagtctgagcattctgctacgaatctgctgggtcttgacactgtagatgatggggttcatcaaaggtggaaaaaggatgtagatgttgcccataagtacatggaccacaggggagagatgcttgccaaaacggtgcatcattgtgaggctaatgatagggatgtagaacacgagaacagcacaaatgtgggagacacaagtctgaaatgatttatgccgctcctcctgagaggcaattaccagcactgacctaagaatcaggaaataggagtaaaggatcagaatagcatccaacaatagtgtgaaaatgaccagcatcagggcatagtagctattgaatcttatgtctgagcaagcgaggcggagaagatcctggtgtaggcagaatgagtgagagaggatgtgggaatggcagtaatggaaaaatttcagattgatgatggggggtgtaataaagaagaaactcctacctactatggcgagcccaattttgaaaatcctggaattagtcagaatggaggaataacgcagtggattacaaatagcaacatacctatcaaaggccatcgtaaggagaacagaggactccatgaaggaaagaccatggataaaataggactgggcaatgcaggaattcaggctgatttctcgaatgaacccccacaggatccccagcactgtgtggaatgtggacagccccatgcacaggtcagtgagggccagcatggccaggaagtagaacatgggttggtgcaggctgggctctgtccggatcacatgtagcaccatgcagttgcccgaaagcaccatggcatagatggtcaaaaagggaatggagatccagggatactgctgctccaggccagaaaatccagtgagaagaaa

SEQ ID NO: 3374 - protein, 300 aa, Felis catus
  MOD_RES (300)..(300): Any amino acid
FLLTGFSGLEQQYPWISIPFLTIYAMVLSGNCMVLHVIRTEPSLHQPMFYFLAMLALTDLCMGLSTFHTVLGILWGFIREISLNSCIAQSYFIHGLSFMESSVLLTMAFDRYVAICNPLRYSSILTNSRIFKIGLAIVGRSFFFITPPIINLKFFHYCHSHILSHSFCLHQDLLRLACSDIRFNSYYALMLVIFTLLLDAILILYSYFLILRSVLVIASQEERHKSFQTCVSHICAVLVFYIPIISLTMMHRFGKHLSPVVHVLMGNIYILFPPLMNPIIYSVKTQQIRSRMLRLFSLKX

SEQ ID NO: 3375 - DNA, 932 bp, Felis catus
tcaagcccttctgtgcacagaaaataggcgaatgatacttctctgaatttgcttggtcttgatgctatatataatggggttcatgaatggaggaaagagaaagtagacatagctcatagtaatgtggatcacacgtgatgcatgtttctcaaacctgtggatgaaggtcaggccaatcacagtaatataaaagaccagaacacagctaatatgggagacacaggtgttaagggccttagctcgctcttctccagaggcgatgcccataactgtcttcaagattaaaatacaagagaagagaataatctgagcatctaggaagaaagtcaaagcaaccagaataactggatatacacgattaaatgtaatatcagcacaagcgagtttcatgacatcttggtggaggcaaaaggcacgggaaagaacatgggaacggcaatatgggaaccaatagagtgacacaattgggggcacaatggacacaaagtcccttgtttgtactccaagtcctattttcatcacctgggaattggtaagaatggagttatacctcagagcggtgcagatggcaatgaatcggtcataggccatggcaaacaagacacctgattccacaatggacagggtgtgaatgaagtaggactgagtgaaatagtcaccctgggaaatttccctctggaaaattggacactcaggactgtgggcactgtggttagtgtcatcccaaggtctgtacctgccagcatagctaggaagtagtacatgcgctcatgaagactggagtcattccaaatgagaaagagaagtgtgccattgaccaaaaggatggagaggtagatgataaagaagggaatagagatccagtgctgaattgcctctgagcccagaaagccagtcagcaagaagggagcagcactgttgttggaccacat

SEQ ID NO: 3376 - protein, 196 aa, Felis catus
MAYDRFIAICTALRYNSILTNSQVMKIGLGVQTRDFVSIVPPIVSLYWFPYCRSHVLSRAFCLHQDVMKLACADITFNRVYPVILVALTFFLDAQIILFSCILILKTVMGIASGEERAKALNTCVSHISCVLVFYITVIGLTFIHRFEKHASRVIHITMSYVYFLFPPFMNPIIYSIKTKQIQRSIIRLFSVHRRA

SEQ ID NO: 3377 - DNA, 936 bp, Felis catus
tcaagctctcctatgcatagaaaataggcaaatgatgtttctctgaatttgcttggtcttgatgctatatataatggggttcatgaatggaggaaagagaaagtagacatagctcatagtaatgtggatcacacgtggtgcatgtttcccaaacctgtggatgaaggtcaggccaatcacagtaatataaaagaccagaacacagctaatatgggagacacaggtgttaagggccttagctcgctcttctccagaggcgatgcccataactgtcttcaagattaaaatataagagaagagaataatcagagcatctaggaagaaagtcaaagcaaccagaataactggatatacacgattaaatgtaatatcagcacaagcaagtttcatgacatcttggtggaggcaaaaggcatgggagagaacatgggaacggcaatatgggaaccaatagagtggcacgattgggggcacaagggataaaaagcccctcattagtacccccaggcctaccttcatcacctgggaattggtaagaatggagttatacctcagaggggtgcggatggcgatgaatcggtcataggccatggcaagcaagacaccagattccacaatggaaagggagtgaatgaagtaggcctgcaggaagcaggctccatggctcatctgccggtgattcatccacaagacacccatcacagttggcatcgtggtcaatgtcaccatcagatctgtgcctgccagcatagcaaggaaataatacatgggttcatggaggctgtggtcatccttgattaggtagaggagagtaccattgccaagaagcacagagatgtagacagcaaagaaggggatggagatccagggatgagcagcttccagacctgggaagccagtcagcaaaaagggggcagcactaatattgggccacat

SEQ ID NO: 3378 - protein, 311 aa, Felis catus
MWPNISAAPFLLTGFPGLEAAHPWISIPFFAVYISVLLGNGTLLYLIKDDHSLHEPMYYFLAMLAGTDLMVTLTTMPTVMGVLWMNHRQMSHGACFLQAYFIHSLSIVESGVLLAMAYDRFIAIRTPLRYNSILTNSQVMKVGLGVLMRGFLSLVPPIVPLYWFPYCRSHVLSHAFCLHQDVMKLACADITFNRVYPVILVALTFFLDALIILFSYILILKTVMGIASGEERAKALNTCVSHISCVLVFYITVIGLTFIHRFGKHAPRVIHITMSYVYFLFPPFMNPIIYSIKTKQIQRNIICLFSMHRRA

SEQ ID NO: 3379 - DNA, 891 bp, Felis catus
aatttgcttggtcttgatgctatagatgacaggattcattaaaggagggaagaggaagtagaaatagctcattattacgtggaccactggtggcacattcttcccaaacctgtggatgaatgacggaccaaccacagtgacatagaagataagaacagagccaatgtgggagatacaagtattgagggccttggttctctcttaaccagaggctatgcccatgacagtcttaagaattaggatataggaaaaaagggtaatcagagaatctaggaagattgttgaaagaaccaaaattacagagtaaagtctattggaagttatgtcagcacaggccagttttatgacttcttgatgaagacagaaagcatgggagagaacatgagagtggcaatatggaaatgagaaaaagctgcaggattacagggacgatggatatgaaacccctcataaaagttcccatccctaaagttacaacacgagtattggtgagaatggaagtgtatttcaagggattgtggaaggcaataaaatggtcataggccatagcaagtaagatacctgattccatgatggaaagggagtgaatgaagtaggcctgcaggaagcaggctccatggctcatcttccggtgattcatccacaagacacccatcacagttggcatcgtgatcaatgtcaccatcagctctgtgcctgccagcatggcaaggaaataatacatgggttcatagaggctgtggtcatccttgatgaggcagaggagagtgtcattgccaagaagcacagagatgtagacagcaaagaaggggatggagatccagtgatgagcagcttccagacctggggagccagtcagcaaaaggggccagcactaatattgggccacat

SEQ ID NO: 3380 - protein, 92 aa, Felis catus
  MOD_RES (92)..(92): Any amino acid
MAHLPVIHPQDTHHSWHRDQCHHQLCACQHGKEIIHGFIEAVVILDEAEESVIAKKHRDVDSKEGDGDPVMSSFQTWGASQQKGPALILGHX

SEQ ID NO: 3381 - DNA, 932 bp, Felis catus
tcaaattctatgcaaagagagaaggtgattgatgccattccttatctgcttggtcttaatactatagatgattggattcataaatggggggaagaggaagtaaatatagctcatgataatatgaactacatgtggcacatatttcccaaatcgatgaataagggtcaacccagtaacagtgacataaaaaccagaacacagctaatatgggagacacaagtgtttagagccttagcctgctccttacctgaggcaatccccatgacagtattaaggattagaatataagagatcaggataagcacagagtccaagaagccagttaatgagactagcactataggatagagtctattgaaggtgatgtcagcacaggccagtttgatcacatcctggtgtaggcagaaagcatgagagagaacatgggatccacagtagggaaatccagagagggtgatgattatgggcacaataagtataaatcccctcattagaacccccagacctatcttcaccaccctagcattggtgaggatggaggtgtatctcaggggactgtggatggcaatgaaacgatcataggccataacaagcaagactccagactccacaatagagagtgaatggattagataggcctgaaagtagcaggctccttggctgattgccctgtgaccaagccacagaacaccaagcacggtgggcattgttgtcaaagtcactccaaggtctgtggctgccaacagagccacaaagtagtacatcggctggtggagagtgtggtcttctctgataaggtagaggatggtgccattgccaaggagtatggagacataaatgacaaagaaagagacggaaatccaaggatgaaatatccccagacctggaaagccagtcagtagaaaaggggcagcactgatgttggaccacat

SEQ ID NO: 3382 - protein, 255 aa, Felis catus
MWSNISAAPFLLTGFPGLGIFHPWISVSFFVIYVSILLGNGTILYLIREDHTLHQPMYYFVALLAATDLGVTLTTMPTVLGVLWLGHRAISQGACYFQAYLIHSLSIVESGVLLVMAYDRFIAIHSPLRYTSILTNARVVKIGLGVLMRGFILIVPIIITLSGFPYCGSHVLSHAFCLHQDVIKLACADITFNRLYPIVLVSLTGFLDSVLILISYILILNTVMGIASGKEQAKALNTCVSHISCVLVFMSLLLG

SEQ ID NO: 3383 - DNA, 920 bp, Felis catus
atggttagtaaaaaggtgaagaaagccactccggatctgcttggtcttgacactatagatcataggattcattagtggagggaaaagaaaatatacatagctcatagtgaggtggacaatatgtggaacctgcttcccaaaccgatgaatcagagacaatccaatgactgtgacatagaaaaccaggacacagcagatatgggagacacaggtgttgaaggccttggccctctcttctttggaggcaattctcaggacactcttgagtatcaatacataggagatgaggatgatcagagaatccagcacaaatataaagactacaagcacaactggatacagtcgattgaaggtggtgtcagcacaggccagtttgatgacatcctggtgaaggcagaatgcatgagagaggacatgggaatggcaatagggaaaaaaataaaggggtacaattggagggataacagatacaaaccccctcagcagaactcccagtccaattttcagcacttgagtataagtgagtatggaggtatatctaagggggttgcgaatggcaataaaacgatcataagccatagcaagcaaaacaccagactctacaaaggcaagtgagtgtataaagtaggcttgagaaaaacaggctactttcccaatctccctgtgacccaaccagaggactctgagcaccgtaggcatcgtggtcaaggtcagccctaagtctgtggctgctagcatggccaggaaatagtacataggttcatgaagattgggatcttccttaatgagaaggaggagggtgctgttgcctaaaaggacagagatgtagatgaaaaagaagggtgtggaaatccagtggtgagctgcctccaagcctgggaaaccagtcaacaggaaggaactggaattgccgttcggcc

SEQ ID NO: 3384 - protein, 306 aa, Felis catus
PNGNSSSFLLTGFPGLEAAHHWISTPFFFIYISVLLGNSTLLLLIKEDPNLHEPMYYFLAMLAATDLGLTLTTMPTVLRVLWLGHREIGKVACFSQAYFIHSLAFVESGVLLAMAYDRFIAIRNPLRYTSILTYTQVLKIGLGVLLRGFVSVIPPIVPLYFFPYCHSHVLSHAFCLHQDVIKLACADTTFNRLYPVVLVVFIFVLDSLIILISYVLILKSVLRIASKEERAKAFNTCVSHICCVLVFYVTVIGLSLIHRFGKQVPHIVHLTMSYVYFLFPPLMNPMIYSVKTKQIRSGFLHLFTNH

SEQ ID NO: 3385 - DNA, 939 bp, Felis catus
atgtggctcaacaccaccacttccctgtttctgcttactggtttcccaggcatggagaaggcacaccactggatttccatcccattattaggggtttacgtctccatacttcttggtaatggcactcttctctttcttatcagggatgatcataaccttcacgagcccatgtactatttcttagctatgctggcagccacagaccttggagtgactttgaccacgatgcccacagttctgggcgttctatggttgaatcacagagagattggccatcaggcctgcttctctcaggcctactttatccacactctttctatcgtagaatctggtgttttgcttgccatggcctatgaccgcttcattgccatccgcaaccccttgagatatacttccatccttaccaacaccaaggtaatgaagattgggatgggggtattgacaagggctggtctgtcaatcatgccaataattatccgcctccactggtttccctattgtcgatcccatgtactctctcatgctttctgtctacaccaagatgtcatcaagttagcttgtgctgacatcaccttcaatcgtctctatccagttgtggttgtatttgcaatggtcttgttggactttcttatcatctttttctcctactttttgatccttaagactgtcatgggcattgcttctggagaagaaagggccaaggccctcaatacgtgcatttctcacatctgctgcatcctggtcttctatgtcactgtagttggtctaacatttattcataggtttggaaagcatgctcctcgtgtggtccacatcacaatgagctacatctacttccttttccccccttttatgaaccctgttatatatagcattaaaaccaagcagatccagagtggtataattcgtttattctctctgcctaactctagagcataa

SEQ ID NO: 3386 - protein, 312 aa, Felis catus
MWLNTTTSLFLLTGFPGMEKAHHWISIPLLGVYVSILLGNGTLLFLIRDDHNLHEPMYYFLAMLAATDLGVTLTTMPTVLGVLWLNHREIGHQACFSQAYFIHTLSIVESGVLLAMAYDRFIAIRNPLRYTSILTNTKVMKIGMGVLTRAGLSIMPIIIRLHWFPYCRSHVLSHAFCLHQDVIKLACADITFNRLYPVVVVFAMVLLDFLIIFFSYFLILKTVMGIASGEERAKALNTCISHICCILVFYVTVVGLTFIHRFGKHAPRVVHITMSYIYFLFPPFMNPVIYSIKTKQIQSGIIRLFSLPNSRA

SEQ ID NO: 3387 - DNA, 916 bp, Felis catus
aatgcccattatggagctcaacaccagtgccccaccctttctgctgaccggcttcgtgggcctggaaaaggctcaccactggatctctatcccgttatctgtcatctagattgccatacttcatggcaatggcattctcctatttctcatcagggttgaccataacctccacgagcccatgtactatttcttagccatgctggcaaccacagacctcgggatgaccctggttacaatgcctacagtgctgtgtgtgatgtggacaaatcatagggaaatcagccatggctcctgcttttgccaagcctgcttcatccacactttctctgtcatacagtctgggattttgcttgccaaggcctatgatcagtttgttgccatccacaacccactgagatatacttccattcttaccaacacccaaatgataaagattggagtgggggttttcatgaagggatttacagtcatcttgcctccaatattccctctcgattggttttcctattgcaggtcccatttcttctctcatgcattctgcctccaccaggatgtcatcaaattagcctgtgctgacatcaccttcaattgcctatatcctattgtgatggtattttctatggtcctaatggactgcctgataatcttttcttctatattttgattctcaaaactgtcatgagtattgcatctggagaggaggggtccaaggcactcaacaaatgtgcctcccacatctgctgtatcttggtcttctatgtcactgttttggtttgacattcatctaccgatttgggaagaaatggtccccatctagtacacatcacaaatagctacatctacttcctttcccttcttttatgaaccctgtcatctgtagtattaaaactaagcagattcacagtagtattctcca

SEQ ID NO: 3388 - protein, 52 aa, Felis catus
NAHYGAQHQCPTLSADRLRGPGKGSPLDLYPVICHLDCHTSWQWHSPISHQG

SEQ ID NO: 3389 - DNA, 812 bp, Felis catus
acaattggaggggcatgcttggcaaagcggtgagtcatggaaagtcccaccaagggcacatagaggaccagaacagccagaatgtgggacagacagttattgagagcctggaaactttcaccctgggagctgattctcaagacacttctcagaatgagtgcataggagaccacaatgagcagggggtccaatgtagtaaagaccagagctataacaaatccataccaattattgatagtggtatcagcacacaccaggcgaatcatgtcttgatgaaggcagtaggagtgggagagatggtgggagccacaaaatggaagccgtttcagtaggaataatgcaggaagaacagtcagaacacagcggaaaatgatggctatccctattcttctgatgacccggttggtaaggatggagacataatggagggggcggcagatggccacatagcggtcaaaggacatggccaacaacacggaagattccataaaagagaatccatggaggaagaagaactgggcaaaacaagcctcaaagctgatctctgaggcattaaaccagaggagtcccatgactgtaggcaaagtggtgagggtaagccccaggtctgttagagccaaaatagagaggaacaagtacatgggctcttgtagggagggctctatcctgatgacagccaggatggtgatattgcccacaatggagaccgtgtagagacaacagaaggggatggaaatccagccatgggaaacctcaaagccagggatgcccatgaggatgaagaagaaggggacttgagtggagttagtaac

SEQ ID NO: 3390 - protein, 271 aa, Felis catus
VTNSTQVPFFFILMGIPGFEVSHGWISIPFCCLYTVSIVGNITILAVIRIEPSLQEPMYLFLSILALTDLGLTLTTLPTVMGLLWFNASEISFEACFAQFFFLHGFSFMESSVLLAMSFDRYVAICRPLHYVSILTNRVIRRIGIAIIFRCVLTVLPALFLLKRLPFCGSHHLSHSYCLHQDMIRLVCADTTINNWYGFVIALVFTTLDPLLIVVSYALILRSVLRISSQGESFQALNNCLSHILAVLVLYVPLVGLSMTHRFAKHAPPIV

SEQ ID NO: 3391 - DNA, 960 bp, Felis catus
atgctcttatccaacattactcagtttagtcccatgttctacctcactggctttcctggattggacaccatcgaacactggattttcatcccctttttccttatgtaccttgtggccatctcgggcaattgtttcattctgatagttattaagaccaaccctcgtctgcacagacccatgtactatctactctcttttctggccttcactgacctgggactgtcagtgtctaccttgcccaccactatgggaatcttttggttcaaatctcatggtatctactttgtggcttgtcagatccagatgttctgtatccactcattttccttcatggagtcctcagtgctccttattatgtcctttgaccgctttttggctatctgccacccccttaggtactcggtcattatcactagccagcgagtgatcagggcaggtctggctgtcatcttccggggacctgtggccctagttccccttgtcctcctcctgaagacttttccctactgtgggcctcgagtcctttcccattctttctgcctacaccaggaagtgatacacttggcctgcacagataccaccttcaacaacctgtatgggctggcagtggtggtgttcactatgatgttggacctggtgctcattgcactgtcttatggggtcatcctgcacaccgtggcaagactggcctcccaagaggagcagctccgagccttccaaacatgtacctcacacctctgtgctgtactgatattctttgtgcctatggtggggctgtccctcgtgcaccgctttgggaagcacgtcccacttgctgtccaccttctcatggccaatgtctatctctttgtgcctcctatgcttaatccaatcatatacagtattaagaccaaggagatccgccacatcatcagcaaactcctcggtcttaagaacgtcagtactaagtcttggagctaa

SEQ ID NO: 3392 - protein, 319 aa, Felis catus
MLLSNITQFSPMFYLTGFPGLDTIEHWIFIPFFLMYLVAISGNCFILIVIKTNPRLHRPMYYLLSFLAFTDLGLSVSTLPTTMGIFWFKSHGIYFVACQIQMFCIHSFSFMESSVLLIMSFDRFLAICHPLRYSVIITSQRVIRAGLAVIFRGPVALVPLVLLLKTFPYCGPRVLSHSFCLHQEVIHLACTDTTFNNLYGLAVVVFTMMLDLVLIALSYGVILHTVARLASQEEQLRAFQTCTSHLCAVLIFFVPMVGLSLVHRFGKHVPLAVHLLMANVYLFVPPMLNPIIYSIKTKEIRHIISKLLGLKNVSTKSWS

SEQ ID NO: 3393 - DNA, 953 bp, Felis catus
atgaagaactctaatagctctttggagttcttacctacaacgttcattctgattggcatcccaggactggaggcagagcacctctggatatccatccccttctgcctgatgtacactatcatcttccttgggaatggcaccatccttcatgtcatcagaacagacactgccctacaccagcccatgtacctccttcttgccatgttggcactcgctgaggttggtgtctctgcatctactctgcctacggtgctaggcatcttcctttttggcatcactgagattagttttgatgtatgcctttttcagatgtttttcatccattcattctccattatggagtcagctgtgttgctggccatgtctgtggaccgatttgtggccatctatagcccactgcgctatacagccattctaaccctgccccgtatctttggcacaggagctgtcatggggctgaaaagcattatgctcatggccccattgcccatgctgttaaggcgcctgcccttctgtggccacaacgtcctctcccattcctattgcctccaccccaaccttatccatctaccttgcggggacatttctatcaacaatatctatgggcttttcattgttacctccacttttgggctggattcactgcttattgtcatctcctatgggctcatactccacactgtaatgagtatcaccactggggaggggcggaggaaggcactcaacacatgtggctcacatatctgtgctgtgctcgcttactatgtgcctatgattggcttatctatggtgcaccgctttggacaccacgtgtcccctttgctgcatgctatgatagccaatgcttatctcttcttcccacctgttgtcaaccccattgtctacagcattaagaccaaggagatccatcgtggcattgtccgaatgttctcagagaaaagagccagagttta

SEQ ID NO: 3394 - protein, 318 aa, Felis catus
  MOD_RES (318)..(318): Any amino acid
MKNSNSSLEFLPTTFILIGIPGLEAEHLWISIPFCLMYTIIFLGNGTILHVIRTDTALHQPMYLLLAMLALAEVGVSASTLPTVLGIFLFGITEISFDVCLFQMFFIHSFSIMESAVLLAMSVDRFVAIYSPLRYTAILTLPRIFGTGAVMGLKSIMLMAPLPMLLRRLPFCGHNVLSHSYCLHPNLIHLPCGDISINNIYGLFIVTSTFGLDSLLIVISYGLILHTVMSITTGEGRRKALNTCGSHICAVLAYYVPMIGLSMVHRFGHHVSPLLHAMIANAYLFFPPVVNPIVYSIKTKEIHRGIVRMFSEKRARVX

SEQ ID NO: 3395 - DNA, 949 bp, Felis catus
atgtccaaggtgacgaacagcacccaagcacccttctacttcatcctcaccggcatccctggatttgaggcctcccacatctggatctccattcccttctgctgcctctacaccatctccatcatgggtaacaccaccattctcacggtcatccgcaaggaaccatccctccaccagcccatgtacctatttctctccatgctggccctgaccgacctgggcctcaccctcaccaccctgcccacagtcatgcagctcctctggttcaacattcatgagatcagctttgaagcgtgttttgcacagttatttttcattcatacattctcctttatggaatcttctgtgttgttggccatgtcctttgatcgctatgtggccatctgccgccccctgcattatacctccatcctcaccggtgaagtcattggcaagatcggcttagccatcatttgccgctgtgtcctggctgttctcccttccctcttcctactcaagcgcctgcccttctgccgctcccaccttctctctcactcctattgcctccaccaggatatgatccgcctcgtctgtgctgacatccgggtcaatagctggtatggatttgctcttgttttgctcattattgtgatggaccctttgctcattgtgctctcctacacactcatcctgaagagtatcttgggcacagcctcctggactgagcggttccgggccctcaaaaactgtctatcccatgtgctggctgttctggtcctttatgttcccatggttggagtatccatgactcatcgatttgccaagcatgcctctccgctggtccatgttatcatggccaatatctacctgttggcaccgcctgtgatgaaccccatcatttacagtgtcaagactaagcagatccgtcagggaattatctgcctcctttcccaaagagatatgtgcttaa

SEQ ID NO: 3396 - protein, 317 aa, Felis catus
  MOD_RES (317)..(317): Any amino acid
MSKVTNSTQAPFYFILTGIPGFEASHIWISIPFCCLYTISIMGNTTILTVIRKEPSLHQPMYLFLSMLALTDLGLTLTTLPTVMQLLWFNIHEISFEACFAQLFFIHTFSFMESSVLLAMSFDRYVAICRPLHYTSILTGEVIGKIGLAIICRCVLAVLPSLFLLKRLPFCRSHLLSHSYCLHQDMIRLVCADIRVNSWYGFALVLLIIVMDPLLIVLSYTLILKSILGTASWTERFRALKNCLSHVLAVLVLYVPMVGVSMTHRFAKHASPLVHVIMANIYLLAPPVMNPIIYSVKTKQIRQGIICLLSQRDMCLX

SEQ ID NO: 3397 - DNA, 940 bp, Felis catus
atttcctcttgcaggagaacaaggtgaaaatcccctgtcggattggcttggtcttgacactgtagatgatggggttgagcacaggaggcacaaagaggtagacgctagacatgagtgtgtggaccaggggtgaggcatgcttggcagcacgatgcatcacagacacaccaatcatgggcacgtagtacatgagcactgcgcagatatgtgacacacacgtgttgagggccttccgccgtccctccccagaagcaatgcccagcactgtgtaaagaatcagcacataagagacaatgataagcagtgagtccagcccaaaagtggccaggacgatggccaaacccaggatgctactgagcttcgtatcaccacaaggcagctggatcaggtctgagtggaggcagtaggaatgggagagtacattggtgtgacaatagggcagttgtttcaaaaggactggaagtggggccatgagcatcacactcttcagtgtgatgcccagacccatgcaaatgatacgtggcagggttaggatggctgtatatcgcagtggactgtagatggctacaaagcggtcataactcatggccaacaggacccctgattccatgcaggagaaagtgtggatgaagaacatctgagccaggcagccatccaggtcaatccggcgggcatcaaaccaaagaatacccatgacagtgggcagtgtagacacagaaacacccacctctgtcacagccaacatggagagaaacaagtacatgggctcgtgaagggcagggtctgcctgcactgctgccatgattaggttgttacccacaatggccacaatatacacagtgaagaaaggaatggaaagccagccatgttgggcctccaatcctgggatgccagtcaggaagacggataggtcaagacttccattgctttcagctcccat

SEQ ID NO: 3398 - protein, 314 aa, Felis catus
  MOD_RES (314)..(314): Any amino acid
MGAESNGSLDLSVFLTGIPGLEAQHGWLSIPFFTVYIVAIVGNNLIMAAVQADPALHEPMYLFLSMLAVTEVGVSVSTLPTVMGILWFDARRIDLDGCLAQMFFIHTFSCMESGVLLAMSYDRFVAIYSPLRYTAILTLPRIICMGLGITLKSVMLMAPLPVLLKQLPYCHTNVLSHSYCLHSDLIQLPCGDTKLSSILGLAIVLATFGLDSLLIIVSYVLILYTVLGIASGEGRRKALNTCVSHICAVLMYYVPMIGVSVMHRAAKHASPLVHTLMSSVYLFVPPVLNPIIYSVKTKPIRQGIFTLFSCKRKX

SEQ ID NO: 3399 - DNA, 945 bp, Felis catus
tcagctctgggatttatagaggactttgaggatccctctgcgtatctcctttgtcttcacactgtagatgatggggttgagcatggggggtacaaacaggtagacattggacatcatgacatgaacaacaggtggggcactcttccagaagcggtggatcatggagacagtaattatgggcacataaaaagccagcactgcacagatgtgtgacatgcaggtgttgaatgccttgagccgctgctcctgagatgcgatggccagcacggctctgaggatcaatgcataagaaagcaggatgaacgctgagtctacaccataggtgaaaatgaccacaaaaagtccatagatgttgttaacatgggtgtctccacacgccactctcatgagatctggatggaggcagtatgagtgatgcagaactttgcccttgcagaagggcagccgttttaccaaaaaggggaaagggaaaagagtgatgaaacttttggtgaggatgcccagacccatagccaggatgcggctgttggtgagcacagtggcatagcgcagtgggtcacaaacagccacaaaacgatcaaagctcatggccagcagtatgcctgattccatgaaagagaaagtgtggatgaagaacatctggaccaagcaggcatcgaagccaacatggcggtggttgaagcagaaggtagcaagcacagtgggaagtgtagacaaggacactcccagatcgttgagagagagcatagagaggaagcagtacatgggctggtgcagagcaggctcctgaaccaccagagcgaggatgctgaggttgcctatgatggaaatcaggtagaggatgcagaaaaccagggcaacccaggcatggcctgtctgcatcccaggaatgcctgtgagctggagtgtggctggctggaagggggtaccattgacactcaacat

SEQ ID NO: 3400 - protein, 314 aa, Felis catus
MLSVNGTPFQPATLQLTGIPGMQTGHAWVALVFCILYLISIIGNLSILALVVQEPALHQPMYCFLSMLSLNDLGVSLSTLPTVLATFCFNHRHVGFDACLVQMFFIHTFSFMESGILLAMSFDRFVAVCDPLRYATVLTNSRILAMGLGILTKSFITLFPFPFLVKRLPFCKGKVLHHSYCLHPDLMRVACGDTHVNNIYGLFVVIFTYGVDSAFILLSYALILRAVLAIASQEQRLKAFNTCMSHICAVLAFYVPIITVSMIHRFWKSAPPVVHVMMSNVYLFVPPMLNPIIYSVKTKEIRRGILKVLYKSQS

SEQ ID NO: 3401 - DNA, 923 bp, Felis catus
atgggactgttcaatgtcactcatcctgcttccttcctcctgaccggcatccctggtctggagagctctcacgcctggctagcagggcccctctgtgtcatgtatgctgtggccctcggaggcaacactgtgatcctgcaggccgtgcgagtggagcccagcctccatgagcccatgtactacttcctgtccatgctgtccttcagtgacgtggccatgtccatggccacactgcccaccgtgctcagaaccttctgcctcaatgcccgcaacattgccttcgatgcctgcctgattcagatgtttctcattcattccttctccatgatggagtcgggcattctgctggccatgagctttgatcgctatgtggccatttgtgatcccttgcactatgccgccgtgctcaccaatgaagtcattgccggaataggcatagctgtggctgctcggagcttcatcaccctccttccccttctcttcctcttcaagaggctgcctatctgcagatccaatgttctttcccactcctactgccttcacccagacatgatgaagctggcctgtgctgatatcactatcaacagcatctatggattctttgttcttgtatctacctttggcatggacatgtttcttatcttcctctcctatgtgctcattctgcactcggtcatggccatcgcttcccgagaggaacgcctgaaagttctcaacacatgcatgtcacatatcttggctgtacttgtgttttacgtaccgatgattggggtctccacagtgcaccgctttgggaagcatgccccgcgctatgtacatgtcctcatgtccaatgtttacctctttgtacctcctgtgctcaaccctctcatttacagcgccaagacaaaggagatccgccgaaccattgtccgtatgtttcg

SEQ ID NO: 3402 - protein, 308 aa, Felis catus
MGLFNVTHPASFLLTGIPGLESSHAWLAGPLCVMYAVALGGNTVILQAVRVEPSLHEPMYYFLSMLSFSDVAMSMATLPTVLRTFCLNARNIAFDACLIQMFLIHSFSMMESGILLAMSFDRYVAICDPLHYAAVLTNEVIAGIGIAVAARSFITLLPLLFLFKRLPICRSNVLSHSYCLHPDMMKLACADITINSIYGFFVLVSTFGMDMFLIFLSYVLILHSVMAIASREERLKVLNTCMSHILAVLVFYVPMIGVSTVHRFGKHAPRYVHVLMSNVYLFVPPVLNPLIYSAKTKEIRRTIVRMFR

SEQ ID NO: 3403 - DNA, 937 bp, Felis catus
taggcttaaaaaacattttgtgtagcctcttacgaatttctttagtcttaatggaatagataattgggttgagcattggaggcacaaagagatataccagggacattaacttgtgcacatactcaggggcatgcttcccaaatcgatgaaccatggacacactaaccatgggtacatagaagatgagcacagcacagatgtgtgacacacatgtattgagtgtcttaagcctctcctcctgggaggcaatggccagtacagagcgcagtatgagcacataggagaggaggatgagcactgagtctacaccaaaggcggagataacaatgaacaagccatacatgctattgatggtggtatctccacagggcaggcggatcaggtctgggtgcaaacagtaggaatgggttaacacattggccttacagaaaggcagcctcttcagaaggaatggcaatggaaagaccatgcagaagctgcggatgatgatggatatgcccatgtgagccacacggatatcagtgagcactgaagaataacgcaaggggttacagatggccacatagcgatcaaaactcatggccagcaggatcccagattctgtccaggagaaaaggtggatgaagaacatctgggtcaagcaggcgtcgaaggcagtctccggggcatgaaagcacaaggcagccagtacggtgggcaatgtagaaaaggacacgcccaggtcattgacagacaacagagacaggaagtagtacataggctggtgcaagctctgctcctcctttatgatgaagagaattaggatgttacccaggatggagacagcataaagcagcaagaggagggccgctaaccagtgctgtaggccctccatctctgggaagcctgttagtgtgaagctggtggtgctagaggtattagtcccaaaacttcccat

SEQ ID NO: 3404 - protein, 313 aa, Felis catus
  MOD_RES (313)..(313): Any amino acid
MGSFGTNTSSTTSFTLTGFPEMEGLQHWLAALLLLLYAVSILGNILILFIIKEEQSLHQPMYYFLSLLSVNDLGVSFSTLPTVLAALCFHAPETAFDACLTQMFFIHLFSWTESGILLAMSFDRYVAICNPLRYSSVLTDIRVAHMGISIIIRSFCMVFPLPFLLKRLPFCKANVLTHSYCLHPDLIRLPCGDTTINSMYGLFIVISAFGVDSVLILLSYVLILRSVLAIASQEERLKTLNTCVSHICAVLIFYVPMVSVSMVHRFGKHAPEYVHKLMSLVYLFVPPMLNPIIYSIKTKEIRKRLHKMFFKPX

SEQ ID NO: 3405 - DNA, 909 bp, Felis catus
tagtattttgcaaagcctccgacgaatctctttggttttgatggaataaataatggggttgagcataggaggcacaaagagatagatcagggacatgagtgtatgtacatactgtggggcatgcctcccatagcgagcaaccatggacacaccaaccatgggcacatagaacatgagcacagcacacaagtgagacacacatgtattcagtgtcttaagtctttcctcccaggatgcaatgacaagtacagagcgcagtatgagcacgtaagaaagaagaatgagtgcagaatccagaccaaagttacagatgacaatgaattgaccataaatattattgatggtgatgtcaccacagggcaagcggatcagatctggatgcaggcagtaagcatgggagagtacattggccttgcagaagggcaacctcttcagaaggaaaggcagtgggaaaaccacacagaaactgcggatgataacagccatgcccatacacaccacacaggcaccagtaagaactgtggcataacgcagtgggttacagatggccacatagcggtcaaagctcataaccaacagaatccccgactctatgaaggagaagaggtggataaagaacatttgagccatgcaagaatcaaagctgatcttctgtaagtggaagcaaaatgtggccaacaccgtgggcagtgtggaaaaggacacacctaggtcattaactgatagcagggacaagaaatagtacataggctgatgcaaactctgttcctccttgataatgaaaaggataagggcatttcccacaatggagacagtgtagagggtaccaaggagcagaaacacatagtgttgggaggtccccagccctgacaaccctgtcagggtaaagggaggcaactctgagctgtt

SEQ ID NO: 3406 - protein, 303 aa, Felis catus
NSSELPPFTLTGLSGLGTSQHYVFLLLGTLYTVSIVGNALILFIIKEEQSLHQPMYYFLSLLSVNDLGVSFSTLPTVLATFCFHLQKISFDSCMAQMFFIHLFSFIESGILLVMSFDRYVAICNPLRYATVLTGACVVCMGMAVIIRSFCVVFPLPFLLKRLPFCKANVLSHAYCLHPDLIRLPCGDITINNIYGQFIVICNFGLDSALILLSYVLILRSVLVIASWEERLKTLNTCVSHLCAVLMFYVPMVGVSMVARYGRHAPQYVHTLMSLIYLFVPPMLNPIIYSIKTKEIRRRLCKIL

SEQ ID NO: 3407 - DNA, 948 bp, Felis catus
tcaggacttaaccctaaagagcatcttgaggagcctgcgacgtatctcctttgtcttaatggagtagatgataggattgagcatgggaggcacaaagaggtagagaatagacatgaggatatagacagcatggggcaggccagcatcaaaacgatgcacaatggacacacttaccatgggcacatagaagatgagcacagctaggatgtgggacacacatgtgttcagtgtcttgatgcgcttttctccggaggcaatggcaagcactgatcgcaagattagtacataggagaggagaatgagtgcagagtccaggccaaaggtgaatagcacaatggacagcccatagtggctattgagggagacatcagtacatgccagcttaatcatatccacatgaaggcagtaggcatgggagaggatgttctgggagtggcagaaggggagtctgtgcagcagcagtgggaagacaaggataagggcaaagcttcggaggacagcacacagtcccattgccacaatgcgggcattagtgagcactgtagcatagcgcagtgggtggcagatggcaacatagcgatcaaagctcatagccagaaggatgccagactctgtccaagagaagaggtggatgaaaaacatttgggccaagcaggcattaaaggcaatcaccctggcatggaaacagagggcagccagcacggtcggcaatgtggaaaaggacactcccaagtcattgactgaaagtagagataaaaagtagtacatgggctggtgcaagctctgctcctccttaacaatgaggaggatcagggtgtttcccacaatggagatggtgtagagcagcagaagagggaaggatagccaggattccatggtttccattcctgggaagcccgtcaagataaaggtgggagcatcagaggcattgattttgaagttacccat

SEQ ID NO: 3408 - protein, 315 aa, Felis catus
MGNFKINASDAPTFILTGFPGMETMESWLSFPLLLLYTISIVGNTLILLIVKEEQSLHQPMYYFLSLLSVNDLGVSFSTLPTVLAALCFHARVIAFNACLAQMFFIHLFSWTESGILLAMSFDRYVAICHPLRYATVLTNARIVAMGLCAVLRSFALILVFPLLLHRLPFCHSQNILSHAYCLHVDMIKLACTDVSLNSHYGLSIVLFTFGLDSALILLSYVLILRSVLAIASGEKRIKTLNTCVSHILAVLIFYVPMVSVSIVHRFDAGLPHAVYILMSILYLFVPPMLNPIIYSIKTKEIRRRLLKMLFRVKS

SEQ ID NO: 3409 - DNA, 945 bp, Felis catus
aacatcagtgatgacagtctcccaggcacactcatccttactgggatcccaggactggagtgggcccacgtctggatcgccatccccttctgcaccatgtatctggtagcgctgactgggaatgctgccctcatccttgtcattgtgacagacagggctcttcatgcacccatgtacctcttcctgtgccttctctcactcactgacctggctctcagctccactactgtgcccaagacattagccattttgtggttttatactggagagatttcctttggtggatgcctggcccagatgttttgtgtccattctatctatgctctagagtcctcagttcttctcgccatggcctttgatcgctatgtggctatctgcaacccactgagatacacaactattctcaaccatactgtcataggcaaaattggacttgccagcatattccgtagcatagtttttgtctccccattcatcttcttgttgaggcgactgccttactgtggtcaccatgtcatggcccacacatactgtgagcacatgggcatcgctcgcctggcctgtgccaacatcactgtcaatattgtctatgggctgactgtggccctgttggccgtgggtctggattccatcctcattgccatttcctacggctttatcctccatgctgtcttccgccttccatctcaagatgccaggcacaaggctctgagtacctgtggctcccacctgggggtcatcttggtcttctacattcctgccttcttctccttcctcacccaccgttttggccagcaccgagtccccaagaatgtgcacatttttctggccaacctgtatgtgctggtgcctcctgtgctcaacccgatcatctatggggctaggaccaaggagattcggagccgacttctgaggctgcttcacttgaggagggtctcagtatga

SEQ ID NO: 3410 - protein, 314 aa, Felis catus
NISDDSLPGTLILTGIPGLEWAHVWIAIPFCTMYLVALTGNAALILVIVTDRALHAPMYLFLCLLSLTDLALSSTTVPKTLAILWFYTGEISFGGCLAQMFCVHSIYALESSVLLAMAFDRYVAICNPLRYTTILNHTVIGKIGLASIFRSIVFVSPFIFLLRRLPYCGHHVMAHTYCEHMGIARLACANITVNIVYGLTVALLAVGLDSILIAISYGFILHAVFRLPSQDARHKALSTCGSHLGVILVFYIPAFFSFLTHRFGQHRVPKNVHIFLANLYVLVPPVLNPIIYGARTKEIRSRLLRLLHLRRVSV

SEQ ID NO: 3411 - DNA, 945 bp, Felis catus
aacatcagtgatgacagtctcccaggcacactcatcctgacgggcatcccagggctggagtgggcccacgtctggatcgccatccccttctgcgccatgtatctggtagcactggctgggaatgctgccctcatcctggtcattgtgacagacagtgctcttcatgcacccatgtacctcttcctgtgccttctctcactcactgacctggctctcagctctgtcactgtgcccaagatgctggccattttgtggcttcatgctggagagatttcctttggtggatgcctggcccagatgttttgtgtccattctatctataccctggagtctttagttcttcttgccatggcctttgatcgctacgtggccatctgcaacccactgagatacacaaccattctcaaccatacagtcataggcaaaattggccttgctgggctgtgccgtagtgtggccattgtgtccccgttcatcttcttgttgaggcgactgccttactgtggtcaccatgtcatggcccacacatactgtgagcacatgggcatcgctcgcctggcctgtgccaacatcactgtcaatattgtctatgggctgactgtggccctgctggccatgggtctggatgccatcctcattgccatttcctacggctttatcctccatgctgtcttccgccttccatctcaagatgccaggcacaaggctctgagtacctgtggctcccacctgggggtcatcctggtcttctacattcctgccttcttctccttcctcacccaccgctttggccagcaccgagtccccaagaatgtgcacatttttctggccaacctgtatgtgctggtgcctcctgtgctcaacccgatcatctatggggctaggaccaaggagattcggagccgacttctgaggctgctacatatgaggaaggtctcattgtga

SEQ ID NO: 3412 - protein, 314 aa, Felis catus
NISDDSLPGTLILTGIPGLEWAHVWIAIPFCAMYLVALAGNAALILVIVTDSALHAPMYLFLCLLSLTDLALSSVTVPKMLAILWLHAGEISFGGCLAQMFCVHSIYTLESLVLLAMAFDRYVAICNPLRYTTILNHTVIGKIGLAGLCRSVAIVSPFIFLLRRLPYCGHHVMAHTYCEHMGIARLACANITVNIVYGLTVALLAMGLDAILIAISYGFILHAVFRLPSQDARHKALSTCGSHLGVILVFYIPAFFSFLTHRFGQHRVPKNVHIFLANLYVLVPPVLNPIIYGARTKEIRSRLLRLLHMRKVSL

SEQ ID NO: 3413 - DNA, 949 bp, Felis catus
atgtcagcttccaacatcagtgaggatagtctcccaggcacactcatcctgacgggcatcccagggctggagtgggcccatgtctggatcgccatccccttctgcgccatgtatcttgtagcgctggctgggaatgctgccctcatcctggtcattgtgacagacagtgctcttcatgcacccatgtacctcttcctgtgccttctttcgctcaccgacctggctctcagctccaccacggtgcctaagatgctgtccactttatggctgcatgctggagagatttcctttggtggatgcctggcccaaatgttttgtgtccattctatctatgctctggagtcctcagttcttctagccatggcctttgatcgctacgtggcaatctgcaacccactgagatacacaactattctcaaccatagcatcataggcatgattagccttgttgggctattccgtagtgtggccattgtgaccccattcatcttcttgctgaggcgactgccttactgtggtcaccatgtcatggcccacacatactgtgagcacatgggcatcgctcgcctggcctgtgccaatatcactgtcaatattgtctatgggctgactgtggccctgctggccatgggtctggatgccatcctcattgccatttcctacggctttatcctccatgctgtcttccgccttccatctcaagatgccaggcacaaggctctgagtacctgtggctcccacctgggggtcatcctggtcttctacattcctgccttcttctccttcctcacccaccgctttggccagcaccgagtccccaagaatgtgcacatttttctggccaacctgtacgtgctggtgcctcctgtgctcaacccgatcatctatggggctaggaccaaggagattcggagccgacttctgaggctgcttcacttggggaaaattt

SEQ ID NO: 3414 - protein, 317 aa, Felis catus
  MOD_RES (317)..(317): Any amino acid
MSASNISEDSLPGTLILTGIPGLEWAHVWIAIPFCAMYLVALAGNAALILVIVTDSALHAPMYLFLCLLSLTDLALSSTTVPKMLSTLWLHAGEISFGGCLAQMFCVHSIYALESSVLLAMAFDRYVAICNPLRYTTILNHSIIGMISLVGLFRSVAIVTPFIFLLRRLPYCGHHVMAHTYCEHMGIARLACANITVNIVYGLTVALLAMGLDAILIAISYGFILHAVFRLPSQDARHKALSTCGSHLGVILVFYIPAFFSFLTHRFGQHRVPKNVHIFLANLYVLVPPVLNPIIYGARTKEIRSRLLRLLHLGKIX

SEQ ID NO: 3415 - DNA, 1020 bp, Felis catus
tcattcactgctatgggaggccctctcagggcttacaccccttatggccccgacccagcacaatcgaagcaagtgcctgagcctctgagcgatctgttgggtacgtactccatagaccacagggttcagggcagggggcaccaccacatacaggttagccagtaggatgtggatgtggccgggcaccgtgtggcggccgaaacggtgggccaggaaagagaagagagcgggtgtgtagaagagagtgatgacactggcatgggccccacaggtacccaaggctttgcagcgggcactgtgggacggcaggcgacagacagcacggagaatgaaggcataggaagtggcgatgagcccgaagtccagtgctggggatagaagtgtggtggctagtccgtaccaaacgttggggcgcgtgtcaccacatgccagccgagccacacccatgtgttcacagtaggtgtgggggagctcccgctgcccacagtaaggcagtctttggagcagggccacagggggtgccatgacacaggcaccacgggtcacggcagccaccgccactccacccaccacacgctgtgtcagcaatgccccatagcgcagaggctgacagatggccacatagcggtccacggccatggccaggagcactgaagattcagcaatgaaggccacatgggtaacaaagagctgagctaggcaggccgcaaaagagatctctgctgacaggccccacagcacagccagagctttgggtaccgtggatgtggccagaaccaagtcagcagctgccagaagccccagcagctggtacatgggtgcctgaagtgtcttatcagctgccaccagccccagtagaaggacattccctgccaaagccgccatgtacagcagacatacaggcaccgcaagccaggcatgcagggtctccagtcctggcacccccagcaggacaaagggaccgggcccagagatgagcacagtctggttgaaagcagccagtacaggatccatttccat

SEQ ID NO: 3416 - protein, 339 aa, Felis catus
MEMDPVLAAFNQTVLISGPGPFVLLGVPGLETLHAWLAVPVCLLYMAALAGNVLLLGLVAADKTLQAPMYQLLGLLAAADLVLATSTVPKALAVLWGLSAEISFAACLAQLFVTHVAFIAESSVLLAMAVDRYVAICQPLRYGALLTQRVVGGVAVAAVTRGACVMAPPVALLQRLPYCGQRELPHTYCEHMGVARLACGDTRPNVWYGLATTLLSPALDFGLIATSYAFILRAVCRLPSHSARCKALGTCGAHASVITLFYTPALFSFLAHRFGRHTVPGHIHILLANLYVVVPPALNPVVYGVRTQQIAQRLRHLLRLCWVGAIRGVSPERASHSSE

SEQ ID NO: 3417 - DNA, 931 bp, Felis catus
ccttggtggaaaacaaaaatatgaccttatctcggatctgcttggtcttcactccatagacaatggggttgagtgcagggggaataactatgtagaggttggcaaacaggatgtggaaagtgcgggagacattgtgcccaaagcgatgcgcaaggatggagaaaaaggcgggtgtataaaacatgaggatgacacagacatgggaaccacacgtgccaagggctttgtgacgggcatcccgggagggaaggcggaagacggcacggaggatgaggctgtaagaaacggcaatgagaatcacatctgagatgaccgtcatgatggggacaccaaagccataccagatgttgacggagatgtcagcacaggcgagccgggcaacacctatgtgctcacagtatgtgtgcggtatgatgcgtgtcctgcagaaaggcaggcgtgtgagcaagaatacaactggcaggataatgcagaagcttcgaaaggagatgcccactgcaatcttgatgatggtcctgggagtcagaatagtggtgtacctcaggggagagcagatggccacgtagcggtcaaatgccatggccatcaggatggctgaatccaggacaaagctgcagtgcagaaagaataactgggtcagacaaccaggaaaactgattttctggggaccaagccagaagatggtaagggttttggggacacaagtggtagacagtatcagatctgtcatggccagcatggaaaggaaaaagaacatgggtgcatgaagactatgttccacagcaatgaggtagagaaggatactattgcccacaatggccgcgagatagataaagcagaaggggatgctgatccagacgtggtactgcccgaggccagggatgcccaaaagggtgaagtcacctgtgtggtcgttactcaggttgtacat

SEQ ID NO: 3418 - protein, 311 aa, Felis catus
  MOD_RES (311)..(311): Any amino acid
MYNLSNDHTGDFTLLGIPGLGQYHVWISIPFCFIYLAAIVGNSILLYLIAVEHSLHAPMFFFLSMLAMTDLILSTTCVPKTLTIFWLGPQKISFPGCLTQLFFLHCSFVLDSAILMAMAFDRYVAICSPLRYTTILTPRTIIKIAVGISFRSFCIILPVVFLLTRLPFCRTRIIPHTYCEHIGVARLACADISVNIWYGFGVPIMTVISDVILIAVSYSLILRAVFRLPSRDARHKALGTCGSHVCVILMFYTPAFFSILAHRFGHNVSRTFHILFANLYIVIPPALNPIVYGVKTKQIRDKVIFLFSTKX

SEQ ID NO: 3419 - DNA, 843 bp, Felis catus
cacatgtggatctccatcgccttctgcctgatgtacctggttgctgtgtcaggaaatgttatcctgatctgtgtggtggcagtggagcaaagtcttcatgaacatatgtacctcttcctctctgtgttggctttttgggatctgattctatccacatccacagcacccaaagccctgagcatcttctgatttgatgatgtggacatctcttggtggctgtataacccagctcttctttatgcattttgcctttgtggtggaatcaggcattctcttggccatggtttttgatcactatgtggccatctgctacccacggaggtacaccatcattcttagccatggtgtcatcggcaaaatagggcgtgttgtagtgctcaggagttttgcaactgtttgcccctttatcttcctagtgaggagcctgctcttctgccagaaaaacatcattgcccacacgttctgtgaacacatggggctggctaagttggcttatgctgatatcaccgtcaacatttggtatggaatctctgtgccattactcagtgtaatgctagatatggtgacaatagtcatctcctataggctcattctccaggcggtcttcaggctgccatcccatgatgtgcagatgaaaacattcagcacctgtggttcccatgtctgtgtcatcctcatgttctaccttcctgggattgtcagtgtcattgctcaacactttggccgaaaaatccccaagcatgtccacatcctgttggctgatctctatgttctcgttctccccgtgatgaacccaattatctatggagtaaagaccaaacagatttgtgaaagagtggtctt

SEQ ID NO: 3420 - protein, 217 aa, Felis catus
  MOD_RES (217)..(217): Any amino acid
MMWTSLGGCITQLFFMHFAFVVESGILLAMVFDHYVAICYPRRYTIILSHGVIGKIGRVVVLRSFATVCPFIFLVRSLLFCQKNIIAHTFCEHMGLAKLAYADITVNIWYGISVPLLSVMLDMVTIVISYRLILQAVFRLPSHDVQMKTFSTCGSHVCVILMFYLPGIVSVIAQHFGRKIPKHVHILLADLYVLVLPVMNPIIYGVKTKQICERVVX

SEQ ID NO: 3421 - DNA, 949 bp, Felis catus
tcacttcatccctttaggaaagagtaggagaatgactttgtccctgatctgcttggtttttacaccataaatgatgggattgagtgcaggagggattgccacatagaggttggcaaatatgatgtgaaaggtgcaagagatattgtgtccgaagcgatgagtgaggacagagaatatggctggtgtgtagaatatgagaatgacacagacatgggaaccgcaggtgctgagggctttctggtgggcatctctggatggaagatggaaaacagcatgaaggatgagagcataggaaataccaatgaggaccaggtctgagataatagtcatcacaggcacagcaaaaccataccagatgttgatggagatgtcagcacaggcgagtcgggcaacccctatatgttcacagtatgtgtgagggatgatacgtgacttgcagaagggcaaacgcttcaccaggaaaacaacaggcaaaatgacaccaaagctccgacccacaatgcccaccatgatcttgacaattgtccttggtgtcaaaacacttgtgtatctcaaagggcagcaaatggccatgtaacggccaaatgccatgcccaacaaaatggcggagtccagaaaaaagctgaagtgaagaaagaacaactgggtaaggcaaccaggaaaagtgattttctgagctttcaaccagaatatgccaagtgttttggggacacacgtggtgcataatacgaggtctgcagaggccaacatggagagaaagaagaacatgggttcgtggaggctgtggtccacagtgatgaggtaaagaaggatgccattaccagcaagggccaccagatagatagtgaagaaaggaatcccaatccagatgtggaattgctccagccctgggatccccaccaaaatgaaagagcctggattgaaacttgtcagattcaatgtggccatc

SEQ ID NO: 3422 - protein, 315 aa, Felis catus
MATLNLTSFNPGSFILVGIPGLEQFHIWIGIPFFTIYLVALAGNGILLYLITVDHSLHEPMFFFLSMLASADLVLCTTCVPKTLGIFWLKAQKITFPGCLTQLFFLHFSFFLDSAILLGMAFGRYMAICCPLRYTSVLTPRTIVKIMVGIVGRSFGVILPVVFLVKRLPFCKSRIIPHTYCEHIGVARLACADISINIWYGFAVPVMTIISDLVLIGISYALILHAVFHLPSRDAHQKALSTCGSHVCVILIFYTPAIFSVLTHRFGHNISCTFHIIFANLYVAIPPALNPIIYGVKTKQIRDKVILLLFPKGMK

SEQ ID NO: 3423 - DNA, 981 bp, Felis catus
atggccctttcatctgccaggagcacggctgccgtgaacgactctgacactcgcacgacaggctgcctcctcactggcatccctgggctggagcacctgcacatctggctctccatccccttctgcgccatgtatgtagccgccctggcaggcaatggcattttaatttgtatcatcctctcacagccaagcctgcacgagcccatgtacatattcctgtccatgctggccagtgcagatatcttgctctccacttccacgatgcccaaaacactggccaacttctggctaggttccagccacatttcctttgatggctgcctcacccaaatgttcttcatccacttcctctttgtggccgactctgcagtcctgctggccatggcctttgaccgctttgtggccatctgctcccctctgcgatataccacagtcctcacgagcaccgtcattgggaagatcgtcgctgccaccctgacccgcagcctcatcatcatgtttccatccatctttcttctcaagcgcctgcactattgccggatcaacatcattgcacacactttttgtgagcacatgggcatcgcccgtctgtcttgttctgatatctccatcaatgtctggtacgggttggcagctgccctactctccacaggcctggacatcatccttatcgctgtttcctacattcacatcctacgagctgtcttccgcctcccttctcgaaatgcccggtccaaggccctgagcacatgtggctcccacgtctgtgtcatcctactcttctacatccctgcccttttctctgtctttgcctacaggttcggtgagagacgcatcccacgctatgtccatatcctcctggccaacctctatgtggtcatcccgcctatgcttaatcccattatttatggagcaaggaccaagcagatttgggaaggggctaaacagatgttttcacatcttgccaaggaatctaaataa

SEQ ID NO: 3424 - protein, 326 aa, Felis catus
MALSSARSTAAVNDSDTRTTGCLLTGIPGLEHLHIWLSIPFCAMYVAALAGNGILICIILSQPSLHEPMYIFLSMLASADILLSTSTMPKTLANFWLGSSHISFDGCLTQMFFIHFLFVADSAVLLAMAFDRFVAICSPLRYTTVLTSTVIGKIVAATLTRSLIIMFPSIFLLKRLHYCRINIIAHTFCEHMGIARLSCSDISINVWYGLAAALLSTGLDIILIAVSYIHILRAVFRLPSRNARSKALSTCGSHVCVILLFYIPALFSVFAYRFGERRIPRYVHILLANLYVVIPPMLNPIIYGARTKQIWEGAKQMFSHLAKESK

SEQ ID NO: 3425 - DNA, 953 bp, Felis catus
taaaccacactgctgttagccatacaatcttccacttgctgggcatccccgggctagaggaccagcatgtgtggatttccatccccttcttcgtttcctatgtcatcgccctgcttgggaacagcctgctcatctgcattatcctcacaaagcagagcctccatgaacccatgtacctcttcctctgcatgctggccggagcagatgttgtcctctccacgtgcacagtacctcaggccttggccatcttctggttccgtgctggggagatctccctggatcgctgcataactcagttcttcatcatccactgcactttcatgtctgagtcggggatcttgctggtgatggcgtttgaccactacattgccatatgctacccactgagatacaccactattcttacacgtgcactgattggaaaaattggcgtgactataattctgaaaagtttctgtacacttttccccatagtatttcttttgaaaagattgactttctgccaaaataatattgttccacacaccttttgtgaacacattggcttggccaaatatgcttgtaatgacattcgtgtgaacatctggtatggattttccatcctaatattaacagtggttttagatgtggtgctaatttttgtttcctatgtgctgattctccgtgctgtcttccacatcccttcccaagatgctcgccacaaagctcttaacacatgtggctcccatgtctgcatcattgtcctcttttacagccctgcgatcttcacaacccttactcagcggtttggacgccacattcctcctcatacccacatcttgttggccaacatctgcatgcttgccccacctatgctgaatcccatcatttatgggattaagaccaagcaaatcagagagcaggtggttcacatgttgtttacaaagcagaaatcactttggttgaagaactga

SEQ ID NO: 3426 - protein, 316 aa, Felis catus
NHTAVSHTIFHLLGIPGLEDQHVWISIPFFVSYVIALLGNSLLICIILTKQSLHEPMYLFLCMLAGADVVLSTCTVPQALAIFWFRAGEISLDRCITQFFIIHCTFMSESGILLVMAFDHYIAICYPLRYTTILTRALIGKIGVTIILKSFCTLFPIVFLLKRLTFCQNNIVPHTFCEHIGLAKYACNDIRVNIWYGFSILILTVVLDVVLIFVSYVLILRAVFHIPSQDARHKALNTCGSHVCIIVLFYSPAIFTTLTQRFGRHIPPHTHILLANICMLAPPMLNPIIYGIKTKQIREQVVHMLFTKQKSLWLKN

SEQ ID NO: 3427 - DNA, 942 bp, Felis catus
atgcataatttgagctgctacaatcccagttcctttctccttgtgggaatacctggcctggacaagttccacatctggattgggattcccttttgtgtcatctatgttttggctattgtgggaaacttcatcctcctctacctcattgcaactgagcacagcctccatgagcccatgtttttcttcctagctatgctggctaccacggacctcatcctgtccactgccacagtgcccaaactgctcagtaacctctggctgggcttccaggaaataaccttctctggctgtctcacccagatgttcttcctccacttcagctttgtagtggactcagccatcctgttggccatggcgttcgatcgctatgtggccatctgcttccctttgaggtacaccaccatcctgactcggcaggtgatcatcaagctgatggtgagcattgttgtgaggagcttctctgtcatcttgccagatgtttttctgctgaaacggttacccttctgtgggacacgcatcataccgcacacatactgtgagcacataggtgttgctcggctttcctctgctgacatctccatcaacatctggtatggattttctgtccctctcatgactgtcatctcagatgtgatctttattgctgtttcctataccttcatcctccatgctgtctttcacctctcatcccagggtgcccgccaaaaggccctcagcacctgtggttcccatgtcagtgtcatcctcatgttttacacacctgccttcttctccatccttgcacatcgctttgggcacagtgtccctcgaaatgtgctcatcctatttgccaacctctatgtggccatcccccctgccctaaatcctgtggtctatggagtgaagaccaagcagatccaggacaaatttgttctcctcttttctttgaagaggacacactga

SEQ ID NO: 3428 - protein, 313 aa, Felis catus
MHNLSCYNPSSFLLVGIPGLDKFHIWIGIPFCVIYVLAIVGNFILLYLIATEHSLHEPMFFFLAMLATTDLILSTATVPKLLSNLWLGFQEITFSGCLTQMFFLHFSFVVDSAILLAMAFDRYVAICFPLRYTTILTRQVIIKLMVSIVVRSFSVILPDVFLLKRLPFCGTRIIPHTYCEHIGVARLSSADISINIWYGFSVPLMTVISDVIFIAVSYTFILHAVFHLSSQGARQKALSTCGSHVSVILMFYTPAFFSILAHRFGHSVPRNVLILFANLYVAIPPALNPVVYGVKTKQIQDKFVLLFSLKRTH

SEQ ID NO: 3429 - DNA, 937 bp, Felis catus
ccacattcaacttgagcagcttcaattcaggccctttcatcctactgggaatcccagggctggaggagttccatgtctggatcgggattccttttttcattatctaccttgtggcccttgcaggcaacagtgtccttctctaccttatttccatggaacgcagccttcatcagcccatgttctttttcctctccatgctggctgctacagatctcatcctatctaatacatgtgtacccaaaacattcagcatcttctggctaggtcctcaggaaatcaccttttctggatgccttactcaaatgttctttctccactatagctttgccatggattctgccatcctgttagccatggcatttgatcgctatgttgctgtttgcttccccctaagatataccactattcttacccgtcagattattactaaaattgtaatggctattgttagcaggagcttttgcatcatcttcccatgtgtgttcctattaaaacgactacctttttgccgaacactcatcatcccccacacgtactgtgagcacataggcatagcccagcttgcctgtgcggacatctccatcaacatctggtatggctttgctgtgcctgtaatgactgttacatcagacctgatcctcattggcatctcctacactctcatccttcgtgccatctttaatcttccatcccgagatgcccgccagaaagccctcaacacctgtggttcccatgtttgtgtcattcttatattctacacaccagcaatgttctctgtcctcacccaccgttttggtcacaatattcctcactccttccacatactgactgccaacctctacgtggccatccctcctgcactcaatccaatcatctatggggtgaagaccaagcagattcgggaaaaaatcatcctacccttcttccctaaagggaa

SEQ ID NO: 3430 - protein, 312 aa, Felis catus
  MOD_RES (312)..(312): Any amino acid
TFNLSSFNSGPFILLGIPGLEEFHVWIGIPFFIIYLVALAGNSVLLYLISMERSLHQPMFFFLSMLAATDLILSNTCVPKTFSIFWLGPQEITFSGCLTQMFFLHYSFAMDSAILLAMAFDRYVAVCFPLRYTTILTRQIITKIVMAIVSRSFCIIFPCVFLLKRLPFCRTLIIPHTYCEHIGIAQLACADISINIWYGFAVPVMTVTSDLILIGISYTLILRAIFNLPSRDARQKALNTCGSHVCVILIFYTPAMFSVLTHRFGHNIPHSFHILTANLYVAIPPALNPIIYGVKTKQIREKIILPFFPKGX

SEQ ID NO: 3431 - DNA, 951 bp, Felis catus
atgctgtccacatctgtcatcaataacactgcctttcatccttccacatttattctacttggaatccctggaatgcaagatcagcatgtgtgggctgccatccccttctgctccatgtatatccttgctctggttggcaatggcaccatcctctacatcgtcatgacaaatagaactctacatgagccaatgtacctcttcctgtgcctgctttctatcactgacctggttctctgttcgaccacattgcccaaaatgttaacaatattttggtttaggtcccacataatttcctaccatggctgcctcacccagatgttttttgttcacactatttttgccacagagtcggctgttctactggccatggcttttgaccgctatgtggctatctgccatccacttcattatacatccatcctcaatgccacagtgattgggaagattggtctggcatgtgtggtccgtggccttatctttgttttcccctttgtcatcctcatcaaacgtttacccttctgtggacaccacatcatcccccacacttactgtgagcacatgggcattgccaagctcgcctgtgccagcatcaagcccaacaccatttatggactcactgtggcactttcagtcactggcatggatgtggtcctcatcaccacctcctacggcttgatcctgcgggctgtgctgcgcttgccctccaaggatgcccaattccgagcatttagcacttgtggagcccatatttgtgtgattctggttttctatgtacctgccttcttttcatttttcacccaccgctttggccaccaagtacctcctcatgtccacattgtacttgcaaatctctatctcctcgtgccccctgttcttaaccccctggtctatggcatcaataccaaacaaatccgcctaagaatatttggcttttttatgggaaggaggtag

SEQ ID NO: 3432 - protein, 316 aa, Felis catus
MLSTSVINNTAFHPSTFILLGIPGMQDQHVWAAIPFCSMYILALVGNGTILYIVMTNRTLHEPMYLFLCLLSITDLVLCSTTLPKMLTIFWFRSHIISYHGCLTQMFFVHTIFATESAVLLAMAFDRYVAICHPLHYTSILNATVIGKIGLACVVRGLIFVFPFVILIKRLPFCGHHIIPHTYCEHMGIAKLACASIKPNTIYGLTVALSVTGMDVVLITTSYGLILRAVLRLPSKDAQFRAFSTCGAHICVILVFYVPAFFSFFTHRFGHQVPPHVHIVLANLYLLVPPVLNPLVYGINTKQIRLRIFGFFMGRR

SEQ ID NO: 3433 - DNA, 978 bp, Felis catus
atgaccgtttgcaatgcgtccctgggtcacccacctttcttcattctccaaggcattcctgggatggaggacaagcacagatggatctctgtccccttctcttccatgtacttcatcaccatccttgggaactgcaccatcatcttcaccatctgcaccgagcgctccctgcacaaacccatgttccttctcctctgcatgttggccctcacagacctgggcatgtccactaccaccattcctaaggtgctgtgcatcttctggtttggccagagtgagatcagctatgtgggctgcctggtccaaatgttcttcatccacttcatatctgtgttgcagtcagccatcctgatgaccatggcctttgaccgctatgtagccatctgtgaacctctgcgttatgccaccatcctttccaatagtcgcattgggctcattggcctggtgagtttagtgagagccattcttttcattctgcccatgcctgtcctcctccagaagatgccctttcatgtaaatcacgtcatccccaccacctactgtgagcacatggctgtggtgaagatggtgtgtgtggacaccacagtcaacaggatatatggtctggtggtggccttgttggttatcgggctggacatctcagctattgcttcatcgtatgtgcttatcatccgggctgtactgcgactgtcttctaaggaagcccaccacaaagcagtcaacacctgcaccacacacatttgtgtcatgcttatctcatacactccctcgctgttctcttttctcactcaccgctttggtaggggaattgcaccccatgtgcacaccattcttgggaacctctacttccttgttcctccaatgctcaatcctattatttatgcagtgaaaaccaaagagtttcgggacaaattgaccaaatacgggtgctggaagaaggaccctgtaaccataacccatggtcagaagcctgtctga

SEQ ID NO: 3434 - protein, 325 aa, Felis catus
MTVCNASLGHPPFFILQGIPGMEDKHRWISVPFSSMYFITILGNCTIIFTICTERSLHKPMFLLLCMLALTDLGMSTTTIPKVLCIFWFGQSEISYVGCLVQMFFIHFISVLQSAILMTMAFDRYVAICEPLRYATILSNSRIGLIGLVSLVRAILFILPMPVLLQKMPFHVNHVIPTTYCEHMAVVKMVCVDTTVNRIYGLVVALLVIGLDISAIASSYVLIIRAVLRLSSKEAHHKAVNTCTTHICVMLISYTPSLFSFLTHRFGRGIAPHVHTILGNLYFLVPPMLNPIIYAVKTKEFRDKLTKYGCWKKDPVTITHGQKPV

SEQ ID NO: 3435 - DNA, 935 bp, Felis catus
ctatgcaggtcctctgcaaaggcatttggtcaccttgtgccatatttccttcatttttctaccatagatgatggggttgagcactgagggtagaagaaggtagagattggcaaggagaacacgagcatgaggtgggatactgtgaccaatgcggtgcatgagagacgaaaagagtgcaggaacataagtgacaagaatgacaaagaggtgagctgaacaggtgttgagagctttataggtagcatcttgagagttgagacataccagagcctgaagaatgaagccataagagaagccaatgagcagcagatcaagtcccaccactagcagaatcacaaagagcccatagatatggttaggtctggtatggtcacaggccattttcaccaaagccatgtggtcacagtaggtatgaggaatgaccatgtggcagaatgtcaacctttgaagtagaagtagcatgggtaggataagaatcacacccttgccagagccatcagtcccaggcatccaactaaggaatggctcagaattgtgttgtagcataacggctcacatacagccacaaagcggtcaaaggccattgcaacaagtaaggctgatcataccacagatgttctatggatgaaaaacatctgggtgaaacaggcattggcagctatatccccatcattgaaccagaagaggcaaaggaacttgggcaatagagccagagtagatatgaggtcagccaccatcagcaaggccaggagcaggtacattgggatgtgaaatgtgggctctgtggccaccagaaagagaatagcaccattgacaatgaggacagccaagaacatggaggagaaaggaataaataaccacaagtgctgtgactctaagcctggtatgcccatcaaagtgaagttcaggatgctggaatggttgaagattagcat

SEQ ID NO: 3436 - protein, 181 aa, Felis catus
MLQHNSEPFLSWMPGTDGSGKGVILILPMLLLLQRLTFCHMVIPHTYCDHMALVKMACDHTRPNHIYGLFVILLVVGLDLLLIGFSYGFILQALVCLNSQDATYKALNTCSAHLFVILVTYVPALFSSLMHRIGHSIPPHARVLLANLYLLLPSVLNPIIYGRKMKEIWHKVTKCLCRGPA

SEQ ID NO: 3437 - DNA, 962 bp, Felis catus
agtctcctaatgacactaacctggacccttctgttttcttcctcttgggcatcccaggtctggaacagttccacctctggctctcactccctgtgtgctgcctgagcacagccacagttgtgggcaacatcaccatcttggttgttgttgccactgagccagccctgcacaagcctgtgtacctgttcctgtgcatgctctcaaccattgacttggctgcctccttctccacagttcccaaactactggccatcctctggtgtgcagctggacacatctcagcctctgcttgccttgcacagatgttcttcattcatgctttctgcatgatggagtccactgtgctgctggccatggcctttgatcgctatgtggccatttgtcacccactccgctatgccactattctcactgacaccatcattgcccgcattggagtggtagctatggtgcggggctccatgctcatgctcccatgtcccttcctcattgggcgtttgagcttctgccaaagccatgtcattccacatacatactgtgaacacatggctgttgtgaagctagcatgtggagacaccaggcctaaccgtgtgtatgggctgacagcagcacttttggtcattggggttgacttgttctgcattggtctctcctatgtctttattgcaagatctgtccttcgtctctcatcccatgaagctcggtccaaggccctggggacttgtggttcccatgtctgtgtcatcctaatctcttatacaccagccctcttctccttctttacccatcgctttggccaccacgttccactccatattcacattcttttggccaatgtctatctactcttcccacctgctcttaaccctatagtatatggagttaagaccaaagaaatccgggaaaaggttgtcagagtgtttcaaaggggtcagggaattggggtcaaggtacctgagtga

SEQ ID NO: 3438 - protein, 319 aa, Felis catus
SPNDTNLDPSVFFLLGIPGLEQFHLWLSLPVCCLSTATVVGNITILVVVATEPALHKPVYLFLCMLSTIDLAASFSTVPKLLAILWCAAGHISASACLAQMFFIHAFCMMESTVLLAMAFDRYVAICHPLRYATILTDTIIARIGVVAMVRGSMLMLPCPFLIGRLSFCQSHVIPHTYCEHMAVVKLACGDTRPNRVYGLTAALLVIGVDLFCIGLSYVFIARSVLRLSSHEARSKALGTCGSHVCVILISYTPALFSFFTHRFGHHVPLHIHILLANVYLLFPPALNPIVYGVKTKEIREKVVRVFQRGQGIGVKVPE

SEQ ID NO: 3439 - DNA, 969 bp, Felis catus
atgatgctaatgttaaaccaaacagacctgaccccagcctcattcattcttaatgggatcccaggactggaggacatgcacatgtggatttctttcccattctgctccatgtatgctgtggcaatggtagggaattgtgggctcctctacctcatccacttagaggactccctgcacaggcccatgtattactttttagccatgctttccctaactgaccttttcatatgctctagtacaatccctaaagccctcagcatattctggttccatttcaaggaaatcagcttcgatggatgtctggtccaaatgttctttgtccacaccttcacagggatggagtctggggtgctcatgcttatggctctggaccgttatgtggccatctgctaccctctgcactattcaactatcctcaccaatcctgtcattgcaaaggttgggcttgctactttcctgagaggggtgttcctcatcattcccttcactttccttaccaagcgcctgccctactgcagagggaatataattcctcacacctactgtgaccacatgtctgtagctaagttatcctgtggaaatatcaaggtcaatgtcatctatggtctgatggttgccctcctgattgggggctttgacatcttgtgcatcacaatctcctacaccatgatcctccgggcagtggttagcctctcttcagcagatgctcggcagaaggctttcagcacctgcactgcccacatctgtgccattgttttctcctacagtccagccttcttctccttcttttcccaccgctttgggggccacacaattcctccatcttgtcatatcattgtggccaatatctatctgcttttgcctcccacgatgaatcccgttgtctatggggtgaaaaccaagcagatacgagactgtgtcatcaggatcctttcaggttctaagaacctcaaatcccacagcatatga

SEQ ID NO: 3440 - protein, 322 aa, Felis catus
MMLMLNQTDLTPASFILNGIPGLEDMHMWISFPFCSMYAVAMVGNCGLLYLIHLEDSLHRPMYYFLAMLSLTDLFICSSTIPKALSIFWFHFKEISFDGCLVQMFFVHTFTGMESGVLMLMALDRYVAICYPLHYSTILTNPVIAKVGLATFLRGVFLIIPFTFLTKRLPYCRGNIIPHTYCDHMSVAKLSCGNIKVNVIYGLMVALLIGGFDILCITISYTMILRAVVSLSSADARQKAFSTCTAHICAIVFSYSPAFFSFFSHRFGGHTIPPSCHIIVANIYLLLPPTMNPVVYGVKTKQIRDCVIRILSGSKNLKSHSI

SEQ ID NO: 3441 - DNA, 969 bp, Felis catus
atgtctgcatctctgaaaggctctaatagctccaagttccaggtgtctgagttcatcttgatgggactcccaggcattcacagctggcaacactggctctccttaccattggcaatactctacctctcagcaattggtgctaatatcctcatcctcgtcaccatctgccaggaccctgctcttcagcagcccatgtactctttcctaggcatcctctctgtggtggacatgggcctggccaccaccatcatgcccaagatcttggccatcttctggtttgatgcgaaggtcatcagccttcctgagtgttttgctcagatctatgccattcactgctttgtgggcatggagtctggtatcttcctctgcatggcttttgatagatacatagctatttgtcaccctcttcgctacccatcaattgtcaccaaggcctttatcttaagagctactgtgttcatggtactaagaaatggcttgtttgtcattccagtgccagtgctagcagcccagcgtaattattgttccaggaacgagatcgagcactgcctgtgctctaaccttggggtcaccagcctggcttgtgatgacaggaggccaaacagcatctgccaattggttctagcatggcttgtaatggggagtgacctaggtcttataatattgtcatacattttgattctgcgctctgtacttaaactgaattctgctgaagctgcctccaaagctctgagcacttgtagctcccatctcatccttattctattcttctacactgttgttgtagtgatttcagtaactcatctggcagaaactaaggtccctttggttccagttctactcaatgtgctgcacaacatcatccccccttccctcaaccctatggtttatgcacttaggactaaagaacttagggcaggcttccaaaaggtgttttgtttgagcttagaaaagaaaacaaggcaccag

SEQ ID NO: 3442 - protein, 323 aa, Felis catus
MSASLKGSNSSKFQVSEFILMGLPGIHSWQHWLSLPLAILYLSAIGANILILVTICQDPALQQPMYSFLGILSVVDMGLATTIMPKILAIFWFDAKVISLPECFAQIYAIHCFVGMESGIFLCMAFDRYIAICHPLRYPSIVTKAFILRATVFMVLRNGLFVIPVPVLAAQRNYCSRNEIEHCLCSNLGVTSLACDDRRPNSICQLVLAWLVMGSDLGLIILSYILILRSVLKLNSAEAASKALSTCSSHLILILFFYTVVVVISVTHLAETKVPLVPVLLNVLHNIIPPSLNPMVYALRTKELRAGFQKVFCLSLEKKTRHQ

SEQ ID NO: 3443 - DNA, 966 bp, Felis catus
atgctaatgctgaataaaacaaactggactccagcctcattcattcttaatggagtcccaggactggaggacatgcacatgtggatttctttcccattctgctccatgtatgctgtggcaatggtagggaattgtgggcttctctacctcatccacttagaggactccctgcacaggcccatgtattactttttagctatgctttccctaactgatattgtcatgtgctctagtacaatccctaaagctctcagcatcttctggtgtcatctcaaagaaattggctttggtgaatgtctggtacagatgttctttgtccacaccttcacagggatggagtctggggtgctcatgcttatggccctggaccgttatgtggccatctgttaccctctgcgctattcaactatcctcaccaatcctgtcattgcaaaggttgggcttgctactttcctgagaggggtgttcctcatcattcccttcactttccttaccaagcgcctgccctactgcagagggaatataattcctcacacctactgtgaccacatgtctgtagccaagttatcctgtggaaatatcaaggccaatgtcatctatggtctgatggttgccctcctgattgggggctttgacattttgtgcatcacagtctcctacaccatgatcctccgggcagtggtgagcctctcctcagcagatgctcggcagaaggctttcagcacctgcactgcccacatctgtgccatcgttttctcctacagtccagccttcttctccttcttttcccaccgctttgggggccacacaatccctccatcttgccacatcattgtggccaatatttatctgctcctgcctcccactatgaaccctattgtctatggagtgaaaaccaagcagatacgcgactgtgtcataaggatcttttcaggttctaaggacatcaaatcccacagcatataa

SEQ ID NO: 3444 - protein, 321 aa, Felis catus
MLMLNKTNWTPASFILNGVPGLEDMHMWISFPFCSMYAVAMVGNCGLLYLIHLEDSLHRPMYYFLAMLSLTDIVMCSSTIPKALSIFWCHLKEIGFGECLVQMFFVHTFTGMESGVLMLMALDRYVAICYPLRYSTILTNPVIAKVGLATFLRGVFLIIPFTFLTKRLPYCRGNIIPHTYCDHMSVAKLSCGNIKANVIYGLMVALLIGGFDILCITVSYTMILRAVVSLSSADARQKAFSTCTAHICAIVFSYSPAFFSFFSHRFGGHTIPPSCHIIVANIYLLLPPTMNPIVYGVKTKQIRDCVIRIFSGSKDIKSHSI

SEQ ID NO: 3445 - DNA, 966 bp, Felis catus
atgataattctgaaccaaacagatgtgaccccagcctcattcattcttaatgggatcccaggactggaggacatgcacatgtggatttccttcccattctgctccatgtatgctgtggcaatggtagggaattgtgggctcctctacctcatctactatgaggactccctgcatagatccatgtattattttttggcaatgctttcccttactgaccttgtcatgtgctctagtacaatccctaaagctctcagcatcttctggtgtcatctcaaggaaattagatttgaagaatgcctagtccagatgttcttcatccataccttcacagggatggagtctggggtgctcatgcttatggccctggatcgctacgtggccatctgttaccctctgcgctactcaactatcctcaccaatcctgtcattgcaaaggttgggcttgctactttcctgagagcggtgttcctcatcattcccttgattttcctcaccaagagactaccctattgcaagggtaatatcatacaccatacctattgtgaccagctatcggtagcaaagttatcctgtggaaatatcaaggccaatgttatatatggtctggtggctgccttcctgattgggggctttgacatcctgtgcatcacagtctcctacaccatgatcctccgggcagtggtgagcctgtcctcagcagatgctcggcagaaggccttcagcacctgcactgcccacatctgtgccatcgttttctcctacagtccagccttcttctgcttcttttttaatcgttttgggagccacacaattcctccatcttgccacatcattgtggccaatatttatctgctcctgcctcccactatgaaccctattgtctatggagtgaaaaccaagcagatacgagactgtgtcataaggatcttttcaggttcgaagaaaatcaaatcctatagcacatag

SEQ ID NO: 3446 - protein, 321 aa, Felis catus
MIILNQTDVTPASFILNGIPGLEDMHMWISFPFCSMYAVAMVGNCGLLYLIYYEDSLHRSMYYFLAMLSLTDLVMCSSTIPKALSIFWCHLKEIRFEECLVQMFFIHTFTGMESGVLMLMALDRYVAICYPLRYSTILTNPVIAKVGLATFLRAVFLIIPLIFLTKRLPYCKGNIIHHTYCDQLSVAKLSCGNIKANVIYGLVAAFLIGGFDILCITVSYTMILRAVVSLSSADARQKAFSTCTAHICAIVFSYSPAFFCFFFNRFGSHTIPPSCHIIVANIYLLLPPTMNPIVYGVKTKQIRDCVIRIFSGSKKIKSYST

SEQ ID NO: 3447 - DNA, 966 bp, Felis catus
atgctaatgttaaaccaaacagacctgaccccagcctcattcattcttaatgggatccgaggactggaggatgtgcatatgtggatttccttcccattctgctccatgtatgctgtggcagtggtagggaattgtgggctcctctacctcatccgctatgaggactccctgcacaggaccatgtactatttcttggctatgctttccctaactgatctcgtcatgtgcactactacaatccctaaagctctctgcatcttctggttccaccttaaggaaatcagttttaatgaatgcctagtccagatgttcttcatctatacctcaacagggatggaatctggggtactcatgcttatggcgctggaccgttatgtggccatctgctaccctctgcactactcaactatccttaccaatcctgtcattgcaaaggttgggcttgctactttcctgagagtggtgctgcttgtcattcctttgactttcatcatcaagaggctaccctactgtagagggaatatactacaccatacctactgtgaccatatgtctgtagccaagttatcctgtggaaatatcaaggtcaatgtcatctatggtctgatggttgccctcctgattgggggctttgacatcctgtgcatcacaatctcctacaccatgatcctccgggcagtagtcagcctctcctcagcagatgctcggcagaaggccttcagcacctgcactgcccacatctgtgccatcgttttctcctacagtccagccttcttctgtttcttttcccaccgctttgggggccacacaatccctccatcttgccacatcattgtggccaatatttatctgctcctgcctcccactatgaaccctattgtctatggagtgaaaaccaaacagatatgagactgtgtcataaggatcttttcaagttctaaggacattaaatcccacagcatatga

SEQ ID NO: 3448 - protein, 302 aa, Felis catus
MLMLNQTDLTPASFILNGIRGLEDVHMWISFPFCSMYAVAVVGNCGLLYLIRYEDSLHRTMYYFLAMLSLTDLVMCTTTIPKALCIFWFHLKEISFNECLVQMFFIYTSTGMESGVLMLMALDRYVAICYPLHYSTILTNPVIAKVGLATFLRVVLLVIPLTFIIKRLPYCRGNILHHTYCDHMSVAKLSCGNIKVNVIYGLMVALLIGGFDILCITISYTMILRAVVSLSSADARQKAFSTCTAHICAIVFSYSPAFFCFFSHRFGGHTIPPSCHIIVANIYLLLPPTMNPIVYGVKTKQI

SEQ ID NO: 3449 - DNA, 960 bp, Felis catus
atgttccagcatcccggagattccaacatctctaagttccaggtctctgagttcattctgatgggattcccaggcattcacacctggcagcactggctctccctgcccctggctctgctctacctcttagctctcactgccaacatccttatcctgatcatcatcaatcaggagaccacactgcatcagcctatgtactatttcctaggggtcctggcggtagtagacatgggtctgggtaccaacatcatgcccaaaattttggctattttatggttcaatgctaaggccatcagtctccctgagtgctttgtgcagatgtatgctatacattgctttatgggcatggagtcaggtatctttgtctgtatggctatagatagatatgtagccatttgtaaaccactacactatccagcaataatcactgaatcttttgtggtcaaagcaactgtgctcatggctctccgaaataccctaactaccatcccagtgcctgtgttggctgctcagagacactactgctcacagaaccaaattgagcactgcctgtgctctaatcttggagtcactagcttatcctgtgatgacaggacaattaacagcatctaccagctacttctggcatggacactgatggggagtgacctggctttgatttttttatcatatgttttgatacttcactcagtgctgaagctgaactcagcagaagctgcttccaaagccctaagtacctgcacttcccacttcatcctaatcttattcttctacacagttgtcattgtcatttccatcacccatagtgaagcaatcacgcttccccttgtcccagttcttctcaatgtacttcaaaataccattcctcctgccctcaaccccatggtgtatgcactcaagaataaggagctgagacagggcttgcataagtttctaaagctagacactaaggacaactaa

SEQ ID NO: 3450 - protein, 319 aa, Felis catus
MFQHPGDSNISKFQVSEFILMGFPGIHTWQHWLSLPLALLYLLALTANILILIIINQETTLHQPMYYFLGVLAVVDMGLGTNIMPKILAILWFNAKAISLPECFVQMYAIHCFMGMESGIFVCMAIDRYVAICKPLHYPAIITESFVVKATVLMALRNTLTTIPVPVLAAQRHYCSQNQIEHCLCSNLGVTSLSCDDRTINSIYQLLLAWTLMGSDLALIFLSYVLILHSVLKLNSAEAASKALSTCTSHFILILFFYTVVIVISITHSEAITLPLVPVLLNVLQNTIPPALNPMVYALKNKELRQGLHKFLKLDTKDN

SEQ ID NO: 3451 - DNA, 957 bp, Felis catus
atgttccagcatcccggagattccaacatctctaagttccaggtctctgagttcattctgatgggattcccaggcattcacacctggcagcactggctctccctgcccctggcactgctctaccttttagctctcactgccaacatccttatcctgatcatcatcaatcaggaggccacactgcaccaacctatgtaccatttcctggggatcctggctgtggtagacatgggactggctaccaccatcatgcccaagattttggccatcttatggttcagtgccaaggccatcagtctccctgagtgttttgctcagatgtatgtcatacattgcttcgtgggcatggagtcaggtatctttgtctgcatggctatagatagatatgtagccatttgcaaaccattacactatccagcaataatcactgaatcttttgtggtcaaagcaactgtgctcatggccctccgaaataccctaactaccatcccagtgcctgttttggctgctcagagacactactgctcacagaaccaaattgagcactgcctgtgctctaatcttggagtcactagcttatcctgtgatgacaggacaattaacagcatctaccagctacttctggcatggacactgatggggagtgacctggctttgatttttttatcatatgttttgatacttcactcagtgctgaagctgaactcagcagaagctgcttccaaagccctaagtacctgcacttcccacctcatcctaatcctattcttctacacagttgtcattgtcatttctatcacccataatgcaacaatgacgtttccccttgtcccagttctactcaatgtactacacaatgtcattcctcctgccctcaaccccatggtatatgcactcaagaacaaggagctcatgcagggcttgtataagcttctgaagctgaacatcaaaggcaac

SEQ ID NO: 3452 - protein, 319 aa, Felis catus
MFQHPGDSNISKFQVSEFILMGFPGIHTWQHWLSLPLALLYLLALTANILILIIINQEATLHQPMYHFLGILAVVDMGLATTIMPKILAILWFSAKAISLPECFAQMYVIHCFVGMESGIFVCMAIDRYVAICKPLHYPAIITESFVVKATVLMALRNTLTTIPVPVLAAQRHYCSQNQIEHCLCSNLGVTSLSCDDRTINSIYQLLLAWTLMGSDLALIFLSYVLILHSVLKLNSAEAASKALSTCTSHLILILFFYTVVIVISITHNATMTFPLVPVLLNVLHNVIPPALNPMVYALKNKELMQGLYKLLKLNIKGN

SEQ ID NO: 3453 - DNA, 960 bp, Felis catus
atgttccaggatctcacacattccaacatctctaagttccaggtctctgagttcattctgatgggattcccaggcattcacacctggcagcactggctctccctgcccctggctctgctctacctcttagctctcactgccaacatccttatcctgatcatcatcaatcaggaggccacactgcatcagcctatgtactatttcctggggatcctggctgtggtagacatgggactggctaccaccatcatgcccaagattttggccatcttatggttcagtgccaaggccatcagtctccctgagtgttttgctcagatgtatgtcatacattgttttgtggttatggagtcaggtatctttgtctgcatggctatagatagatatgtagccatttgcaaaccactacgctatccagcaatagttactgattcttttgtggtcaaggcaactgtgttcatggcacttagaaacagcctggctaccatcccagtgcctgtgttggctgctcagagacactactgctcacagaaccaaattgagcactgcctgtgctctaatcttggagtcactagcttatcctgtgatgacaggacaatcaacagcatctaccagctatttctggcatggacattgatggggagtgacctggttttgatttttttatcgtatgttttgatacttcactcagtgctgaaactgaactcagcagaagctgcttccaaagccctaagtacctgtacttcccacctcatcctcattttgttcttttacacagtcattgttgtcatttccatcacccatagtgcagcaatcacgcttccccttgtcccagttctcctcaatgtactacacaatgtcattcctcctgccctcaatcccatagtgtatgcactcaagaataaggaactcaggcatggcttatataaagctcttaagttgaacatcaaaagcaagtaa

SEQ ID NO: 3454 - protein, 319 aa, Felis catus
MFQDLTHSNISKFQVSEFILMGFPGIHTWQHWLSLPLALLYLLALTANILILIIINQEATLHQPMYYFLGILAVVDMGLATTIMPKILAILWFSAKAISLPECFAQMYVIHCFVVMESGIFVCMAIDRYVAICKPLRYPAIVTDSFVVKATVFMALRNSLATIPVPVLAAQRHYCSQNQIEHCLCSNLGVTSLSCDDRTINSIYQLFLAWTLMGSDLVLIFLSYVLILHSVLKLNSAEAASKALSTCTSHLILILFFYTVIVVISITHSAAITLPLVPVLLNVLHNVIPPALNPIVYALKNKELRHGLYKALKLNIKSK

SEQ ID NO: 3455 - DNA, 860 bp, Felis catus
ttaaatgttgtgagaattgtccttttccttaaacaagaatctaataacaatttctcgtatctgcttggttttcaccccatacacaatagggttcattgtgggaggcatgagcaggtagagattagccataataatgtgtatatgtggaggaatggtgtgtcccccaaaccggtgagtaaagaaggtgaagaaggctgggacataggtgatgacaatggcacagatgtgagcagtgcatgtgctaaaggccttctgccgggcatctgctgatgatagactcacaactgcccggaggatcatagtgtaggagattgtgatgcacaggatgtcaaagcccccaatcaggagggcaaccattaaaccatatatggcattgatcctaacattaccacaggatatcttggccacagacatgtggtcacagtaggtgtgaggtatgacattgcccctgcagtatggcaggtgcttggtgaggaaagtgaaagggataacaagtattacacctctaagaaaagtgaggagtccagccttggaaatgactgaatttgtgaggatagtagcatagcgcaggggatagcagatggccacatagcggtccagggccatgagcatgagcaccccagactccattcctgtgaaagtgtgcacaaagaacatctgggccaggcaggccttgaaatcaatctccttgaggttgaaccacaatatgcagagggtgttgggaagagtgctggtgcacatgagcacatctgtgaaggatagaagggctaggaaaatgtacataggtctgtgtagggcttcttcagagtaaatgaggtatataagaccaaagtttcctgtgattgcaatggctgtacatg

SEQ ID NO: 3456 - protein, 285 aa, Felis catus
CTAIAITGNFGLIYLIYSEEALHRPMYIFLALLSFTDVLMCTSTLPNTLCILWFNLKEIDFKACLAQMFFVHTFTGMESGVLMLMALDRYVAICYPLRYATILTNSVISKAGLLTFLRGVILVIPFTFLTKHLPYCRGNVIPHTYCDHMSVAKISCGNVRINAIYGLMVALLIGGFDILCITISYTMILRAVVSLSSADARQKAFSTCTAHICAIVITYVPAFFTFFTHRFGGHTIPPHIHIIMANLYLLMPPTMNPIVYGVKTKQIREIVIRFLFKEKDNSHNI

SEQ ID NO: 3457 - DNA, 715 bp, Felis catus
tgctgtgcatattctggttcaacctcaaggagattgactttgatgcctgcctggctcagatgttttcgtccacatgctgactgggatggagtctggggtgctcatgctcatggccctggaccgctatgtggccatctgctaccccttacgttattccatcatcctcaccaaccctgtcatcgccaagaccggtcttgccaccttcctgaggggtgtgctgctcattatcccattcactttcctcaccaagcgtctgccctattgccggggcaacttcattccccatacctactgtgatcatatgtctgtggccaaggtgtcctgtggcaatttcaaggtcaatgccatctatggtctcttggcagccctcctaattgggggctttgatatgttctgtatttctgtgtcttacactatgatcttgcgggcagtggtgagtttgtcatctgcagatgctcggaagaaagccttcggtacctgtacatcccacatatgtgccattgtgatcacatatgttccagccctgttcaccatttttactcatcgttttgggggacaaaacattccccaccacgttcatatccttattgctaatctttatttgatgttgcctcctactctgaaccccattgtttatggagccaagaccaagcagatccaggaaggagtgatcaagttattttttaaagagaaaactatcttagttatgagatag

SEQ ID NO: 3458 - protein, 213 aa, Felis catus
MLTGMESGVLMLMALDRYVAICYPLRYSIILTNPVIAKTGLATFLRGVLLIIPFTFLTKRLPYCRGNFIPHTYCDHMSVAKVSCGNFKVNAIYGLLAALLIGGFDMFCISVSYTMILRAVVSLSSADARKKAFGTCTSHICAIVITYVPALFTIFTHRFGGQNIPHHVHILIANLYLMLPPTLNPIVYGAKTKQIQEGVIKLFFKEKTILVMR

SEQ ID NO: 3459 - DNA, 885 bp, Felis catus
gatctccctgccattctgcttcatgtacgtcatcgctgtcgtggggaactgcgggctcatctacctaatcagccatgaggatgccctgcaccggcccatgtactacttcctggccctgctcgccttcacagatgtcaccctgtgcaccaccactgtacccaatatgctgtgcatattctggttcaacctcaaggagattgactttgatgcctgcctggctcagatgtttttcgtccacatgctgactgggatggagtctggggtgctcatgctcatggccctggaccgctatgtggccatctgctaccccttacgttattccatcatcctcaccaaccctgtcatcgccaagaccggtcttgccaccttcctgaggggtgtgctgctcattatcccattcactttcctcaccaagcgtctgccctattgccggggcaacttcattccccatacctactgtgatcatatgtctgtggccaaggtgtcctgtggcaatttcaaagtcaatgctgtctatggtctgatggttgctctccttattggtgtgtttgacatctgctgtatttctgtgtcttacactatgatattgagagcagtagtgagcctgtcatctgcagatgctcgtcaaaaagcctttagcacctgtacatcccacatatgtgccattgtgatcacttatgttccagcttttttcactttttttgcccaccgttttggaggacacaatatcccccaccacattcacatcattgtagccaacctttacctgctcctacctcctacaatgaatcctattgtttatggagtcaagaccaagcagatccgagaaggtgtgttcaagtttttacttggacacaaggttgtctttactcaagacaaatgaat

SEQ ID NO: 3460 - protein, 293 aa, Felis catus
ISLPFCFMYVIAVVGNCGLIYLISHEDALHRPMYYFLALLAFTDVTLCTTTVPNMLCIFWFNLKEIDFDACLAQMFFVHMLTGMESGVLMLMALDRYVAICYPLRYSIILTNPVIAKTGLATFLRGVLLIIPFTFLTKRLPYCRGNFIPHTYCDHMSVAKVSCGNFKVNAVYGLMVALLIGVFDICCISVSYTMILRAVVSLSSADARQKAFSTCTSHICAIVITYVPAFFTFFAHRFGGHNIPHHIHIIVANLYLLLPPTMNPIVYGVKTKQIREGVFKFLLGHKVVFTQDK

SEQ ID NO: 3461 - DNA, 931 bp, Felis catus
atgtccccctcaaatgataccaagctccacccctcctatttcctcctgctgggagttccaggtcttgaacagatgcacatctggattgggtttcctttttgttctgtgtatttgattgcccttgtggggaacatcactatcctgtttgtgatcaagactgaacacagccttcatcagcctatgttttacttcttggctatgttagcctccattgatctgggcctgtccacatccaccatccccaaaatgttaggcatattctggtttaatttaaaggagattagctttgagggctgtgtcacccagatgttctttattcatatattcactgccatggagactgtcgtgttggtggccatggcctttgatcgccatgttgctgtctgcaaccctctgcgatacagcctgattctcactaacagaacgattggtctcatccttgttgttgtgtttggtgtcaatttcattttggttatccctctggtgtttctcatcttgagacttcccttttgtggacaccatgtaatcccccacacatactgtgagcacatgggaattgctcgcctagcctgtgccaatataaaggtcaacatgatatttggattaattcttatatcactggtgtttgttgacgtggttctgatcgtcatctcctatgtgagaatactccgagctgtcttctgccttccttcccaggatgccagactcaaagcacttaatacatgtggctcccatatctgtgttatcctagccttctttactccagcttttttctccttcatgactcaccggtttggcaggaacgttcccgtatacattcatattctccttgccaatctatatgtggttgttccacctgccctcaatcctgtcatctatggagtgaggaccaagcaaattcgagaaagggtttcaagcatctttttgaaaa

SEQ ID NO: 3462 - protein, 311 aa, Felis catus
  MOD_RES (311)..(311): Any amino acid
MSPSNDTKLHPSYFLLLGVPGLEQMHIWIGFPFCSVYLIALVGNITILFVIKTEHSLHQPMFYFLAMLASIDLGLSTSTIPKMLGIFWFNLKEISFEGCVTQMFFIHIFTAMETVVLVAMAFDRHVAVCNPLRYSLILTNRTIGLILVVVFGVNFILVIPLVFLILRLPFCGHHVIPHTYCEHMGIARLACANIKVNMIFGLILISLVFVDVVLIVISYVRILRAVFCLPSQDARLKALNTCGSHICVILAFFTPAFFSFMTHRFGRNVPVYIHILLANLYVVVPPALNPVIYGVRTKQIRERVSSIFLKX

SEQ ID NO: 3463 - DNA, 942 bp, Felis catus
tcaaacttccttaaaaaggaagatcatcaccacctgttctcggatctgcttagttctcaccccataaataatggggttaagagcaggtgggattatcacatataaatttgccaggaggatgtggatataacgtggaatattgtggccaaatcgatgagtcataaaagagaaaaatgctggagtgaaaaaagctaagatgacacatacatgggaaccacaggtattaagagctttgagcctggcctcccaggatgggagtctgaagacagcacgtagaatcttcacataggagatagcaatcaaaataacatccagaagtatcatagagataagaattaatccaaataatatattgacctttatgctgacacaggccagacgggcaatgcccatgtgctcacagtaggtatggggtataatattatgtccacagaatgaaagccttagaaggagaaacacaagtggaaacaccaaaacaaaatttttcaacattcctactccagcaataatacaaatagttctgttggtaaggattgtgttgtatcgaagagggtggcaaatggcaacatagcgatcaaaagccatggcaacaagcatgaaagtttcgaaacctgtaaacaggtgtatgaagaacatttgagctaagcatcccccaaagtcaatctcattgagaccaaaccagaatatgctcagcattttgggaatagttgcggtggagaggcccaggtcagtgagagccaacatggccaataagtagaacatgggatggtgaaggctgtgctcagtctggatcacaaagaggatgatgccattccccaggagggcaatcagatagactgtaccaaatgggacaccaagccagagctgcatattttccagtcctgggattcccaacagcaggaaagatgaggggtgaaaacatgaggtattggctagagacat

SEQ ID NO: 3464 - protein, 313 aa, Felis catus
MSLANTSCFHPSSFLLLGIPGLENMQLWLGVPFGTVYLIALLGNGIILFVIQTEHSLHHPMFYLLAMLALTDLGLSTATIPKMLSIFWFGLNEIDFGGCLAQMFFIHLFTGFETFMLVAMAFDRYVAICHPLRYNTILTNRTICIIAGVGMLKNFVLVFPLVFLLLRLSFCGHNIIPHTYCEHMGIARLACVSIKVNILFGLILISMILLDVILIAISYVKILRAVFRLPSWEARLKALNTCGSHVCVILAFFTPAFFSFMTHRFGHNIPRYIHILLANLYVIIPPALNPIIYGVRTKQIREQVVMIFLFKEV

SEQ ID NO: 3465 - DNA, 928 bp, Felis catus
ttaactgtcttttaaaaagatcctcaaaacctgctccttaatctgcttggtcctgaccccatagattacaggattgagagctggcggaacaaccacatataggttggctaagaggatgtggatatattgagggatgttgtggccaaaacggtgtgtcaagaaagagaaaaatgctggtgtgaaaaaggctaagataacaccaatgtgagagccacaggtgttgagagctttgaaccgggcctcccaggaaggcaggcagaagacagcatagaggatcctgacataggagagaattataaggaacacatccaataataaaatagacatatccccaagaccaaatattatgttgactttgatgctggcacaggccaggcgagcaatgcccatgtgttcacagtaggtatgagggatgatatagtgcccacagaagggcagcctcaagaggagaaataccagaggggccaccatgcacaggctcctcagaatagccatgcctgcaatgaggctgatgattttgctggtgaggatcatggtgtaccgaaggggtttacaaatggcaacatagcggtcaaaggccatggccaccaacacaatgctctccatggcagtgaagaagtggatgaagaacatctgggaaaggcagctttcaaaagatatatccctgaggctgaaccagaagatgcccagcattttggggatggtggctgtggacaagcccaggtcgatggagtccaacatggctaggaagtagtacacgggctcatggagactatgctcagtctggatcacaaacaggacagcagcgttccccaagagtgcaacaagatacgcaaagaaaaagggaaatccaatccagacgtgcacatcttctagccctgggatacccaggaggaggaacgaagaaggatggaactgggtgtcatta

SEQ ID NO: 3466 - protein, 308 aa, Felis catus
NDTQFHPSSFLLLGIPGLEDVHVWIGFPFFFAYLVALLGNAAVLFVIQTEHSLHEPVYYFLAMLDSIDLGLSTATIPKMLGIFWFSLRDISFESCLSQMFFIHFFTAMESIVLVAMAFDRYVAICKPLRYTMILTSKIISLIAGMAILRSLCMVAPLVFLLLRLPFCGHYIIPHTYCEHMGIARLACASIKVNIIFGLGDMSILLLDVFLIILSYVRILYAVFCLPSWEARFKALNTCGSHIGVILAFFTPAFFSFLTHRFGHNIPQYIHILLANLYVVVPPALNPVIYGVRTKQIKEQVLRIFLKDS

SEQ ID NO: 3467 - DNA, 936 bp, Felis catus
ttatttctgtacaaatatcttcacaactctctctcggatgtgtttggtcctgactccatagatgaccggattaagggccggtgggacaaccacataaagattagccagaagaatgtggatatagcggggaatgtttctgccaaaacggtgtgtcataaaagaaaaaaaagctggcgtgtaaaagcacagcatgacacagacatgagaaccacaggtattgagagcctttagccgggcatcctgagaaggaaggcggaaaacagctcgaaggataagcacataggaggaggcaatcaggatcacatccacaatgatattagaaatcaccatgagcccatagataatgttgaccttgatgggtgcacaggccaaccgggcaagacccatgtgctcacagtacgtatgagggatgatgtgatgcccacagaagggcaacctcagaatgagaaacacgaatggagtcacaagaattaaatttcttcccacaacaagagaagctaggatgctgatggttttattggtgaggatcatggtgtactggagagggttgcagatggcaacaaagcggtcataagccatggccaccaggagaacagtctccattcctgtgaacatgtggataaagaacatctgggcaaggcagcccccaaagctgatctcttgttggttgaaccagaagatgcccagcattttggggatggtggacgtggacagacccagatcgatcatagacaacatggccaggaagtagaacatgggctggtggagactgtgttcagtcttgatcacaaagagaatggtgatgttccccacaagggcaatcaggtacacaatgcagaatgggaaagcaatccagatatgtacagtttccagtcctgggattcctagcaggtgaaacaaggggggatggaagtgggtgtcattgatggaagtcat

SEQ ID NO: 3468 - protein, 311 aa, Felis catus
MTSINDTHFHPPLFHLLGIPGLETVHIWIAFPFCIVYLIALVGNITILFVIKTEHSLHQPMFYFLAMLSMIDLGLSTSTIPKMLGIFWFNQQEISFGGCLAQMFFIHMFTGMETVLLVAMAYDRFVAICNPLQYTMILTNKTISILASLVVGRNLILVTPFVFLILRLPFCGHHIIPHTYCEHMGLARLACAPIKVNIIYGLMVISNIIVDVILIASSYVLILRAVFRLPSQDARLKALNTCGSHVCVMLCFYTPAFFSFMTHRFGRNIPRYIHILLANLYVVVPPALNPVIYGVRTKHIRERVVKIFVQK

SEQ ID NO: 3469 - DNA, 943 bp, Felis catus
atgtcttctcccaatgtcactgaatcccatcctccttcattcctattgctggggattccagggttggaagttgcacaaatctggcttgtatttctcttctgtgctgtgtatctgattgctcttgttggaaatgttatcattctgtttgttatctgggttgatcatagccttcaccaacctatgttctactttctggccatgctgtcagtgattggcctaagtctctctactactaccatctccaagatgctggggatcttctggttcagacttcaggagctgtgctttgggtgatgtgttgctcaagtgttttttatccacttttttacagtcatggagagcattgtacttcttgccatgggttttgatcattatgtggctatttgcaaccccctcaggtacagcatgattcttaccaacagagtgattggtgtaattgctgtgatagtggtactaagaagcttatgcatgattgttcccatcatttttctcctcctgagcctgccttactgtggacacagaatcatccctcatacctattgtgagcacatgggagtggcacgtctagcttgtgccagcattaatgccaatgtctactatggtcttggaaatatttctatcttgtttctggatgtgcttcttatcattgtctcatatattaggatcttatatgctgtcttccacctcccttcccaagatgcccgcctgaaagctctgaatacctgtacctcccatatttgtgttatcttggtcttctttcgtccagctctcttctctttcctcactcaccgctttggtcatgacatccccaagtatatccatatcctcctggctaacctctatgtagtcataccccctgccctcaacccagtcatttatggcatcaggaccaagtagatccaggaatgggtaaagagtctctttgttaaaacaagattgatga

SEQ ID NO: 3470 - protein, 97 aa, Felis catus
MSSPNVTESHPPSFLLLGIPGLEVAQIWLVFLFCAVYLIALVGNVIILFVIWVDHSLHQPMFYFLAMLSVIGLSLSTTTISKMLGIFWFRLQELCFG

SEQ ID NO: 3471 - DNA, 936 bp, Felis catus
atgacttccatcaatgacacccacttccatccccccttgtttcacctgctaggaatcccaggactggaaactgtacatatctggattgctttcccattctgcattgtgtacctgattgcccttgtggggaacatcaccattctctttgtgatcaagactgaacacagtctccaccagcccatgttctactttctggccatgttgtctatgatcgatctgggtctgtccacgtccaccatccccaaaatgctgggcatcttctggttcaaccaacaagagatcagctttgggggctgccttgcccagatgttctttatccacatgttcacaggaatggagactgttctcctggtggccatggcttatgaccgctttgttgccatctgcaaccctctccagtacaccatgatcctcaccaataaaaccatcagcatcctagcttctcttgttgtgggaagaaatttaattcttgtgactccattcgtgtttctcattctgaggttgcccttctgtgggcatcacatcatccctcatacgtactgtgagcacatgggtcttgcccggttggcctgtgcacccatcaaggtcaacattatctatgggctcatggtgatttctaatatcattgtggatgtgatcctgattgcctcctcctatgtgcttatccttcgagctgttttccgccttccttctcaggatgcccggctaaaggctctcaatacctgtggttctcatgtctgtgtcatgctgtgcttttacacgccagcttttttttcttttatgacacaccgttttggcagaaacattccccgctatatccacattcttctggctaatctttatgtggttgtcccaccggcccttaatccggtcatctatggagtcaggaccaaacacatccgagagagagttgtgaagatatttgtatagaaataa

SEQ ID NO: 3472 - protein, 309 aa, Felis catus
MTSINDTHFHPPLFHLLGIPGLETVHIWIAFPFCIVYLIALVGNITILFVIKTEHSLHQPMFYFLAMLSMIDLGLSTSTIPKMLGIFWFNQQEISFGGCLAQMFFIHMFTGMETVLLVAMAYDRFVAICNPLQYTMILTNKTISILASLVVGRNLILVTPFVFLILRLPFCGHHIIPHTYCEHMGLARLACAPIKVNIIYGLMVISNIIVDVILIASSYVLILRAVFRLPSQDARLKALNTCGSHVCVMLCFYTPAFFSFMTHRFGRNIPRYIHILLANLYVVVPPALNPVIYGVRTKHIRERVVKIFV

SEQ ID NO: 3473 - DNA, 942 bp, Felis catus
atgctgcattccaacaatacacagtttcacccctcttccttccttctggtggggattccaggactagaagatgtgcacatctggattggcttccccttctttgcagtgtatctgacagccctcctagggaacattactatcctgtttgtgatccagactgaacacagcctccaccaacccatgttttacttcctggccatgttggcctgcactgatcttggcctgtctacagccaccatccccaagatgctaggaattttctggttcaatctcagggagattgggtttggtgcttgcatcacacagatgtatactatccatatatgtactggcctggagtctgtggtgctgacagtcatggccatagatagatacattgccatctgtaaccccctgagatatagtatgatcctcaccaataaggtgatagctatcctgagcatagtcatcatagtcaggactttggtgtttgtgactccattcatatttctcatcctaagattgcctttctgtggtgtccgggttattcttcacacctactgtgaacacatgggtttggcaaagttggcttgtgccaatattaggatcaatgttgtctatggcttgattgctttctcagtgggatacatcgacctttctgtgattggattctcctacgttcaaatcctccgagcagtcttccatctaccttcctgggatgccaggctcaaggcacttggcacatgtggctcccatgtctgtgtcatggtagctttctacctaccagccctcttctccttcatgacacatcgctttggccacaacatccctcattacatccacattcttctggccaatctgtacgtggttgttccccctgctcttaaccctgttatctatggggtcaggacaaaacagataagagagcgtgtactaaggatgcttaaccctaaaggctattga

SEQ ID NO: 3474 - protein, 313 aa, Felis catus
MLHSNNTQFHPSSFLLVGIPGLEDVHIWIGFPFFAVYLTALLGNITILFVIQTEHSLHQPMFYFLAMLACTDLGLSTATIPKMLGIFWFNLREIGFGACITQMYTIHICTGLESVVLTVMAIDRYIAICNPLRYSMILTNKVIAILSIVIIVRTLVFVTPFIFLILRLPFCGVRVILHTYCEHMGLAKLACANIRINVVYGLIAFSVGYIDLSVIGFSYVQILRAVFHLPSWDARLKALGTCGSHVCVMVAFYLPALFSFMTHRFGHNIPHYIHILLANLYVVVPPALNPVIYGVRTKQIRERVLRMLNPKGY

SEQ ID NO: 3475 - DNA, 960 bp, Felis catus
atgatcaggacactttacatggcctcacccagcaactactccactgttccagtctccgaattcctcctcatctgcttccctaactaccagagttggcagcattggttgtctctgcccctcagcctccttttcctcctggccatgggggccaatgccaccctcctgctcaccatccagctggaggcctctctgcacgagcccatgtactacctgctcagcctcctctccctgctggacatcgtgctctgcctgactgtcatccccaaggtcctggccatcttctggtttgacctcaggtccatcagcttctctgcctgcttcctccagatgttcatcatgaacagtttcttgaccatggagtcttgtacattcatggtcatggcctatgaccgctatgtggccatttgccacccactgcgatatccatccataatcactgaccattttgtggttagagctaccatatttgttgtggcccggaatggcctcttttctcttcctgttcctgtcctgtcttctcgactcacatactgtgcagagaacaccatcaagaactgcatctgcactaacctgtctgtgtccaaactatcctgtgatgacatcaccttcaaccggctctaccaatttgtggcaggctggaccctcctgggctctgacctcatccttattgttctctcctactccttcatcctgaaagctgtgctaaggatcaaggctgagggtgctgcggccaaggccctgagcacgtgcggttcccacttcatcctcatcctcttcttcagcaccgtcctgctggttctggtcatcactaacctggccaggaagagaattcccccagatgtccccatcctgctcaacatcctgcaccacctcatccccccagctctgaaccccattgtttatggtgtgaggaccaaagagatcaagcagggaatccagaagttactgaggaggttgtaa

SEQ ID NO: 3476 - protein, 319 aa, Felis catus
MIRTLYMASPSNYSTVPVSEFLLICFPNYQSWQHWLSLPLSLLFLLAMGANATLLLTIQLEASLHEPMYYLLSLLSLLDIVLCLTVIPKVLAIFWFDLRSISFSACFLQMFIMNSFLTMESCTFMVMAYDRYVAICHPLRYPSIITDHFVVRATIFVVARNGLFSLPVPVLSSRLTYCAENTIKNCICTNLSVSKLSCDDITFNRLYQFVAGWTLLGSDLILIVLSYSFILKAVLRIKAEGAAAKALSTCGSHFILILFFSTVLLVLVITNLARKRIPPDVPILLNILHHLIPPALNPIVYGVRTKEIKQGIQKLLRRL

SEQ ID NO: 3477 - DNA, 943 bp, Felis catus
cacactttcttcagtaatctctggattccttgcttgatctcctgggttcgcactccatacacaacggggttgagggctgagaagatgatatggtggaggacgttgagcaggactggaacatcaggcgagaccttcttcttcaccacatgagtgagcacgaagaccagaaggatggtgctgaagaagaggataaggatgaagtgggagccacatgtgctcagggccttggccacagcaccctctgccttgagtctcagcacagctcgcaatatgagggtgtaggagaggaagatgaggatgaggtcagatcctagcagtgtccagcctgcaacaaactggtagatgcgactaatggtgacatcattacaagagagcctggagacaaacatattggcacagatgcaattgtcaatgacatttgtcccacaataatggagttgggatgatagaatggggataggcattgtaacaatactattcctggccaaaataaaaatggcagccttgactacaaattggtcagtgatgatggatgggtacctcagtgggtggcagatggccacatagcggtcataggccatgaccatgaatgtacaggattccatagcaaagaaccaattcatgatgtacatctggaggaagcaggcatagaaactgatggacttgaggtcaaaccagaagatggccaggacctggggatgacagtgaggcagacaacaatgtccagcagggaaaggatactgagcaggtagtacatgggctcatgcagagagacctctagccagatggtaatcaggagaacactattggcccccatggccagaaggaagagaaggctgaggggcagggacaaccagaacttccagctgggggacctgacaaaacaattcaggaggaagtctgaaacctcagaggagatggtgccattttggtatattgtcat

SEQ ID NO: 3478 - protein, 211 aa, Felis catus
  MOD_RES (211)..(211): Any amino acid
MYIMNWFFAMESCTFMVMAYDRYVAICHPLRYPSIITDQFVVKAAIFILARNSIVTMPIPILSSQLHYCGTNVIDNCICANMFVSRLSCNDVTISRIYQFVAGWTLLGSDLILIFLSYTLILRAVLRLKAEGAVAKALSTCGSHFILILFFSTILLVFVLTHVVKKKVSPDVPVLLNVLHHIIFSALNPVVYGVRTQEIKQGIQRLLKKVX

SEQ ID NO: 3479 - DNA, 962 bp, Felis catus
atgctgccttagaacagcagctccctctctattgaagtctcagacttcatcctgaattgctttgtcaggtcccccatctggaagcattggttgtctctgcccctcagcctcctcttcctcctggctatggggccagtgccaccctcctgatcaccatccggatcaggatggaggtctcttggcataagcccatgtactacctgctcggcctcctttccctgctggacatcatgctctgcttgactgtcatccccaaggtcttggccatcttctggtttgaccacaggtccatcagcttctctacctgcttcctccagatgttcatcatgaattccttcctgcccatggaatcatgcaccttcctggccatggcctatgactgctatgtgtccatctgtaagcctctctactacccatctatcatcactgaccagtttgtaggaaaggctgttctcttcatcttggcccggaacacatttcttcctgcacctattcccatcctctctgcccagcatcattactgtggaaaaaatataattgagaactgtatgtgtgccaatctctcttgtgtccaagctctcctgtgataacattgcctttaacagaatttaccatttagttgtggcctggactcttctgggctctgacctcatcctcatcattttctcctatactttcatcctatgagccgttcttagactcaagacaaaaggggcagctgccaaagctctgaacacttgtggctctcacttcatcctcatcctcttcttcagtaccatcctgctggtttttgttttcacccacattgccaagaaaaaagtttcccctgatatccctgtcttacttaatgtgttacaccatgtaattcctgcagctctcaaccccattgtctatggggtacgaatgcaggagattaaagaggggattaggaaattgctgaggagggtgagagcagcaagtaa

SEQ ID NO: 3480 - protein, 35 aa, Felis catus
TCCSHPPQQFPNPLFNLLHSYPIDNGVESCRNYMV

SEQ ID NO: 3481 - DNA, 949 bp, Felis catus
atgacagtgcatcaaaatggcaccatctcctttgagatttcagacttcctcctgaattgttttatcaggtcccccagctggaagctctggttgtccctgccactcagcctcctcctcctcctggctatgggggccaatggtattctcttgatcaccattcggatggaggtctctctacatgagcccatgtactacctgctcagcctcctctccctattggacattgtgctctgcctcaccgtcatccccaagattctggccatcttctggtttgacctcaaatccatcagcttctatgcctgcttcctccagatgtacatcatgaattgcttcttcggcatggagtcctgcacattcatggtcatggcctatgaccgctatgtagccatctgccacccactgaggtactcatccatcatcactgaccattttgtagccaaggctgccatttttattttggccagaaatgcacttcttactatattcattcccatcctctctgcccggctccattattgtggaaaaaatataattgagaactgtatgtgtgccaatctctctgtgtccaagctctcctgtgataacattggctttaacagaatttaccatttagttgtggcctggactctactgggctctgacctcattctcatcatcttctcctataccttcatcctacgagccgttcttagactcaagacaaaaggggcagctgccaaagctctgagcacttgtggctctcacttcatcctcatcctcttcttcagcaccatcctgctggtttttgttttcacccacattgccaagaaaaaaatttcccctgatatccctgtcttacttaatgtgttacaccatgtaattcctgcagctctcaaccccattgtctatggggtacgaactcaggagattaaagaggggattaggaaattactgaggagggcaagagaga

SEQ ID NO: 3482 - protein, 317 aa, Felis catus
  MOD_RES (317)..(317): Any amino acid
MTVHQNGTISFEISDFLLNCFIRSPSWKLWLSLPLSLLLLLAMGANGILLITIRMEVSLHEPMYYLLSLLSLLDIVLCLTVIPKILAIFWFDLKSISFYACFLQMYIMNCFFGMESCTFMVMAYDRYVAICHPLRYSSIITDHFVAKAAIFILARNALLTIFIPILSARLHYCGKNIIENCMCANLSVSKLSCDNIGFNRIYHLVVAWTLLGSDLILIIFSYTFILRAVLRLKTKGAAAKALSTCGSHFILILFFSTILLVFVFTHIAKKKISPDIPVLLNVLHHVIPAALNPIVYGVRTQEIKEGIRKLLRRAREX

SEQ ID NO: 3483 - DNA, 946 bp, Felis catus
atgacagcgcaccaaaatggcaccatctcctctgaggtttcagacttcctcctgaattgttttgcccggtcccctagctggaaattctggttgtccctgcccctcagcctcctctttcttttagccatgggggccaatagtgttctcctgatcaccatccggctggaggcatctctgcatgagccattgtactacctgctcagcctcctctctctgttggacatcattgtctgcctcaccgtcatccccaaggtgctggctgtcttttggtttgacctcaagtccatcggcttctatgcctgcttcctccagatgtacatcatgaactgcttcctttccatggagtcctgcacattcatggtcatggcctatgactgctatgtagccatctgccacccactgaggtacccatccatcatcactgaccaatttgtagtcaaggctgctgtctttattttggccaggaatggcattttaacagtacctatccccattctatcatcccgactccattattgtaggacaaatgtcattgagaactgcctctgcgccatatgtctgtctccaggctctcctgcaatgatgtcaccatcaatcgcctctaccagtttgtcgtaggatggaccctgctagggtctgacctcatcctcatctttgtctcctataccttcatactgcgagctgtgctgagactcaaggaagagggtgctgtggccaaggccctgagcacatgtggctcccacttcatccttatcctcttcttcagcaccatccttctggtcttcgtgctcactcttgtggtgaagaagaaagtctccccggatgtgccagtcttgctcaacatcctccaccatgtcattttctcagccctcaaccccattgtgtatggggtgcgaacccaggagatcaagcaaggaatccagagattactgaagaaagtgtggta

SEQ ID NO: 3484 - protein, 205 aa, Felis catus
MTAHQNGTISSEVSDFLLNCFARSPSWKFWLSLPLSLLFLLAMGANSVLLITIRLEASLHEPLYYLLSLLSLLDIIVCLTVIPKVLAVFWFDLKSIGFYACFLQMYIMNCFLSMESCTFMVMAYDCYVAICHPLRYPSIITDQFVVKAAVFILARNGILTVPIPILSSRLHYCRTNVIENCLCAICLSPGSPAMMSPSIASTSLS

SEQ ID NO: 3485 - DNA, 941 bp, Felis catus
atgacaactcatggaaatgactccactaggatttcagactttctcctgaattgttttgtcaggtcccccagctggcagctctggctgtccctgcccctcagcctcctattcctcctggccatgggggctaacgttattctcctaatcaccatccggctggaggtctctctacaccagcccatgtactacctgctcagtattgtctccctgctggacattgtgctctgcctgactgtcatccccaaagtcctggccatcttctggtttgacctcaagtccatcagtttctatgcctgcttcctccagatgtacatcatgaattgcttctttgccatggagtcctgcacattcatggtcatggcctatgaccgctatgtagccatctgccacccactgaggtacccatccatcatcactgaccaatttgtagtcaaggctgctgtctttattttggccaggaatgcacttcttactgtgtccattcccatcctctctgcccggctccattactgtgggagaaatgtcattgagaattgcatctgtgccaatatgtctgtctccaggctctcctgtgatgatgtcaccatcaatcgcctcctccagtttgctggaggctggacactgctaggatccgacctcatcctcatcctcctctcctacaccctcatactgcgagcggtgctgagactcaaggcagagggtgctgtggccaaggccctgagcacatgtggctcccacttcatccttatcctcttcttcagcaccatccttctggtcttcgtgctcactcatgtggtgaagaagaaggtctcacccaatgtgccagtcctgctcaacgtcctccaccatgtcatccctgcagccctcaaccctatagtttatggagtgcgaacccaggagatcaagcaaggaatccagagattactgaagaaagggtggta

SEQ ID NO: 3486 - protein, 314 aa, Felis catus
  MOD_RES (314)..(314): Any amino acid
MTTHGNDSTRISDFLLNCFVRSPSWQLWLSLPLSLLFLLAMGANVILLITIRLEVSLHQPMYYLLSIVSLLDIVLCLTVIPKVLAIFWFDLKSISFYACFLQMYIMNCFFAMESCTFMVMAYDRYVAICHPLRYPSIITDQFVVKAAVFILARNALLTVSIPILSARLHYCGRNVIENCICANMSVSRLSCDDVTINRLLQFAGGWTLLGSDLILILLSYTLILRAVLRLKAEGAVAKALSTCGSHFILILFFSTILLVFVLTHVVKKKVSPNVPVLLNVLHHVIPAALNPIVYGVRTQEIKQGIQRLLKKGWX

SEQ ID NO: 3487 - DNA, 690 bp, Felis catus
gtacttgaatagtttgagaataccttgcttgatttcctgggttcgtactccataaacaatggggttcagggctggtggaatgaggtggtgcaagacattgagaagaatgggtacctctgagggcaccttcttttctgccttgtttgtgaagatgaagacaagcagcaatgtatagaagaaaagtataagaatgagatgggaaccacaagtactcaaggctttggttgctgcacctcctgactgcagacgtttaacagccctcaggatgaagcagtaggatagtaagatgagcactaggtcagaacccagtagacaccaaacactcacaaattggtagagcttatttgggtgaatatccccacaggagagctttgctacagaaatgttggcacagatacagttctccaccacattgctggcacagtagttgagcctggcagccagaactggtgtgggtagtgtggccacaaaattgcggaagacaatgaagatggctgcataaatgacaaatttttcagtgatggtggatgggtagtgcagaggatggcaaatggccacatagcggtcataggccatgaccaggaaggtggaagactccataggaaggaatgtattcatgatgaacatctgcagaaagcagcctgcaaggctgatggtcttcatgttgaaccagaagatgagcaggacctg

SEQ ID NO: 3488 - protein, 230 aa, Felis catus
QVLLIFWFNMKTISLAGCFLQMFIMNTFLPMESSTFLVMAYDRYVAICHPLHYPSTITEKFVIYAAIFIVFRNFVATLPTPVLAARLNYCASNVVENCICANISVAKLSCGDIHPNKLYQFVSVWCLLGSDLVLILLSYCFILRAVKRLQSGGAATKALSTCGSHLILILFFYTLLLVFIFTNKAEKKVPSEVPILLNVLHHLIPPALNPIVYGVRTQEIKQGILKLFKY

SEQ ID NO: 3489 - DNA, 955 bp, Felis catus
ttacaaccttctcagtagtttctggattccctgcttgatctctttggtcctcacaccataaacaatggggttcagagctggggggatgaggtggtgcaggatgttgagcaggatggggacatctgggggaattctcttcctggccaggttagtgatgaccagaaccagcaggacagtgctgaagaagaggatgaggatgaagtgggaaccgcacgtgctcagggccttggccgcagcaccctcagccttgatccttagcacagctttcaggatgaaggagtaggagagaacaataaggatgaggtcagagcccaggagggtccagcctgccacaaactggtagagccggttgaaggtgatgtcatcacaagagagtttggacacagacaggttagtgcagatgcagttcttgatgatgttccctgcacaatatctgagtcgggaagaaaggactggaacaggaaggaaaaagaggccattccgggccacaacaaatatggtagctctaaccacaaaacggtcggtgattatggatgggtatcgtagtgggtggcaaatggccacatagcggtcataggccatgaccatgaatgtgcaggactccatggcaaggaagcaattcatgatgaacatctggaggaagcaggcagaaaagctgatggacctgaggtcaaaccagaagatggccaggaccttggggatgacagtcaggcagagcacgatgtccagcagggagaggaggctgagcaggtagtacatgggctcgtgcagagaggcctccagctggatggtgagcaggagggtggcgttggcccccatggccaggaggaaaaggaggctgaggggcagagacaaccaatgctgccaactctggtagttaggaaagcagatgaggaggaattcggagactggagcagtggagtagttgctgggtgaggccatgtaaagtgctctg

SEQ ID NO: 3490 - protein, 313 aa, Felis catus
MASPSNYSTAPVSEFLLICFPNYQSWQHWLSLPLSLLFLLAMGANATLLLTIQLEASLHEPMYYLLSLLSLLDIVLCLTVIPKVLAIFWFDLRSISFSACFLQMFIMNCFLAMESCTFMVMAYDRYVAICHPLRYPSIITDRFVVRATIFVVARNGLFFLPVPVLSSRLRYCAGNIIKNCICTNLSVSKLSCDDITFNRLYQFVAGWTLLGSDLILIVLSYSFILKAVLRIKAEGAAAKALSTCGSHFILILFFSTVLLVLVITNLARKRIPPDVPILLNILHHLIPPALNPIVYGVRTKEIKQGIQKLLRRL

SEQ ID NO: 3491 - DNA, 942 bp, Felis catus
tcacatccctgtccccatcaatttcttaattccttgttttatctctttgatctgaacctcataaacaatagggttcaaggcagggggtatgaggtgatgaaggacattgagcaggatgaggatgtctatggggaccctatttctggccatgtttgtcaacaccacaaccagcagaatggtgctgatgaacaggatgaggatgaaatgagagtcacatgcgttcaggtctttgacagcagccccctcagccttgaacctaagcacagctcttaagatgaaggtataggagaagatgaggatgaaatctgagcctattaatgtccaaccagccacaaattggtagatgccgttaagggtgaaactgtcacaggagagcctggacacagacaagttggcacagattcagttctcaatgacattttcccacagtaatggagctgggaagagagaataggaatagataggtacagtgagtagggcatttcatgtgattatgaagaaattagccttggccacaaattggtcagtgattatggaaggatattgtagtgggtggcagatggccatgtagcgatcataggccataaccctgaatgtgcaggactccatggggaggaagctgttcatgataaacatctggaggaagcagacagaaaagctgatggacctgaggtcaaacagaagatggccaggaccttggggatgacagtcaggcagagcatgatgtccagcagggagagcaggctgagcaggcagtacatgggctcgtgcagagatgcctccagccagatagtggtcaacagggtggtgttggcccccatggccaggataaaaaggaggctgaggggcagggacagccagtgctgccaactccggtagttagggaagcaaatgaggaggaattgagactggagcagtggagtagttgccgggtgaggccat

SEQ ID NO: 3492 - protein, 105 aa, Felis catus
WPHPATTPLLQSQFLLICFPNYRSWQHWLSLPLSLLFILAMGANTTLLTTIWLEASLHEPMYCLLSLLSLLDIMLCLTVIPKVLAIFCLTSGPSAFLSASSRCLS

SEQ ID NO: 3493 - DNA, 952 bp, Felis catus
tcagatccatccttttagggagaataccctgagtactcgctggcggatctgctgagtctttaccccatagacaacaggattgagtgcaggtggcacgaggaggtagagtgtggccagaagaacatggacatgatggggtacatggtggccaaagcggtgagtgaggaaggagaatattccaggaacatagaagatcaggatgacacaaatgtgagacccacatgtgctaaaggccttaagtcgggcctcaccccccggtactttcagcactgtctggaggatgaaagcataggaaataccaatggccacgacatctagcccaaccacaagcagggccactgccaacccataagctcggttcactgtggtttctgagcaggcaagtttcaccacagccatatgttcacaataggcatggcctatgacagtggcctggcagaagataagtctccgcaacaggatagggaaggggaggaggaggagtaacccccgtaccagcactgccattccaatgcgccctatgatccctggatgcaagatggtggaatggtgcagagggtgacaaatggctacatagcgatccagagccatggccacaagtacacctgactccatggaagagaacgcatggatgaagaacatttgggtcaggcagacagtgtacccaatctcatgggcatgaaccaggagcactgcaagggttttgggtgcagtggaggacgccagcaccaggtcaatgccagagagcatggccagaaagaggtacataggctggtgcaaggatgggtcagtccagatgataaagatgatggtgacattgcccattacagcaaagagataaaggacactcagcggcattgctatccagtgctggctttcctctaaaccggggatgcccatcaggaaaaaagaaggctgcagtagcctccagctggaattactaagggccatc

SEQ ID NO: 3494 - protein, 316 aa, Felis catus
MALSNSSWRLLQPSFFLMGIPGLEESQHWIAMPLSVLYLFAVMGNVTIIFIIWTDPSLHQPMYLFLAMLSGIDLVLASSTAPKTLAVLLVHAHEIGYTVCLTQMFFIHAFSSMESGVLVAMALDRYVAICHPLHHSTILHPGIIGRIGMAVLVRGLLLLLPFPILLRRLIFCQATVIGHAYCEHMAVVKLACSETTVNRAYGLAVALLVVGLDVVAIGISYAFILQTVLKVPGGEARLKAFSTCGSHICVILIFYVPGIFSFLTHRFGHHVPHHVHVLLATLYLLVPPALNPVVYGVKTQQIRQRVLRVFSLKGWI

SEQ ID NO: 3495 - DNA, 963 bp, Felis catus
tcaggtgggatcaatctgcttggtcctcagccttttaagcagctgctcccggatctgcttggtcttgaccccatagacaatggggtccagtgcagggggaaagagcaagtagagattggcaaggatgaccttagcagcagaggctgtgggtgggccaaagcgctgcatgactacagaaagaaagcctggtccatagaagaagaggatgacacagacatgagctgtacatgtgctgccagctttagcacgtgcctcaggtgaaggaaaatgaatcacggtcctcacaatgtgcccataagagtaggcaataaaggccacatcccccacaccaagaaagattgccacagcaaaggcatagaggttatccacagtggtggccccacaggccagcttcactactgccatatgctcacagtaggtataggcaatcgtgtgagagccacagtaggacagccgacgggccaagcttggaaaggagatggtcaatcccacacctcgcagcactaccaggcctccaatcttggcaacaacaaccggggtaagaatggttgcataatgtagtgggttacagatggccacgaagcggtccacggccatggccaccagcactcctgactccatagcagagaatgcatggatgaagaacatctgggaaagacaggagtgggagctgatagctgtagcaccaaaccagaagatggccagcatcttgggcagagtagagagggagagaaccaggtcaacaaaggagagcatggcaagaaagaaaaacatgggctggtgaaggctgtgctctgtccggatgagaaaaagcaggacaccattcccagtcactgccaggaagaacataaagcaaaagggaagtgagatccaaatgtgggcagcagtcagtcctgggatgccagccaagaagaaggtatgtgggaagtgatgagaattattggaaagaattatggtgatcat

SEQ ID NO: 3496 - protein, 320 aa, Felis catus
MITIILSNNSHHFPHTFFLAGIPGLTAAHIWISLPFCFMFFLAVTGNGVLLFLIRTEHSLHQPMFFFLAMLSFVDLVLSLSTLPKMLAIFWFGATAISSHSCLSQMFFIHAFSAMESGVLVAMAVDRFVAICNPLHYATILTPVVVAKIGGLVVLRGVGLTISFPSLARRLSYCGSHTIAYTYCEHMAVVKLACGATTVDNLYAFAVAIFLGVGDVAFIAYSYGHIVRTVIHFPSPEARAKAGSTCTAHVCVILFFYGPGFLSVVMQRFGPPTASAAKVILANLYLLFPPALDPIVYGVKTKQIREQLLKRLRTKQIDPT

SEQ ID NO: 3497 - DNA, 896 bp, Felis catus
tggggctcccaggcattcatgggtggcagcactggctctccctgcccctggctctgctctacttcttagctctttgtgctaatctcctcatcatcattaccatccaacatgaggccacgctgcatatgcctatgtaccattttctgggcatactggctgttgtggacatgggcctggccaccaccatcatgcccaagatcctggctaccttctggtttgatgccaaggccatcagcctccctgagtgttttgctcagatctatgccatccactgtttcttcttcatggaatctggtatcttcctctgcatggcattggacagatatatagccatctgtcacccccttcgatacctgtctatagtcactgacacttttgtggtcaaaaccacaggattcatggtgctcaggaattgactgtttactatcccagttccaatactgtctgcccagagacactattgctccaagaaagaaattgaccactgcctgtgctctaatttgggggtcaccagtctagcctgtaatgacatcactgtgaacaaattttaccaactgatcttagcatggatcctgactgggagtgatatggctctggttttttcttcctatgtgttaatccttcactctgtgctgaggttgaactcaccagaagcaatatcaaagctctggggacctgtagctcccacctcattctcaatctcttcttctatacaggtatcaccgtgctatctgtcacataccttgcagagaaaaatacgcccctaatccctgtgctgcttaatgtactgcacaatgtcatcccccctgcactcaatcccatggtctatgcactcaggatgcaagagctcagactgggcttccagagactgcttggactgagtgaagatatgtcca

SEQ ID NO: 3498 - protein, 137 aa, Felis catus
GLPGIHGWQHWLSLPLALLYFLALCANLLIIITIQHEATLHMPMYHFLGILAVVDMGLATTIMPKILATFWFDAKAISLPECFAQIYAIHCFFFMESGIFLCMALDRYIAICHPLRYLSIVTDTFVVKTTGFMVLRN

SEQ ID NO: 3499 - DNA, 966 bp, Felis catus
atggataccaccctgagtataaccaatagctcaaggcttcaagtgtctgagttcatcctggtggggctcccaggcattcatgagtggcagcactggctctccctgcccctggctctgctctacatcttagctctcattgccaacatcctcatcttgatcaccatccaacatgagccttccctgcaccagcccatgtatcagctccttggcatcttggctatcgtggacattggcctggctaccaccatcatgcccaagatcctggccattctctggtttgatgccaaggccatcagcctccacgagtgctttgctcagatctatgctatccatactttcatgtgcatggagtcaggcatcttcctctgcatggctgtggatagatatgtagccatttgctacccccttcagtactcctccctagtcaatgaggcttctgtgaccaaagccaccctgtccatggtgctcaggaatggcctgttgaccatcccactgcctgtactggctgcccagcgacactactgctccagaaatgaaattgaccactgtctgtgctctaatttgggggtcactagtctggcctgtgatgacgtcactattaacagagtataccagttggccttggcatgggttacacttgggggtgacatgggtctggtctttgcttcctatgctttgattgttcgctcagtgctgaggctgaactccactgaagcaacatcgaaggccctgagtacctgcagctcccatctcatcctcattgtcttcttctacacagccattattgtgctgtctgtcacccacctggcaggaagaaaggtccccttcatccctgttctcttcaacgtgctgcataatgttatgcccccagcctttaaccccatggtgtatgccctccggacccaggagctgagagtgggcttccagagggtgcttggtttgggtgagaatgtgtccaggaagtga

SEQ ID NO: 3500 - protein, 321 aa, Felis catus
MDTTLSITNSSRLQVSEFILVGLPGIHEWQHWLSLPLALLYILALIANILILITIQHEPSLHQPMYQLLGILAIVDIGLATTIMPKILAILWFDAKAISLHECFAQIYAIHTFMCMESGIFLCMAVDRYVAICYPLQYSSLVNEASVTKATLSMVLRNGLLTIPLPVLAAQRHYCSRNEIDHCLCSNLGVTSLACDDVTINRVYQLALAWVTLGGDMGLVFASYALIVRSVLRLNSTEATSKALSTCSSHLILIVFFYTAIIVLSVTHLAGRKVPFIPVLFNVLHNVMPPAFNPMVYALRTQELRVGFQRVLGLGENVSRK

SEQ ID NO: 3501 - DNA, 969 bp, Felis catus
ttagcccggaggggaagcacagcaccaagtcctgatgtcgaagaaccggtgggctacaccctcccggatctgcttagtcttcacaccatagacaatgggattgagcattggtggcaccaccacataaagattggccagcagaatatggacatgtcgaggaatgttatgtccaaagcggtgggtcaataatgtaaagaaggatggaacataaaacataaggatgacacagaggtgggagccacaagtgctaagggccttgtgccgggcatcctgggagggcaaacgaaacacggctcggaggatcagtgagtaagacacagcaattaggatcacatccacgatgaccatgacaatgggcactgagaagccataccagatgttaatggtgatgtcagcgcaggccaagcgggccactccaatatgctcacaataggaatgggggacaatgttggtccggcagaagggcagccgcttcaataagaagatcactgggaagatgatgcagaagcttctggtgacaatggccagaccaatccttcccacaacacgccatgttagcatggctgtataatgcagggggacacagatggccacaaagcggtcaaaggccatggctaacaggatggctgactcccccacaaacatcacatggacaaagaaaacttgggtgacacaggcatcaaaggcaatgtcatgggcatggagccaaaagatggctagagccttgggtacggtagtagtggacagcaggatgtccgtgatggccagcatggagagaaagaagtacatgggctcatgaagattacgttctgtgatgatgaccactaccaggatgctgttccccacgatggcagtgatatacatgaggcagaggggtattgacagccaaatgtggtaagcctcccatccagggatgcccagtaggacaaaaactgcagggtgaaagatggtaaagttggtgtgagtcat

SEQ ID NO: 3502 - protein, 322 aa, Felis catus
MTHTNFTIFHPAVFVLLGIPGWEAYHIWLSIPLCLMYITAIVGNSILVVVIITERNLHEPMYFFLSMLAITDILLSTTTVPKALAIFWLHAHDIAFDACVTQVFFVHVMFVGESAILLAMAFDRFVAICVPLHYTAMLTWRVVGRIGLAIVTRSFCIIFPVIFLLKRLPFCRTNIVPHSYCEHIGVARLACADITINIWYGFSVPIVMVIVDVILIAVSYSLILRAVFRLPSQDARHKALSTCGSHLCVILMFYVPSFFTLLTHRFGHNIPRHVHILLANLYVVVPPMLNPIVYGVKTKQIREGVAHRFFDIRTWCCASPPG

SEQ ID NO: 3503 - DNA, 963 bp, Felis catus
atggcagaaggtccacattccaactccaccttcccacgcccaaccttcttcatactgactggcattccagggctagggcctgcccaggcttggctgacactggtcttcgggcccatgtatctgttggccctgctgggcaatggagcactgctgacattggtgcagatagattccacactgcagcagcccatgtttctactcctggccgcactggcagccacagacctgggcttagctacatctatagccccagggttgcttgctgtgctgtggcttggaccccggcctgtgccatacagtgcctgcctggtccagatgttctttgttcatgcactgactgctgtagaatctggtgtactgctggccatggcctgtgatcgtgccgtggcagtagggcgtccactgcactaccctctcctagtcaccaaagcccgtgtaggctatgcagtcctggcactggcactgaaagctgtggctattgttgtgcctttccctctgctggtggcgcgatttgagcacttccaagccaagaccatagaccatgcctactgtgcacacatggcggtggtagaactggtggtgggcaacacacgggccaacaatttgtatgggctagcgctttcactggctgtgtctggtatagatatcctgggcatcactggctcttatgggctcattgctcatgctgtgctgcggctgcctacccaggaggcccgtgctaaggcctttggcacatgtagttcccacatatgtgtcattctggccttctatgtacctggtctcttctcctacctcacacatcgctttggtcgtcacactgtcccaaagcccgtacacatccttctctctaatatttatttgctgctgccacctgccctcaacccactcatctatggggtccgcaccaagcaaatcagggaccgactcctggaaatcttcacattcagaaaaagccagttctaa

SEQ ID NO: 3504 - protein, 320 aa, Felis catus
MAEGPHSNSTFPRPTFFILTGIPGLGPAQAWLTLVFGPMYLLALLGNGALLTLVQIDSTLQQPMFLLLAALAATDLGLATSIAPGLLAVLWLGPRPVPYSACLVQMFFVHALTAVESGVLLAMACDRAVAVGRPLHYPLLVTKARVGYAVLALALKAVAIVVPFPLLVARFEHFQAKTIDHAYCAHMAVVELVVGNTRANNLYGLALSLAVSGIDILGITGSYGLIAHAVLRLPTQEARAKAFGTCSSHICVILAFYVPGLFSYLTHRFGRHTVPKPVHILLSNIYLLLPPALNPLIYGVRTKQIRDRLLEIFTFRKSQF

SEQ ID NO: 3505 - DNA, 944 bp, Felis catus
atgggagaaggaaaccaaacttctgtggctgaatttatcttgctgggactttcacaggatccaaaggtccagatcctgctgttctgtgttttccttaccatttaccttctctctgtgtttggaaacctgcttgtaataatcctcattcaaagtgactctcgacttcacactcccatgtactttttcctcaaaaacttgtcctttgctgacctctgtttctctacaagcattgttcctcagatgttggtccacttcctcgtaaaaaggaaaaccatttcctttgctggatgctcactgcagataattgtcttccttttagcagggtgtacagagtgtgcacttctggcagtgatgtcctatgaccgctatgtggctgtctgcaagcccctgcattattccactgtcatgacccagagggtttgtgtccagttggccatagtgtcttggatcagtggggcatttgtatgttcagtggacagtgcatttacactgtgtcttccctaccagggacagaatataattaatcattatttttgtgaacctcctgcactcctgaagctggcttcagcagacacctacaatgctgagatggctctcttttcaatgggtgtgattatcctcttagcacctctctccctcatccttgtctcctactggcatattatctcaacagtgattcagatgcagtcagaggaggggaggctcaaggtcttttctacctgtggctctcatctcactgttgtggttctctactatggctctggaatatttgcctatatgagacccaattccaagacaatgaatgaaaaggatcaggtcgtctctgtgttctattcagttatgacttccatgttgaaccccataatttatagcctgaggaacaaggacgtgaagggtgctctcaggaggctggttggaagatagtctgccttcagaggcagtga

SEQ ID NO: 3506 - protein, 307 aa, Felis catus
MGEGNQTSVAEFILLGLSQDPKVQILLFCVFLTIYLLSVFGNLLVIILIQSDSRLHTPMYFFLKNLSFADLCFSTSIVPQMLVHFLVKRKTISFAGCSLQIIVFLLAGCTECALLAVMSYDRYVAVCKPLHYSTVMTQRVCVQLAIVSWISGAFVCSVDSAFTLCLPYQGQNIINHYFCEPPALLKLASADTYNAEMALFSMGVIILLAPLSLILVSYWHIISTVIQMQSEEGRLKVFSTCGSHLTVVVLYYGSGIFAYMRPNSKTMNEKDQVVSVFYSVMTSMLNPIIYSLRNKDVKGALRRLVGR

SEQ ID NO: 3507 - DNA, 927 bp, Felis catus
atggagtactggaactccaccctgggcagtggctttatattgatggggattctgaaagacagtgggtctcctgaactgctctgtgtcataatcacagtcctgtacatgttggccctgaccagcaatggcctgctgctcttggtcatcacagtggattcccggctccacgtgcccatgtacttcctgctcgggcagctctcactcatggacctcctcttcacatctgttgtcactcccaaggctctcatggattttctgcgcagtgaaaacaccatctcctttgcgggctgtgcccttcagatgttcctggcattgatgctgggtggtgcagaggacctgctactggccttcatggcctatgatagatatgtggccatttgtcatcctctgaactacatggtcttcatgaggccaagggtctgctggctcatggtggccacagcatggatactggcatccttaagtgccattgtttataccatgtataccatgcagtatcccttctgcaaagcccggaacatcaggcacctgctctgtgagattccacctttgctgaagttggcctgtgcagatacctctagatatgaactgtttgtgtatgtgatgggtgtgaccttcctgatgccccctctccttgcaatcatttcttcctatgcactaatcctgtttactgtgcttcacatgccctcaaatgaggggaggcagaaagccctagtcacctgctcttcccatctgactgtggttgggatgttctatggagctgccacattcatgtatgtcttgcccagttccctccacagccccaagcaagacaacatcacctctgttttctacacggttgtcactccagccctgaacccccttatctacagcttgaggaataaggaagtcatgggggctttgaagagagtgctgggaaaatacatg

SEQ ID NO: 3508 - protein, 309 aa, Felis catus
MEYWNSTLGSGFILMGILKDSGSPELLCVIITVLYMLALTSNGLLLLVITVDSRLHVPMYFLLGQLSLMDLLFTSVVTPKALMDFLRSENTISFAGCALQMFLALMLGGAEDLLLAFMAYDRYVAICHPLNYMVFMRPRVCWLMVATAWILASLSAIVYTMYTMQYPFCKARNIRHLLCEIPPLLKLACADTSRYELFVYVMGVTFLMPPLLAIISSYALILFTVLHMPSNEGRQKALVTCSSHLTVVGMFYGAATFMYVLPSSLHSPKQDNITSVFYTVVTPALNPLIYSLRNKEVMGALKRVLGKYM

SEQ ID NO: 3509 - DNA, 931 bp, Felis catus
aaaaagattattttgcagtcactctcctgagagcccctttgacatccttgtttctcagactataaatgatcgggttcaacatgggtgtcactgctgagtagaacacagagatcattttatccctttcattcattatcttggagtttggcctcatataggcaaatattgctgagccatagaagaggacaacaacaatgagatgggagccacaggtagagaaagccttgaatctcccctccccagactgcatttggatcacagcggagataatattccagtaggagacaaggatcaggcagacaggagctaggaggatgaccacgcccattgcaaagatggccatttctgtgctataggtatttgtggaagccagcttcaggagggcaggaggttcacaaaaaaagtggttaatgatattgttcccttggtagggcagacacagtgtgaatgtggtatccactagagatactaacgctccactgacccaggaccctaaggccagctggacacataaccaatgcgtcatgatagaagagtagtgcaagggcttacatacagccacataccggtcataggacatcaccgccagcagtgcacactctgtacacccaaccagaagtaaaacaaatatttgagttgagcatccagcaaaggaaatggttttcctctttgccaggaagtggactagcacctggggcactgtggtggtagagaaacagagatcagcaaaggacaagtttctaaggaaaaagtacatgggtgtgtggagtctggagtctgtgtggatgagcacaatgataagcagatttcccagtacagtcagcaggtagatgatcagaaaaaggaagaagagcaggagttgtgtgtgtggatcctgtgaaaggcccaggaaaacaaattcagtcacgtaggtttggttttcttctcccat

SEQ ID NO: 3510 - protein, 307 aa, Felis catus
MGEENQTYVTEFVFLGLSQDPHTQLLLFFLFLIIYLLTVLGNLLIIVLIHTDSRLHTPMYFFLRNLSFADLCFSTTTVPQVLVHFLAKRKTISFAGCSTQIFVLLLVGCTECALLAVMSYDRYVAVCKPLHYSSIMTHWLCVQLALGSWVSGALVSLVDTTFTLCLPYQGNNIINHFFCEPPALLKLASTNTYSTEMAIFAMGVVILLAPVCLILVSYWNIISAVIQMQSGEGRFKAFSTCGSHLIVVVLFYGSAIFAYMRPNSKIMNERDKMISVFYSAVTPMLNPIIYSLRNKDVKGALRRVTAK

SEQ ID NO: 3511 - DNA, 924 bp, Felis catus
ctatcttccaaatgctttcctaaatgcctcctttacctccttgtttctcaggctgtaaatgaatgggttcatcatggatgttatgactgagtagaacacagaaatcaccttatccccttcatttaccttcttggaatttggacgcatgtaggtaaatatagttgagccgtagaagaagaccacaacaatgagatgagaaccacaggtagaaaaggccttaagtctccccttacctgactgtatccgaatcacagtggagataatattccagtaggagaaaaggatgagggagacagggccaaggagaattactatgcccattgccaagatggccatctcagctttgtaggtttcttctgaagccaacttcaagagtgcaggaggttcacaaaaataatgattaattatattctgtccatggtatgagagacataaagtaaatattgtgtctactaaagacacaatggctccactggcccaggaccctatgatcagctgtacacacaccctctgggtcatgagggtggagtagtgaaggggcttacagacagccacatagcggtcataggacatcactgctaggagggaactttctgtacacccagctactaggaaaaaaatcatctgaattgaacacccagcaaaggaaatggtctttctcaaatccagcaagtggaatagcatctgggggatgactgttgtagagaaacatagatcagtaaacgacaggtttttaaggaagaagtacattggtgtatgaagtcgagagtcaatatgaattagcactatgatgagaaaattcccacacagagtcagcaggtagatgatgagaaacactacaaacagcaggatttgggtctgccaatctgaagaaaggcctagcaagatgaattcagtcagataggtttggttttctgtgcccat

SEQ ID NO: 3512 - protein, 307 aa, Felis catus
MGTENQTYLTEFILLGLSSDWQTQILLFVVFLIIYLLTLCGNFLIIVLIHIDSRLHTPMYFFLKNLSFTDLCFSTTVIPQMLFHLLDLRKTISFAGCSIQMIFFLVAGCTESSLLAVMSYDRYVAVCKPLHYSTLMTQRVCVQLIIGSWASGAIVSLVDTIFTLCLSYHGQNIINHYFCEPPALLKLASEETYKAEMAILAMGIVILLGPVSLILFSYWNIISTVIRIQSGKGRLKAFSTCGSHLIVVVFFYGSTIFTYMRPNSKKVNEGDKVISVFYSVITSMMNPFIYSLRNKEVKEAFRKAFGR

SEQ ID NO: 3513 - DNA, 917 bp, Felis catus
cccagtactctcctggaggcttctattacctccttctttctcagactatagacaagagggttcagtgttggagtaatgataatacaaaatagagagagaatgttgtcctgttggggactatggtagtaattgggctggatgtacatcaacatggcagctccatagtacattcctaccacagtcaggtgagaagagcatgtggtgaggactttcttccttcccttacccgaggacatgtgaaggacagcaattaggacaaacgtataagaggcaaggatagcagcaagggtaggcatgagaaagatcacacctatcacatataccatgagctcatatatggaggtatctgcacaggccaatttcaacaagggtgggatctcacagagtaggtgcctcattttccgagacatacagaaaggaaagtgcatagtatatgaagtgagtatcacagcattcaggaatgccaggatccaaggtgtggctattgtgagccagcatatccttggcctcatgcggaccatgtagtgcaaaggatgaaaaatagccacatacctgtcataggccatgaacgccagtagtaagtcctctgcacctcctgaagtgagaactactaacatctgaaaggtgccgccttcaaaggagatggtgttctccccatgcagataatccacaagcatttggggagtaactgcagatgcaaacatcaagtccatgagagatagctggctaagtagaaggtacataggcacatggagccaggaatccattataatgaccaagagcagcaggccattgctggtcagggccaacatgtataggacagcgattgtggcaaaaagcagtttgggaaccccactgtcattcagagtctccgctaatgtgaagtcatttcccaaggtggagttccagagctccat

SEQ ID NO: 3514 - protein, 306 aa, Felis catus
MELWNSTLGNDFTLAETLNDSGVPKLLFATIAVLYMLALTSNGLLLLVIIMDSWLHVPMYLLLSQLSLMDLMFASAVTPQMLVDYLHGENTISFEGGTFQMLVVLTSGGAEDLLLAFMAYDRYVAIFHPLHYMVRMRPRICWLTIATPWILAFLNAVILTSYTMHFPFCMSRKMRHLLCEIPPLLKLACADTSIYELMVYVIGVIFLMPTLAAILASYTFVLIAVLHMSSGKGRKKVLTTCSSHLTVVGMYYGAAMLMYIQPNYYHSPQQDNILSLFCIIITPTLNPLVYSLRKKEVIEASRRVLG

SEQ ID NO: 3515 - DNA, 957 bp, Felis catus
ttagcaaagacaatctctcaagaaaagggcttggccactagacatggtttttctgatggcatctttgacctccttgttcctcaggcaatagataatagggttgagcatgggagtaaagactgcatatatggctgagatcaatttgttagaattgaatgaagcaatggctcgaggtcggacatacatgaagatcacagctgtatagaagatgaccaccactgtaaggtgagaggcacaggtggagaaggtcttccactgcccagtggctgagggaatgtgcaggatggtagagacaatgaagccataggaaaggacagtggctgagaggggaaacacaagaatgaaaatggctagcacaaagtctaccatctcagccatagaaaaatccatgcaggccagtttgaggataggagaaacatcacagaaaaaatggttcaagatattattgccacagaaggcaactcgggagatgaagtatacctttgccatggagatggtgaagccactcacccaggaactgatggtcagctgaacgcaaaatcctgtggtcatcatggctggataacgaagaggacaacatatagccacgtaacggtcataggccatggcagccaagagcacacattcagtacaggcaagtgagatgaagaaatagagttggatcatgcatcccaggaaggagatggtattgggacgaagtaggaatccagccaacatcttagggactgtgacagatacataccaagtctccagaaaggacatggtgcccagaaaatagtacataggcttgtgcagggacccagtaacccatacagtgagaatgataaccaaattctccagcagcacaaacaggtaggtgatgaggaagacaaggaaaagcagaacctgtagccaaggggaagtatggaagcccaccaggatgaattcactaacataggtggtattttcctttgacat

SEQ ID NO: 3516 - protein, 318 aa, Felis catus
MSKENTTYVSEFILVGFHTSPWLQVLLFLVFLITYLFVLLENLVIILTVWVTGSLHKPMYYFLGTMSFLETWYVSVTVPKMLAGFLLRPNTISFLGCMIQLYFFISLACTECVLLAAMAYDRYVAICCPLRYPAMMTTGFCVQLTISSWVSGFTISMAKVYFISRVAFCGNNILNHFFCDVSPILKLACMDFSMAEMVDFVLAIFILVFPLSATVLSYGFIVSTILHIPSATGQWKTFSTCASHLTVVVIFYTAVIFMYVRPRAIASFNSNKLISAIYAVFTPMLNPIIYCLRNKEVKDAIRKTMSSGQALFLRDCLC

SEQ ID NO: 3517 - DNA, 945 bp, Felis catus
ttagctaagcaggaggcactgcccaacccccatggtctttttgacagcattttttacttcctggtttctaaggcagtagatgaagggatttagcatgggtgtgaggactgcatacacagctgagattagtttgttggaattaaatgatgcaatagctctgggccgaacatacataaaaatcatggctgtataataaattatgaccacagtgaggtgggatgcacaggtggagaaggctttcttccttccctgggtggagggtatccgcagaatggtggagacaatgtatacataggaaaggacagtggtgatgagtgggaagacaagaatgacaatagccaaagcaaagtccactagctcagctgtggacatgtctttgcaagccagcttaaggattggtgagatatcacagaaaaagtggttcatgacattagaaccacaaaaggcaacatgtgaaatgaaataaactttgatgacagagaccatgaaaccacttacataggagaacgccactagctgtacacaacaacctgtggtcataatgactgggtattggagagggtggcaaatggccacatagcggtcataggccatggttgccagaagcacacactctgtgcaggcgagcgagataaagaagtagagctgggtcatgcaacctgtgaaggagatgcgccgtttctgcaaaaggaatccatccagcatcttggggactgtgacagagacataccagacctccagaaaggacaagctactcaggaaatagtacatgggcttatggagggagccagtgatccaaacagtgagcatgatgataagattctctattatcaccagcaagtagaccacaaggaagaggaagaagagcaggacttgtagccatggggcagtggggaagcccaccaagatgaattcactgaccagagtgatgtttttccccagcat

SEQ ID NO: 3518 - protein, 314 aa, Felis catus
MLGKNITLVSEFILVGFPTAPWLQVLLFFLFLVVYLLVIIENLIIMLTVWITGSLHKPMYYFLSSLSFLEVWYVSVTVPKMLDGFLLQKRRISFTGCMTQLYFFISLACTECVLLATMAYDRYVAICHPLQYPVIMTTGCCVQLVAFSYVSGFMVSVIKVYFISHVAFCGSNVMNHFFCDISPILKLACKDMSTAELVDFALAIVILVFPLITTVLSYVYIVSTILRIPSTQGRKKAFSTCASHLTVVIIYYTAMIFMYVRPRAIASFNSNKLISAVYAVLTPMLNPFIYCLRNQEVKNAVKKTMGVGQCLLLS

SEQ ID NO: 3519 - DNA, 954 bp, Felis catus
atggctgaaggaaaccagacaagggttggggagtttatcctcatgagcttctcttccctacctactgaaatacagtcactactcttcctgacatttctaatcatctacctggtcacgctattgggaaacagcctcatcattcttgttaccttgactgaccccatgctgcacagccccatgtacttcttcctcaggaacttgtccttcttggagattggcttcaacctagtcatcgtgcccaagatgctggggaccctgcttgcccgggacacaaccatctccttccttggctgtgccatgcagatgtatttcttcttcttctttggagttgctgaatgcgtcctcctggccgccatggcatatgaccgctatgtagccatctgcaatcccttgcactacccagtcatcatgaaccagaggacacgtgccaaattggctgttgcctcctggtttccaggctttcccgtagctactgtgcagaccacttggctcttcagctttccattctgtggcaccaacaaggtgaaccacttcttctgtgacagcccacctgtgctgagactggtgtgtgcagacacagcaatgtttgagatctatgcgattgttggaactgtgctggtcgtcatgataccctgcatgctgatcctgtgttcctacattcgcattgctgctgccatccttaagattccatcagctaaagggaagcataaagccttctctacctgctcctcccacctccttgttgtctccctattctatgtatcttcaagcctcacctacttccggcctaaatccaataattcgcctgagagcaaaaagctgctgtcattgtcctacactgttgtgactcccatgttgaaccccatcatctatagcctgagaaataatgaggtgaagaatgcccttggccggaccttctgcaaggctttcggccttagaatttgcatcccatag

SEQ ID NO: 3520 - protein, 317 aa, Felis catus
MAEGNQTRVGEFILMSFSSLPTEIQSLLFLTFLIIYLVTLLGNSLIILVTLTDPMLHSPMYFFLRNLSFLEIGFNLVIVPKMLGTLLARDTTISFLGCAMQMYFFFFFGVAECVLLAAMAYDRYVAICNPLHYPVIMNQRTRAKLAVASWFPGFPVATVQTTWLFSFPFCGTNKVNHFFCDSPPVLRLVCADTAMFEIYAIVGTVLVVMIPCMLILCSYIRIAAAILKIPSAKGKHKAFSTCSSHLLVVSLFYVSSSLTYFRPKSNNSPESKKLLSLSYTVVTPMLNPIIYSLRNNEVKNALGRTFCKAFGLRICIP

SEQ ID NO: 3521 - DNA, 970 bp, Felis catus
atgtcaatgaaatcctggacagaagaatgatgtggggaaactggacaattgtcagtgagtttgtccttgtgagtttttcaaccttatcctctgagctacaagctctactatttctcctttttttgactgtttacctggttactctaatgggcaatattctcatcatcctggtcactacagctgactctgctctacaaaaccctatgtacttcttcctcaggaacttgtccttcctggagataggcttcaacttggtcattgtgcccaagatgctggggactctgatcatccaagacacaaccatatccttctttggctgtgcctctcagatgtatttctttttcttctttggggctgctgagtgttgcctcctggccacaatggcatatgaccgctatgtggccatctgtgaccctttgcgctacccaatcattatgaaccgcaaggcctgtgcccagctagcagctgcctcttggttctcagggtttccagtggccaccgtgcaaaccacatggattttcagcttccctttttgtggccccaacatagtgaaccacttcttttgtgacagcccccctgtcattgcactggtctgtgctgatacctctctgtttgaactggaggctctgacggccactgtcttattcatcctctttcctttcttgctgatcctgggatcctatgtccgcattctttccactatcttcaggatgccctcagctgaggggaaacgcaaggccttctccacctgttcctcccaccttctggttgtgtccctcttctacagcactgccatcctcacatacttccgaccccggtccagcacctctcctgagagcaagaagttgttgtcgctctcctacacagtagtgactcccatgttgaaccccatcatctacagcttaaggaacagtgaagtgaagtctgcactgaggcgagtcatccgcaggaccctgggccctcagaaact

SEQ ID NO: 3522 - protein, 315 aa, Felis catus
MMWGNWTIVSEFVLVSFSTLSSELQALLFLLFLTVYLVTLMGNILIILVTTADSALQNPMYFFLRNLSFLEIGFNLVIVPKMLGTLIIQDTTISFFGCASQMYFFFFFGAAECCLLATMAYDRYVAICDPLRYPIIMNRKACAQLAAASWFSGFPVATVQTTWIFSFPFCGPNIVNHFFCDSPPVIALVCADTSLFELEALTATVLFILFPFLLILGSYVRILSTIFRMPSAEGKRKAFSTCSSHLLVVSLFYSTAILTYFRPRSSTSPESKKLLSLSYTVVTPMLNPIIYSLRNSEVKSALRRVIRRTLGPQKL

SEQ ID NO: 3523 - DNA, 948 bp, Felis catus
tcagtggaagatttcaagcctgcatgagaaattccttgtggctacttttctcagagctcccttcacgtccttgtttctcaagctatagatgaggggattaagcataggtgtcaccactccataaaacacagacaccagtttttcctgttctttggaagactttggagtcatgtaagtgacaattgctgacccataaaaaaggatgaccaccatgaggtgggagccacaggtagagaatgccttgagcctccccacagctgacttcatcctgaccacagtcactatgatgtgactataggataccagaattagggaaacaggtatgaggagaatcacaacacccatgaggaaaatgaccatctctgaagtatgagtgtctgtggatgccaggatcaacagtgcaggggcctcacaaaagaaatgagcaatactattgctgccttggtagggtaaacttagtgtaaaagtggtatctaccacagacaccagaatgccgctggtccatgatcctgcagccagctggacacacaccctccaagtcatgatgctagggtaatgcaaagggttgcagatggccacgtaccgatcataggacatcactgccagaaaggcacactgggtgcacccaaaaatgaggaagaatagaagctgagttgcacaacgtgtgaatgaaatgaccttcttctgggatagcaggtgggctagggcctggggaacgatgttggtagaaaaacagaagtcagccagagataagttgcagaggaaaaaatacatgggtttgtgaagccgggagtcaacctgaacaaggtacgtgagaagtagatttgcaagcacagtgatgaggtagacacccaggaataaaatgaatagcaacttctgggtgtgtgggtcatcagaaagtcccagaaggaggaattctgtcacctgtgtctgatttgtttctctcat

SEQ ID NO: 3524 - protein, 315 aa, Felis catus
MRETNQTQVTEFLLLGLSDDPHTQKLLFILFLGVYLITVLANLLLTYLVQVDSRLHKPMYFFLCNLSLADFCFSTNIVPQALAHLLSQKKVISFTRCATQLLFFLIFGCTQCAFLAVMSYDRYVAICNPLHYPSIMTWRVCVQLAAGSWTSGILVSVVDTTFTLSLPYQGSNSIAHFFCEAPALLILASTDTHTSEMVIFLMGVVILLIPVSLILVSYSHIIVTVVRMKSAVGRLKAFSTCGSHLMVVILFYGSAIVTYMTPKSSKEQEKLVSVFYGVVTPMLNPLIYSLRNKDVKGALRKVATRNFSCRLEIFH

SEQ ID NO: 3525 - DNA, 945 bp, Felis catus
atgggcgaggaaaaccaaacctctgtggctgagtttattttctttggcctttcacaggacttgaagaccgaaatcctgctatttactctttttctcatcatttatcttttgactgtatttggaaacctgctcatcatcattctcatcttcatggattctcgacttcacactcccatgtacttttttcttagaaacctctctttcgcagatctctgtttctctactagcattgtcccccaagtgttggtccacttccttgtaaagaggaaaactatttctttttttggatgtgtgacacagataattgtcttccttctggttgggtgtacagagtgcgcactgctggcggtgatgtcttatgaccggtatgtggctgtctgcaagcccctgcactactctactatcatgacccaccaggtgtgtctccagttggccataggatcctgggccagtggggcactggtgtctctggtggataccacctttactttccaactaccctatcaaggacagaacattattaatcactacttttgtgaacctcctgccctcctgaagctggcttcagcagatacttatagcacagaaatggccatctttgcaatgggcgtggtcatcctcttagctcctgtctgcctgatccttgtctcctactggaatattatctccactgtgatccagatgcagtctggggaggggaggctcaaggctttctctacctgtggctcccatctcattgttgtcatcctcttctatgggtcaggaatattcacctacatgcggccaaactccaagaccacaaaagagcgggataaaatgatatctgtgttctatacagtggtgacgccaatgttgaaccccataatttatagcctgagaaacaaggatgtcaaaggggctctcaggaaactagctggaagaaagtccttttttcagaggcagtga

SEQ ID NO: 3526 - protein, 314 aa, Felis catus
MGEENQTSVAEFIFFGLSQDLKTEILLFTLFLIIYLLTVFGNLLIIILIFMDSRLHTPMYFFLRNLSFADLCFSTSIVPQVLVHFLVKRKTISFFGCVTQIIVFLLVGCTECALLAVMSYDRYVAVCKPLHYSTIMTHQVCLQLAIGSWASGALVSLVDTTFTFQLPYQGQNIINHYFCEPPALLKLASADTYSTEMAIFAMGVVILLAPVCLILVSYWNIISTVIQMQSGEGRLKAFSTCGSHLIVVILFYGSGIFTYMRPNSKTTKERDKMISVFYTVVTPMLNPIIYSLRNKDVKGALRKLAGRKSFFQRQ

SEQ ID NO: 3527 - DNA, 930 bp, Felis catus
gaaaaccacacagcagtgacagagttcattattctgggattaacagataatcccacactatgtgccatcttctttgtgatttttctgggagtttatgtagttaccatagtgggaaatatcagtataatcatcttaatccgaagcagcccacagctgcacaccccaatgtacctttttctcagccatttggcctttgtggacattgggtattccacgtcagtcacgccaatcatgctaatgagttttttaagagagaaaacaactatccctatcactggttgtatagcccagcttggctctgatgtcacttttgggactacagaatgcttcctgctggctaccatggcctatgatcgctatgtggccatctgctctcccttactctactccacccagatgtcctcagtggtctgcttcctcctactgggggcttcctacctgggtggatgcatgaacgcttcatcatttacaggctgtctgatgaatctatctttctgtggaccaaataaaatcaaccattttttctgtgacctctttccactcttgaagctttcttgtggccatgtttttattgctgaaatatctcccgccatctcttctgcatctgtcctcataagcacactgtttaccataattgtgtcctacagctacatcctccactcaattctgaatatgcgctctactgaggggaggaagaaagccttctcaacctgcacttcccacctcactgccgtcactttgttttatgggacagttttgttcgtttatgtgatgcccaagtccagttattcagctgatcaggtcaaagtggcctctgtcatctatacagtggtggtccccatgttgaatcccctcatctacagtctgaggaacaaggaggtgaaaggggccatgagaaaactaatggccagaacacactggttttcctga

SEQ ID NO: 3528 - protein, 309 aa, Felis catus
ENHTAVTEFIILGLTDNPTLCAIFFVIFLGVYVVTIVGNISIIILIRSSPQLHTPMYLFLSHLAFVDIGYSTSVTPIMLMSFLREKTTIPITGCIAQLGSDVTFGTTECFLLATMAYDRYVAICSPLLYSTQMSSVVCFLLLGASYLGGCMNASSFTGCLMNLSFCGPNKINHFFCDLFPLLKLSCGHVFIAEISPAISSASVLISTLFTIIVSYSYILHSILNMRSTEGRKKAFSTCTSHLTAVTLFYGTVLFVYVMPKSSYSADQVKVASVIYTVVVPMLNPLIYSLRNKEVKGAMRKLMARTHWFS

SEQ ID NO: 3529 - DNA, 968 bp, Felis catus
ttaatgtccggtgttcttctactccccatctgagggatgaacctatttgtcttgcctaataccttccttagggctgtctgcatgtctttgtttctgagactgtaaacgatggggttaagcagaggtgtcagcactgtgtacgtgaccgccatcagcatatcttcacggaatgagtccctgtccttgggcctcaaatagacaaagccagcaaatccatagtgtatgcacaccacagtgaggtgggaggagcaagtggagaaggccttatacttccccttggtagagggcatcttcacaactctggacacaatgaagacataggacatcataatgaaaacaaagctgcccaccaacacgaaggcagagagcacaaaaatagccatttcgtgatgggaggtgtaatcacaggcaaggcagaccacaggtgagatgtcacagaagtagtgctcgatgatgttggagtcacagaaagacaagttgaatacagtgatgacgatgcacagagaaaccaggaacccagccatccaagaggccatcatgaactgaaagcagatcttatgggtcatcaagaccttatagtgcagtgggctgtgaatggcagtgtaacggtcgtaagacatggcagccatgatgaagcagttattggctcccaagccaaagaagaaaaacatctgtgtggcacactcaggaagagagatggccttgctatctgacagcaagtccactagcatgcgggggatgattgccatagtggtacaagtttctgaaaaggacaggccacagaggaaaaaatacatgggggtgtgaaggttgtgactcagcttgatggccaccattatgcacacatttgcagctaggatggtcacatgggagaagaaaatcatcacaaagaggagaccctgcaagtctgggaaactggaaaacccccacagaaggaatgtgctcactgtggtatgattgtccatcat

SEQ ID NO: 3530 - protein, 323 aa, Felis catus
  MOD_RES (323)..(323): Any amino acid
MMDNHTTVSTFLLWGFSSFPDLQGLLFVMIFFSHVTILAANVCIMVAIKLSHNLHTPMYFFLCGLSFSETCTTMAIIPRMLVDLLSDSKAISLPECATQMFFFFGLGANNCFIMAAMSYDRYTAIHSPLHYKVLMTHKICFQFMMASWMAGFLVSLCIVITVFNLSFCDSNIIEHYFCDISPVVCLACDYTSHHEMAIFVLSAFVLVGSFVFIMMSYVFIVSRVVKMPSTKGKYKAFSTCSSHLTVVCIHYGFAGFVYLRPKDRDSFREDMLMAVTYTVLTPLLNPIVYSLRNKDMQTALRKVLGKTNRFIPQMGSRRTPDIX

SEQ ID NO: 3531 - DNA, 968 bp, Felis catus
atgatgggcaatcataccacagcgagcacattccttctgtgggggttttccagtttcccagacttgcagggtctcctctttgtggtgattttcttctcccatgtgaccatcctagctgcaaatgtgtgcataatggtggccatcaagctgagtcacaaccttcacacccccatgtattttttcctctgtggcctgtccttttcagaaacttgtaccactatggcaatcatcccccgcatgctagtggacttgctgtcagatagcaaggccatctctcttcctgagtgtgccacacagatgtttttcttctttggcttgggagccaataactgcttcatcatggctgccatgtcttacgaccgttacactgccattcacagcccactgcactataaggtcttgatgacccataagatctgctttcagttcatgatggcctcttggatggctgggttcctggtttctctgtgcatcgtcatcactgtattcaacttgtctttctgtgactccaacatcatcgagcacttcttctgtgacatctcacctgtggtctgccttgcctgtgattacacctcccatcacgaaatggctatttttgtgctctctgccttcgtgttggtgggcagctttgttttcattatgatgtcctatgtcttcattgtgtccagagttgtgaagatgccctctgccaaggggaagtataaggccttctccacttgctcctcccacctcactgtggtgtgcatacactatggatttgctggctttgtctatttgaggcccaaggacagggactcattccgtgaagacatgctgatggcggtcacatacacagtgctgacacctctgcttaaccccatcgtttacagtctcagaaacaaagacatgcagacagccctaaggaaggtattaggcaagacaaataggttcatccctcagatggggagtagaagaacactggacattaa

SEQ ID NO: 3532 - protein, 323 aa, Felis catus
  MOD_RES (323)..(323): Any amino acid
MMGNHTTASTFLLWGFSSFPDLQGLLFVVIFFSHVTILAANVCIMVAIKLSHNLHTPMYFFLCGLSFSETCTTMAIIPRMLVDLLSDSKAISLPECATQMFFFFGLGANNCFIMAAMSYDRYTAIHSPLHYKVLMTHKICFQFMMASWMAGFLVSLCIVITVFNLSFCDSNIIEHFFCDISPVVCLACDYTSHHEMAIFVLSAFVLVGSFVFIMMSYVFIVSRVVKMPSAKGKYKAFSTCSSHLTVVCIHYGFAGFVYLRPKDRDSFREDMLMAVTYTVLTPLLNPIVYSLRNKDMQTALRKVLGKTNRFIPQMGSRRTLDIX

SEQ ID NO: 3533 - DNA, 926 bp, Felis catus
tgccaagctctctctcttcagagccaccttcatctcactcttcctgaggctgtagatgagggggttcaatatggggatcaccaccatgtagaacacagacaccaccttgttctggtccgttgagtagccggacttgggcatcacataaatgagcgtgttcgtcctatagcacagagtgaccgctgtgaggtgggatgtacaagtggaaaaggccttgtggcgtcccttggtggagcacatcttcaggatggtgatgaggatacggatgtaggaggcagctctgacacaccgtgaccacaacaatggagccagccgtctacgaggggacacttgcggaggtgctgataccagagtgggagagtttaactaaaggagcaaaatcacagagaaagtgatggacttgatttgttccgcagaagagtaaaaaaagagaagcaaatagtagaagagaagcattgagaaaactacctacacaagccaccgtgagtcagcgaacacacacctgtgtggacattttggttgaataaagcagcgggtcacagatggccatgaagcgatcagatgtcatggcagccagaaggaggcactcacttgacccaaagaaaacagctgagctcacctggacagcacgtccaagacaggagattgtatgtctctccatcaggaagtttacaagcatatgaggtgtgacagaagatgaagagcctatatcagccaagggcaggcagctcagaaaaaactacctaaggtggtggggctgagaggcgagtctgataagaatgattgtactgaggttgccagatatggtcgccaggtagatgcaaaggatggttatgaagaggatggctcagaagacaggttatcagttaggcccgatgaaatgaaccctgtcattgcagtgtggttcccatcccccagggaatcca

SEQ ID NO: 3534 - protein, 80 aa, Felis catus
MCSTKGRHKAFSTCTSHLTAVTLCYRTNTLIYVMPKSGYSTDQNKVVSVFYMVVIPILNPLIYSLRKSEMKVALKRESLA

SEQ ID NO: 3535 - DNA, 946 bp, Felis catus
agagaagaaaatggcaagaggcaaccgtaccacagtgacagaatttgtccttatgggattcacagagtgtcctgagctgcagcttcccctttttgtggtattcctggtaatttatctcatcaccctggtaggaaaccttggcatgatcctactcatcaaggtggatccaaggctccacacccccatgtactatttcctcagccacctggctttcatcgatgtttgctactcatcttccattgggcccaagatgctacaaaatttattggcaaagaaaaaaaccatctccttttcaggctgttttgcccagctgtacttctccagtgcttttgccactactgaatgcttcctcttggccacaatggcctatgaccgctacatggctatctgcaaccccctgatttacccagccgttatgactcagcgggtctgcaaggagttggtgataggcgtctatacctacggcttcctgaactctgtaatacaaacagttctgacttttcaattgtctttctgcgactccaatatcatccaccatttctactgcgctgaccctcctctccttgccctctcctgctctgacacccgcaccaaagagaagcagctcttgatcttctctgcagtgaatctcagtggatccttcctgactgtcctcatctcctacatctgcatcctcctttccattataaaaattcagtcttctgaaggcaagtgcaaagccttttccacctgtgcctcccacctcactgtggtcatcgtcttctatggaacgctgtttttcatgtacatgcagcaacccaaagcagggaattcatggaagtacaacaaagtggtctctgtgttttatagtcttgtcattcccctgctcaaccccctgatctataccctgaggaacacagaagtaaaggacaccctgaaaaagatgctagaaggcaaagagccatag

SEQ ID NO: 3536 - protein, 311 aa, Felis catus
MARGNRTTVTEFVLMGFTECPELQLPLFVVFLVIYLITLVGNLGMILLIKVDPRLHTPMYYFLSHLAFIDVCYSSSIGPKMLQNLLAKKKTISFSGCFAQLYFSSAFATTECFLLATMAYDRYMAICNPLIYPAVMTQRVCKELVIGVYTYGFLNSVIQTVLTFQLSFCDSNIIHHFYCADPPLLALSCSDTRTKEKQLLIFSAVNLSGSFLTVLISYICILLSIIKIQSSEGKCKAFSTCASHLTVVIVFYGTLFFMYMQQPKAGNSWKYNKVVSVFYSLVIPLLNPLIYTLRNTEVKDTLKKMLEGKEP

SEQ ID NO: 3537 - DNA, 946 bp, Felis catus
tcagaatatgtgtgaatccacctttcttcgccacaatttcatcaaagctcttttcatctcactgtttctcaagctgtagatcagtggattcaacagaggtgtaagaagtgagtaggacaatgacatcaccttctttgtttctggggagtagccagatttgggttggatataagtcatattggctgtgccatagaagagggtcacagacgtgagatgggaggcacaggtggaaaaggccttttgcctcccggtggccgatggcatcttcaggatggcaaagagaatccgaatataagacaagagaatcaacacaaaggggaccatgacaatcaaaatggtgccagtgaacgcatagatttcaaacagaaaggtgtctgcacatgcaagttctagcactgctggggtttcacaagagatgtgattgatttcattggggccacagaaaggaaaactaaaaacccatgtggtctgcacagtagccaccatgatccctgagacccatgagaacattactaatttcatgaaaacccttttgttcataatcattgggtagctcaggggatggcagattgcagcaaatcggtcataagccatcacccccaggagaaaacattcagtcccaccaaaaaaaaagaataaaatacatctgtgcaaaacagctcacaaatgaaattgacgttttctcagtggagaggaccaccagcatttcaggcataatgactgcactgaaactcacatccaccacagacaggttctgcaggaacaggtacatgggaacgtggaggctctgttccagggagatgatgactataatgatggcatttcccatcagagtcccaaggtaaacaaccaagaaaaccccaaagagctgctcttggagttcaggaaagttagaaaagcccaagaggatgaattcaaccacagagctttgattttgccttttcat

SEQ ID NO: 3538 - protein, 197 aa, Felis catus
MAYDRFAAICHPLSYPMIMNKRVFMKLVMFSWVSGIMVATVQTTWVFSFPFCGPNEINHISCETPAVLELACADTFLFEIYAFTGTILIVMVPFVLILLSYIRILFAILKMPSATGRQKAFSTCASHLTSVTLFYGTANMTYIQPKSGYSPETKKVMSLSYSLLTPLLNPLIYSLRNSEMKRALMKLWRRKVDSHIF

SEQ ID NO: 3539 - DNA, 963 bp, Felis catus
tcatcttgatattttcaatctgcacattgtctccttcagagcctgctgtacctgcttattgcgcagagtgtagatgacagggttgagcagtggcgttaccaccgtgttcacaagggcagcctccctgttggagttcagcctgttcctttgctttggtttcacgtatataaagacacagctgccatacatcagagagaggacaatgaggtgagacgagcaggtggagaaagctttctgtcgctccttggctgatgggagtcgcacaattgtgactactatgttgctgtatgcaatgatggttatgataagcgatgtcaaaaggatcaacaaagcgatgacaaaggccaacatttcaacagacctggtattagaacaggagagatgaatcaaaggatcaaggtcacagaagaagtggggaatgacatgggggccacagaacgataactgggaaaccattactagtggaccagtgatgagaatgaaggccaaaacacagcaggcagtgaccaagaggaagcaagtcttgaggttcatgatggttgggtaatgcaggggcttgcaaatggccatgtaccgatccacagacatcactgctatgaggaggaaacctgctgctcccagatagacaaacacaaaggcttgtatgaaacaggcaagaaaggaaatggtttgccggcctaaaagaaagatgaccagcaacttaggaataacagcacttatgaaacaacactcaaagaaggagaaagtgctgaggaaaaagtacataggtgtctggagccgggagtcagcacaggtgatggtgactatgacagcattgcctgtaatggatgccaggtaggccagcaggtgcaccaggaagaggacctttcccaggtgttggatggcaggaaacccctccaaggtgaattcttggacagtggtcccgttccctatttccatgggcatctctttccacagcatcat

SEQ ID NO: 3540 - protein, 320 aa, Felis catus
MMLWKEMPMEIGNGTTVQEFTLEGFPAIQHLGKVLFLVHLLAYLASITGNAVIVTITCADSRLQTPMYFFLSTFSFFECCFISAVIPKLLVIFLLGRQTISFLACFIQAFVFVYLGAAGFLLIAVMSVDRYMAICKPLHYPTIMNLKTCFLLVTACCVLAFILITGPLVMVSQLSFCGPHVIPHFFCDLDPLIHLSCSNTRSVEMLAFVIALLILLTSLIITIIAYSNIVVTIVRLPSAKERQKAFSTCSSHLIVLSLMYGSCVFIYVKPKQRNRLNSNREAALVNTVVTPLLNPVIYTLRNKQVQQALKETMCRLKISR

SEQ ID NO: 3541 - DNA, 960 bp, Felis catus
tcttgatattttcattctgcacattgtctctctcagaacctggtggacctgcttattccgcagagtgtagatgacagggttcaacagcggggtcaccaccgtatgcacaagggcagcctccctgttggagttcagcctgttggtttgctttggtttcacgtatataaagacacagctgctgtatatcagggagaggactatgaagtgagaggagcaggtggagaaagctttctgtcgctccttggctgatgggagtcgcacaattgtgactactatgttgctgtatgcaatgatggttatgataagcgatgtcaaaatgataaacaaagcaatgacaaaggccaacatttcaacaaacctggtattagaacaggagagatgaatcagggaaccaagatcacagaagaagtgggggatgacattggggccacagaacgataactgggaaacctttactatcagaccagtgatgagaaggaaggccaaaacacagcaggcagtgaccaagaggaagcaagtcttgaggttcatgatggttgggtaatgcagaggcttgcaaatggccatgtaccgatccacagacatcactgttatgaggaagaaacctgtggctccgaggtatacatacacaaaggcttgtatgaaacaggcaagaaaggaaatggtttgccggcctaaaagaaagatgaccagcaacttaggaataacagcacttatgaaacaacactcaaagaaggagaaagtgctgaggaaaaagtacataggtgtctggagccgggagtcagcacaggtgatggtgactatgacagcattgcctgtaatggatgccaggtaggccagcaggtgcaccaggaagaggacctttcccaggtgttggatggcaggaaacccctccaaggtgaattcttggacagtggtcccgttccctatttccatgggcatctctttccacagcatcat

SEQ ID NO: 3542 - protein, 320 aa, Felis catus
MMLWKEMPMEIGNGTTVQEFTLEGFPAIQHLGKVLFLVHLLAYLASITGNAVIVTITCADSRLQTPMYFFLSTFSFFECCFISAVIPKLLVIFLLGRQTISFLACFIQAFVYVYLGATGFFLITVMSVDRYMAICKPLHYPTIMNLKTCFLLVTACCVLAFLLITGLIVKVSQLSFCGPNVIPHFFCDLGSLIHLSCSNTRFVEMLAFVIALFIILTSLIITIIAYSNIVVTIVRLPSAKERQKAFSTCSSHFIVLSLIYSSCVFIYVKPKQTNRLNSNREAALVHTVVTPLLNPVIYTLRNKQVHQVLRETMCRMKISR

SEQ ID NO: 3543 - DNA, 927 bp, Felis catus
atggcctggggccgcagccagaacctctccacattcatcctactgggcttcccggggccacggggcctgcagacctggctcttcctcctcttcctggtcgcgtacgtgctcacggtggccgggaacctggccatcatctccctggtcggggcgcaccggcgcctgcagacgcccatgtacttcttcctctgcaacctctccttcctggagatctggttcaccacggcctgtgtgcccaaggccctggccacgttcgcctcgcacagtggagccatctccttggccggctgcgcggcgcagatgtacttcgtcttctcgctgggctgcaccgagtacttcctgctggccgcgatggcttacgaccgctacctggccatctgcctgccgctgcgctacggcagcaccatgacgcctgggctctccgcccgcctcgctctgggctcctggctgtgcggcttctccgccatcaccgtgcccgctgccctcattgctcgcctctccttctgccgctcccacgtcatcaaccacttcttctgtgacatcgcgccctggatcgtgctgtcctgcagcgacacgcggggtgtggagctggcggccttcggcattgccttctgtgtcatcctgggctcctgctttgtcacgctgctctcctacgcctacatcgctgccaccatcatcaggatcccctcggcccggggccggcacagagccttctccacctgctcctcccatctcaccgtggtcctcatctggtacggctccaccatcttcctgcatgtgaggacctcggtggagagctcgctggacctgaccaaggccgtcacggtgctgaacaccgttgtcactcccgtgctgaaccccttcatatacaccctgaggaacaaggacgtcagggaggctctgcggaggtcggtgcagcggaagtga

SEQ ID NO: 3544 - protein, 308 aa, Felis catus
MAWGRSQNLSTFILLGFPGPRGLQTWLFLLFLVAYVLTVAGNLAIISLVGAHRRLQTPMYFFLCNLSFLEIWFTTACVPKALATFASHSGAISLAGCAAQMYFVFSLGCTEYFLLAAMAYDRYLAICLPLRYGSTMTPGLSARLALGSWLCGFSAITVPAALIARLSFCRSHVINHFFCDIAPWIVLSCSDTRGVELAAFGIAFCVILGSCFVTLLSYAYIAATIIRIPSARGRHRAFSTCSSHLTVVLIWYGSTIFLHVRTSVESSLDLTKAVTVLNTVVTPVLNPFIYTLRNKDVREALRRSVQRK

SEQ ID NO: 3545 - DNA, 938 bp, Felis catus
gggcacccagggcctgggccaccctctgcactgccttgcgtagggcctccttgacctcctggttccgcaggcagtagatgatggggttgagcaggggcgtgagcaccgtgtagaccacggacaccaccttgttgaagtcaaaggagtagatggcgcgtggccgggcgtagatgaagagggaggcggagtagaagatgaccaccacggccaggtgcgaggcacaggtggagaaggccttgcgccggccggcggcggacgggatgcgcagcacggtgccgaggatggcggcgtacgagaagatggtgagctgcagcggccccagcaggatgagcagagccaggaggaagtcgaccagctccgccacggacacgtcggagcacgcgaggctcagcaggggggacacgtcgcagaagaagtggttcatgacgttggggccacagtagcccaggcgtgagatgaagaagacctttcccaaggagacggtgaagcccgagagccaggagctggcggccaggaagctgcagaggctggggctcatgatggccgggtagcgcagggggctgcagatggccacgtagcggtcgtaggccatgacgcccaggagcgtgcactcggtgcaggccagcgccaggaagaaatacagctgcgtcatgcagcccgtgaaggagatgtgtcggaactggggctccgccaggctgagcagcatcttgggcacggtgacggagacgtaccacacctccaggaaggacaggttgctgaggaagacatacatgggcttgtgcagctgggggctgacccggatcacggcgacgacgaccacgttctctgtgacggtcagcatgtaggccagcgtgaacagcaccaccaggcacacttggaggcccagcgagcccgagaagcccaccaggatgaactctgtcacctccgagcgattgtcc

SEQ ID NO: 3546 - protein, 313 aa, Felis catus
  MOD_RES (313)..(313): Any amino acid
DNRSEVTEFILVGFSGSLGLQVCLVVLFTLAYMLTVTENVVVVAVIRVSPQLHKPMYVFLSNLSFLEVWYVSVTVPKMLLSLAEPQFRHISFTGCMTQLYFFLALACTECTLLGVMAYDRYVAICSPLRYPAIMSPSLCSFLAASSWLSGFTVSLGKVFFISRLGYCGPNVMNHFFCDVSPLLSLACSDVSVAELVDFLLALLILLGPLQLTIFSYAAILGTVLRIPSAAGRRKAFSTCASHLAVVVIFYSASLFIYARPRAIYSFDFNKVVSVVYTVLTPLLNPIIYCLRNQEVKEALRKAVQRVAQALGAX

SEQ ID NO: 3547 - DNA, 903 bp, Felis catus
gaacagcctccggagggcagctttgacctccgtgttcctcagggagtagataagggggttcagggagggcgccaccgaagtgtagatcacagacaccaccttgtccttgtgcaatgagtatctggatgctgggcggatgtaggtgtagatgacagtgcagtagtacagggagaccaccaggaggtgggaggagcaggtggagaaggcccgtcgcttgcctgaggccgagcggatgcgcaggatgctggcgatgatgcagccgtaggagagcatgatcacagagaagttccccaaggccaggatcacgtctgcagtgaaggccatggcctcgttcaggcgtgtcggggcacaggagagcttcagcagaggggggatctcacagaagaagtgctcgaccacgttggaatggcagaagggcaggtgcagcaggaggccggtgttcacactagtgttggccaggctgatggtccacacggccacggccaagagcctgcaaacccgggagtccatgagggtgctgtagcgcaggggccagcagatggccacgtagcggtcataggccatggcggaaaacagcagcagctcagctcccagagaccacgtgaaggagaaaagctgcactatgcaacccccgtaggagatggtcctgtcagccaccatgctgcccaggagcttgggcaggatcgtggaggtgcagaggatgtccaccacggccaggtttaccaggaagaagtacatgggggtgtgcaaggcagggcaggagccaatggccaccatgatgagcaggtttccagagagggccaccatgtagaggaggaggaagacaggaaagaggagcatttgcagctgaggtgtttctgagaatcccagaatgaggaactcggtgaccagtgtctggttcat

SEQ ID NO: 3548 - protein, 301 aa, Felis catus
MNQTLVTEFLILGFSETPQLQMLLFPVFLLLYMVALSGNLLIMVAIGSCPALHTPMYFFLVNLAVVDILCTSTILPKLLGSMVADRTISYGGCIVQLFSFTWSLGAELLLFSAMAYDRYVAICWPLRYSTLMDSRVCRLLAVAVWTISLANTSVNTGLLLHLPFCHSNVVEHFFCEIPPLLKLSCAPTRLNEAMAFTADVILALGNFSVIMLSYGCIIASILRIRSASGKRRAFSTCSSHLLVVSLYYCTVIYTYIRPASRYSLHKDKVVSVIYTSVAPSLNPLIYSLRNTEVKAALRRLF

SEQ ID NO: 3549 - DNA, 980 bp, Felis catus
ctagctgtcttgcgtgacacagttgaagagcaacagggaaggtgggacaatttcctggagagcaggtctccccagagcagggctaggacagcagatttcacctctgcattcctcaggctgtagatgatggggtttagtgagggcgtcacgaccccatagaacaatgcaataatcttatccaggttggggtcctcggccttggacttgaagtacatgaaggagatggtcccgtagaaaaccaccacaactgtgaggtgggcagagcaggtggagaaggctttgcaccggcctgcggcagagggcaccctaaggatggcagcaaggatgagaatgtaggacaggcagatgaggaggagtggggccagcgtcaggacagccgtggccatgattaatagcagtgcattgagagagatgtccccacaggacagtttcagcactgccaagatctcacagaagaagtgattgatgatattgtggccacagaaggggaggctccaggtgagaagggactgcagcagtgaattggcaaaacctgtcccccagctcagcactgccatccacaggcacgtccacctactcatgatctctgtgtacctaagcggctggcagatagccacataacggtcatatgccatcacagccaggagcaggcactccgtggagcccagcgccagggtcaggtacatctgcagggcacaaccaaggaaggagatggtcctttgggcttccaggaagttggtcagcatgagaggcacaaaggaggatgtgccacagatgtccatgagggagaggttgctgagaaagaagtacatggggctgtgcaggcgggggtccagcatgtttaggccgatgaggagggagttccccagcacattcatggagtagatgcccaggcagagcacaaacaggaccatctctaggttagggtgctcgtgtagccccagcaagatgtattctgtcacagccgtctggtttgccat

SEQ ID NO: 3550 - protein, 327 aa, Felis catus
  MOD_RES (327)..(327): Any amino acid
MANQTAVTEYILLGLHEHPNLEMVLFVLCLGIYSMNVLGNSLLIGLNMLDPRLHSPMYFFLSNLSLMDICGTSSFVPLMLTNFLEAQRTISFLGCALQMYLTLALGSTECLLLAVMAYDRYVAICQPLRYTEIMSRWTCLWMAVLSWGTGFANSLLQSLLTWSLPFCGHNIINHFFCEILAVLKLSCGDISLNALLLIMATAVLTLAPLLLICLSYILILAAILRVPSAAGRCKAFSTCSAHLTVVVVFYGTISFMYFKSKAEDPNLDKIIALFYGVVTPSLNPIIYSLRNAEVKSAVLALLWGDLLSRKLSHLPCCSSTVSRKTAX

SEQ ID NO: 3551 - DNA, 954 bp, Felis catus
tcacttggaggtccaacttctaccccacactttcctggcagcctccttcacttccgtgttcctcaagctgtagatgacagggttcagcatgggtgtgaccacggcatagaggaccgtgaagacctcgtcagagatgcgtgccttcttgctcttgggtttcatgtacgtgaatattacggtgccatagaaaagcatcaccacagccaggtgtgccgagcaggtggagaaggctttgcggcgcccagcggctgaaggcaccctcaggatggtggccagaataagtatgtaggacaggcagatgaatgccaggggtacaggcagcagcagaatggcgcccaccagcaggaagacttcactgactgacgtgtcgccgcatgccagcttcagcactgccaggatctcacaggtgaagtgactaaccacttggcggccacagaagggcaacctcatggcaatgaccgtctcagtcaccgacttgaagaggcagaggccccaggcggttcccgccaggaagaagcagagccggtggctcatgagcacggggtacctgagtggccggcaaatggccaggtagcgatcgtaggccatgatagcgagcagtagacactctgtggagcctgcggacaggctcagacacatctggactgcacagccaataaaggagatggtcttctgagctgacaggaggtggaccagcatcagaggcacaaaggtggacgtgtagcagatgtccaggatggagaggttgcccaggaagaagtacatgggtgtgtgcaggcggacatctaagacactcactgccacgatggcagtgtttcccagcagggtcaccaggtacatggctgagcacagagggaagagcaggtgctccagggccgggtagccagaaaatcctttcagaaagaactcagagatctctgtcctattgaccagctccatactgcagcgctcagg

SEQ ID NO: 3552 - protein, 312 aa, Felis catus
MELVNRTEISEFFLKGFSGYPALEHLLFPLCSAMYLVTLLGNTAIVAVSVLDVRLHTPMYFFLGNLSILDICYTSTFVPLMLVHLLSAQKTISFIGCAVQMCLSLSAGSTECLLLAIMAYDRYLAICRPLRYPVLMSHRLCFFLAGTAWGLCLFKSVTETVIAMRLPFCGRQVVSHFTCEILAVLKLACGDTSVSEVFLLVGAILLLPVPLAFICLSYILILATILRVPSAAGRRKAFSTCSAHLAVVMLFYGTVIFTYMKPKSKKARISDEVFTVLYAVVTPMLNPVIYSLRNTEVKEAARKVWGRSWTSK

SEQ ID NO: 3553 - DNA, 955 bp, Felis catus
ggtgaagtatttccgagccaccaggttcctcacagcagccttcacgtccttgttcctgaggctgtagatgacggggttgagcatgggggtcaccaccccatagaagagagggatgagcttatctgaaaggtcctctttgtctgcccccaggggatccttagacttgggcttcctgtacatgaaaaataaggtcccatagaagatgaccaccacagtgaggtgggcagagcaggtagaaaaggcctttttcctcccctcagctgaagggatcctcaggatggtagcaatgatgaagacataagagacagagatgaacagaactgggacccccaggaagatcacatttgtcactcccatgctgatcacattgatggagatgtcaacacaggccaacttgaggactgccaggatctcacaggcaaggtggttgatgacgttgttcccgcagaaaggcagctgaatcgtcaggggatgtgtgtaccacagaagcagccccaccaattgtccaggagctgacagccatggatacatacacagacctgctcatgaccacagggtacctcagggggttacagatggccacatagcgatcaaatgccatcacgctcaggcgcacacactctgtccctgccatggcaaaggagaggaacatctgcatggcacaacctgagaaggagatagttttcctgggagtgaggaagccatccaggactagagggatggaagaggttgtgtagcagatgtccaggaaggagaggttccccaggaagaagtacatgggcgtgtgcaggcgggagtcaaggatggtcaccaggatgaggaccccattgcccagcaggatcaccagatacatagacaggatgagcacaaagaacgttttctccagccttgggtgggctgagagtcccaggagaatgaaccccaccacgggggaggaccagttggctttttccat

SEQ ID NO: 3554 - protein, 180 aa, Felis catus
MEKANWSSPVVGFILLGLSAHPRLEKTFFVLILSMYLVILLGNGVLILVTILDSRLHTPMYFFLGNLSFLDICYTTSSIPLVLDGFLTPRKTISFSGCAMQMFLSFAMAGTECVRLSVMAFDRYVAICNPLRYPVVMSRSVYVSMAVSSWTIGGAASVVHTSPDDSAAFLREQRHQPPCL

SEQ ID NO: 3555 - DNA, 979 bp, Felis catus
  modified_base (135)..(154): a, c, t, g, unknown or other
tcactggatgaagtgtttctgaaataccaggttcctcacagcggccttcacgtccttgttcctcaggctatagatgatggggttggagcatgggggtcgaccaccccatagaagagggagatgagcttatctgannnnnnnnnnnnnnnnnnnnctgcttgtctgcccccagggggtccgttggatttggggtcttcccatacatgaaaaggatagtcccatagaagacgaccacgactgtgaggtgggcagagcaggtggagaaggcctttttcctcccctcagctgaggggatcctcaggatagtggtgaggatgaagatgtaggagataaagatgaacagaactgggacccccaggaagatcacattggctactgccatactgatcacattgatggagatatcagcacaggccaacttcaggacagccaagatctcacaggtgaagtggttaatgacgttgtcaccacagaagggcaaccgcattgctaaggatgtttgcaccatggcagtcgtgcttccagctgcccaggagctggcagccatgggcacgtagacagccttgctcatgaccacagggtacctaagagggttacaaatggccacatagcgatcaaatgccatcatgcccagaagcacacactctgtggctcccatggcgaaggaaagaaacatttgcacagcacaggctgagaagggtacagttttcctgggggtcaggaagctgtcgagaatgagggggactgaggaggttgtgtagcagatgtccaggaaggagaggttccccaggaagaagtacatgggcgtgtgcaggcgggagacagacacagtgaccaggatgaggaccccattgcccagcaggatcaccaagtacatcaggaggatgagcacaaagaacgttttctctagctttgggtgggctgagagtcccaggagaataaaccccatcacaggagaagtccaattggatctctccat

SEQ ID NO: 3556 - protein, 303 aa, Felis catus
  MOD_RES (276)..(282): Any amino acid
MERSNWTSPVMGFILLGLSAHPKLEKTFFVLILLMYLVILLGNGVLILVTVSVSRLHTPMYFFLGNLSFLDICYTTSSVPLILDSFLTPRKTVPFSACAVQMFLSFAMGATECVLLGMMAFDRYVAICNPLRYPVVMSKAVYVPMAASSWAAGSTTAMVQTSLAMRLPFCGDNVINHFTCEILAVLKLACADISINVISMAVANVIFLGVPVLFIFISYIFILTTILRIPSAEGRKKAFSTCSAHLTVVVVFYGTILFMYGKTPNPTDPLGADKQXXXXXXXQISSSPSSMGWSTPMLQPHHL

SEQ ID NO: 3557 - DNA, 960 bp, Felis catus
tcactgggtgaagcatttctgactcaccaagtttctcacagcagccttcacgtccttgttcctcaggctgtagatgatggggttgagcatcggggtcaccaccccatagaagagggagatgagcttgtctgaaaggtcctgcttgtctgcccccagggggtccttggatttgggcttcccatacatgaaaaggatagtcccatagaagacgaccacgactgtgaggtgggcagagcaggtggagaaggcctttttcctcccctcagctgaagggatcctcaagatagtggtgaggatgaagacgtaggaaacaaagatgaacagaactgggacccccaggaagatcacatttgtcactcccatactgatcacattgatggagatgtcagcacaggccaacttcaggacagccaggatctcacaggtaaagtggttgatgatgttgttcccacagaagggaagtctcattgcaagggacgtttgaaccatggaggcagcacttccagctgcccaggagctggcagccatgggcatataggtctccttgctcatgaccacagggtacctaagggggttacaaatggccacataacgatcaaatgccatcatgcccagaagcacacactctgtggctcccatggcgaaggaaagaaacatttgcacagcacaggctgagaagggtacagttttcctgggggtcaggaagctgtcgagaatgagggggactgaggaggttgtatagcagatgtccaggaaggagaggttccccaggaagaagtacatgggcgtgtgcaggcgggagacagacacagtgaccaggatgaggaccccattgcccagcaggatcaccaagtacatcaggaggatgagcacaaagaacgttttctctagctttgggtgggccgagagtcccaggagaataaactccgccacagaggcagtctggttgacactttccat

SEQ ID NO: 3558 - protein, 319 aa, Felis catus
MESVNQTASVAEFILLGLSAHPKLEKTFFVLILLMYLVILLGNGVLILVTVSVSRLHTPMYFFLGNLSFLDICYTTSSVPLILDSFLTPRKTVPFSACAVQMFLSFAMGATECVLLGMMAFDRYVAICNPLRYPVVMSKETYMPMAASSWAAGSAASMVQTSLAMRLPFCGNNIINHFTCEILAVLKLACADISINVISMGVTNVIFLGVPVLFIFVSYVFILTTILRIPSAEGRKKAFSTCSAHLTVVVVFYGTILFMYGKPKSKDPLGADKQDLSDKLISLFYGVVTPMLNPIIYSLRNKDVKAAVRNLVSQKCFTQ

SEQ ID NO: 3559 - DNA, 954 bp, Felis catus
ctaggcaaagcatttctgactcaccagagtcttcacagcgaccttcacatgcttgtttctgagactgtagatgatggggttgagcatgggagtcagcactccatagaagagggatataagcttgtctgaaaggtcctgcttatctgcccccagggggtccttggatttgggctttgcgtacatgaaaagaatggtcccatagaagatgaccaccacagtgaggtgggcagagcaggtggagaaagcctttttcctcccctcagctgaggggatcctcaggatggtagcaatgatgaagacataagagccagagatgaacagaactgggacccccaggaagatcacattggctacccccatactgatcacattgatggagatgtcagcacaggccaacttcaggacagccaggatctcacaggtgaagtggttgatgacattgtccccacagaagggtaattgtactgcaagagagatctgcaccaaggagttggctccaccagccacccaggagctgatagccatgggcacatagacagccttgctcatgaccacagggtacctcagggggttacagatggccacatagcgatcaaatgccatcatgcccagaagcacacactctgtggctcccatggcaaaggagaggaacatctgcatggcacagcctgagaaggagatggttttcctgggagtgaggaagccgtccaggactagaggaactgaagaggttgtgtagcagatgtccaggaaggagaggttccccaggaagaagtacatgggcgtgtgcaggcgggagtcaaggatggtcaccaggatgaggaccccattgcccagcaggatcaccaggtacatcaacaggatgaacacaaaaaacattttctcaagctttggctgatctgacagccccagcaagacaaatcccgctacaacagattggttgcccacttccat

SEQ ID NO: 3560 - protein, 317 aa, Felis catus
MEVGNQSVVAGFVLLGLSDQPKLEKMFFVFILLMYLVILLGNGVLILVTILDSRLHTPMYFFLGNLSFLDICYTTSSVPLVLDGFLTPRKTISFSGCAMQMFLSFAMGATECVLLGMMAFDRYVAICNPLRYPVVMSKAVYVPMAISSWVAGGANSLVQISLAVQLPFCGDNVINHFTCEILAVLKLACADISINVISMGVANVIFLGVPVLFISGSYVFIIATILRIPSAEGRKKAFSTCSAHLTVVVIFYGTILFMYAKPKSKDPLGADKQDLSDKLISLFYGVLTPMLNPIIYSLRNKHVKVAVKTLVSQKCFA

SEQ ID NO: 3561 - DNA, 957 bp, Felis catus
tcactgggtgaagtgtttctgagccaccaggtacctcaccgcggtcttaacatccttgttcctcagactatagatgatggggttgagcataggagttaaaagtccatagaagagggagatgagcttgtctgaaaggtcctgcttgtctgcccccagggggtccttggatttgggcttcccatacatgaagaggatggttccatagaagatgaccacaactgtgaggtgggcagagcaggtggagaaagcctttttcctcccttcagctgaggggatcctcaggatagtggtgaggatgaagatgtaggagacaaagatgaacagaactgggacccccaggaagatcacattggccacccccatactgatcacattgatggagatgtcagcacaggccaacttcaggacagccaggatctcacagatgaagtggttgatgacattgtccccacagaagggtaattgtactgcaagagagatctgcaccaaggagttggctccaccagccacccaggagctgatagccatgggcacatagacagccttgctcatgaccacagggtacctcagggggttacagatggccacatagcgatcaaatgccatcatgcccagaagcacacactctgtggctcccatggcaaaggagaggaacatctgcatggcacagcctgagaaggagatggttttcctgggagtgaggaagccgtccaggactagaggaactgaagaggttgtgtagcagatgtccaggaaggagaggttccccaggaagaaatacatgggcgtgtgcaggcgggagtcaaggatggtcaccaggatgaggaccccattgcccagcaggatcaccagatacatagacaggatgagcacaaagaacgttttctctagttttggatgggcagagaggccaagcaaaacaaattctgtcacagcagattggttggatgcttccat

SEQ ID NO: 3562 - protein, 318 aa, Felis catus
MEASNQSAVTEFVLLGLSAHPKLEKTFFVLILSMYLVILLGNGVLILVTILDSRLHTPMYFFLGNLSFLDICYTTSSVPLVLDGFLTPRKTISFSGCAMQMFLSFAMGATECVLLGMMAFDRYVAICNPLRYPVVMSKAVYVPMAISSWVAGGANSLVQISLAVQLPFCGDNVINHFICEILAVLKLACADISINVISMGVANVIFLGVPVLFIFVSYIFILTTILRIPSAEGRKKAFSTCSAHLTVVVIFYGTILFMYGKPKSKDPLGADKQDLSDKLISLFYGLLTPMLNPIIYSLRNKDVKTAVRYLVAQKHFTQ

SEQ ID NO: 3563 - DNA, 945 bp, Felis catus
atggacaggttcaaccagacctcccctgtggtggggttcattctcctgggactctcagcccatccaaggctggagaaaacgttctttgtgctcatcctgtctatgtatctggtgatcctgctgggcaatggggtcctcatcctggtgaccatccttgactcccacctgcacacgcccatgtacttcttcctggggaacctctccttcctggacatctgctacacaacctcctctgtccccctcattctcgacagcttcctgacccccaggaaaaccatctctttctcagcctgttttgggcagatgtttctctcctttgccatgggagctacagagtgtgtgcttctgggcatgatggcatttgatcgctatgtggccatctgtaaccccctgagatactctgtggtcatgaacaaggctatatacatacccatggctgctggctcctgggcagctggtatcaccaactctgtagttcagacatcccaggctatgaggctgcccttctgtggggacaatgtcatcaaccacttcacctgtgagatcctggctgtcctgaagttggcctgtgctgacatttctatgaatgtgatcagcatggttgtggctaatgtgattttcctgggggtcccagttctgttcatttttgtctcttatgtattcatcattgctaccatcctgaggatcccctcagctgaggggaagaaaaaggccttctccacctgctctgcccacctcacagttgtggtcgtcttctatggaaccatcctcttcatgtatgggaagcccaaatccaaggaccccctgggggcagacaagcaggacctttcagataagctcacctcccttttctatggggtggtgacccccatgctcaaccccatcatctacagcctaaggaacaaggatgtgaaggctgccgtgaagaacctggtacatcaataa

SEQ ID NO: 3564 - protein, 314 aa, Felis catus
MDRFNQTSPVVGFILLGLSAHPRLEKTFFVLILSMYLVILLGNGVLILVTILDSHLHTPMYFFLGNLSFLDICYTTSSVPLILDSFLTPRKTISFSACFGQMFLSFAMGATECVLLGMMAFDRYVAICNPLRYSVVMNKAIYIPMAAGSWAAGITNSVVQTSQAMRLPFCGDNVINHFTCEILAVLKLACADISMNVISMVVANVIFLGVPVLFIFVSYVFIIATILRIPSAEGKKKAFSTCSAHLTVVVVFYGTILFMYGKPKSKDPLGADKQDLSDKLTSLFYGVVTPMLNPIIYSLRNKDVKAAVKNLVHQ

SEQ ID NO: 3565 - DNA, 978 bp, Felis catus
atgtttcagggaaatttgacatctgtaacagtttttttcctcctgggattttcccactaccccaaagttgaggtcattgtatttgtgctgtgcttgctgatgtacctgatcaccctgctgggtaatatcattctgatctccatcaccatcctggattcccacctacacaaacccatgtacttcttcctcagcaacctctcctttttagacatctggtacacttcttctgcttttactccaatgctgacaaactttgttacaggggaaaacactatctcattcgtagggtgtgttgctcagatgtacttctctctagctatgggtgccactgagtgtgtgctcttgtccttgatggcatatgaccgatatgtggccatctgcaaccccctgagataccccatcataatgaacaggaaggtttgtttgcagattgcagctggttcctggttgacaggctacctcaccaccctggtggaaacaatatttgtgctgcagctctctctgtgtggtcataacaccatcaatcattttgcttgtgaaattctggctgtcttgaaactggtttgtgtggacacctccatggtggaattactcatgctggtgatcaccacacttatccttcccatgccagtgcttctaatttgtatatcttatgcattcattctctccaacatcctaagaattcgttcagtgggtggtcgaagcaaagccttttcaacatgtgcagcccacctaactgtggtggttttgttctttgggacagctctctccatgtacctaaagccctcagctgtggattcacaggaaatagataaatttatagctttggtatatggcggattaacccccatgttgaatcctatcatctatagtctacggaacaaagaggtgaaagcagctatgaaaaggttgctgattagaaatccttttggtactgtgttaatttctgtcctcaataatatcagagcaagcacactc

SEQ ID NO: 3566 - protein, 326 aa, Felis catus
MFQGNLTSVTVFFLLGFSHYPKVEVIVFVLCLLMYLITLLGNIILISITILDSHLHKPMYFFLSNLSFLDIWYTSSAFTPMLTNFVTGENTISFVGCVAQMYFSLAMGATECVLLSLMAYDRYVAICNPLRYPIIMNRKVCLQIAAGSWLTGYLTTLVETIFVLQLSLCGHNTINHFACEILAVLKLVCVDTSMVELLMLVITTLILPMPVLLICISYAFILSNILRIRSVGGRSKAFSTCAAHLTVVVLFFGTALSMYLKPSAVDSQEIDKFIALVYGGLTPMLNPIIYSLRNKEVKAAMKRLLIRNPFGTVLISVLNNIRASTL

SEQ ID NO: 3567 - DNA, 958 bp, Felis catus
ttattggttaacagttttccaattcagcaaatatttcacagcagcttttacatctttatttctcaagctatagattataggatttagcatgggggttactaccccataaaacatggaaataagcccctctgtagcttgcaaattgtcattccgaaggtggtcttgagacttgggtttggcatacatgaagaagatggtaccataaaatatgatcaccacagtcagatgtgctgaacaggtggaaaaggctttgcgtctccctgtggctgagttcattctcaagatggtgtaaaggatgaacatataggagaaaaaaatgactatcagtggaagaaccaggaatgccatatttgaaactgctagggtaacataattgagggttatatcagcacaagctagcttaaggacagctaatatctcacataagaaatgattgataatattattcccacagaaaggcaactgcatggcaagagatgtttgcacaattgagttgattccaccagagagccatgacacagaagccatcagtacatacaccaccttgctcatgatgatggggtatctcagagggttacagatggctacatagcgatcaaaagccatcatgccaaggaggaaacactctgttgaccccattgcaaacccaaagaacatctgcactgcacatccagagaagggaatgttccttttctttgaaattaagctcaccaaagttgagggaacagaggaggatgtatagcagatatccaggaaagacaggttgcccaggaagaagtacatgggggtggtgaagacgagaatcaaagatgcttgctatgatcaaaacaccattgccaattagaatcactagatacattactagaattagagaaaaaaaaatgatctcaagttttgggtaaccagagagtcctagaagaatgaattctttcacaaatgtcttgtttatcctatccat

SEQ ID NO: 3568 - protein, 260 aa, Felis catus
MYFFLGNLSFLDICYTSSSVPSTLVSLISKKRNIPFSGCAVQMFFGFAMGSTECFLLGMMAFDRYVAICNPLRYPIIMSKVVYVLMASVSWLSGGINSIVQTSLAMQLPFCGNNIINHFLCEILAVLKLACADITLNYVTLAVSNMAFLVLPLIVIFFSYMFILYTILRMNSATGRRKAFSTCSAHLTVVIIFYGTIFFMYAKPKSQDHLRNDNLQATEGLISMFYGVVTPMLNPIIYSLRNKDVKAAVKYLLNWKTVNQ

SEQ ID NO: 3569 - DNA, 954 bp, Felis catus
ttactgaatagctttttggtttagcagatattttacagcaatttttacatccttattcctcaagctatagattataggatttagcatgggggtcactaccccataaaacagagaaatgagcttgtctgaagtttgcaacttgtcgtccccaggaaactcttgagacttgggcttggcatacatgaagaagatggtaccataaaatatgatcaccacagtcagatgtgctgaacaggtggaaaaggctttgcgtctccctgtggctgagttcattctcaagatggtgtaaaggatgaacatataggagaaaaaaatgactatcagtggaagaaccaggaatgccatatttgatatcaccatggtgataatattgagggatatatcagcacaagctagcttaaggacagctaatatttcacatgtgaaatggttgataacattattcccacagaaaggcaactgcatggcaagagatgtttgcacaattgagttgattccaccagagagccatgacacagaagccatcagtacatacaccaccttgctcatgatgatggggtatctcagagggttacagatggctacatagcgatcaaaagccatcatgccaaggaggaaacactctgttgaccccattgcaaacccaaagaacatctgcactgcacatccagagaagggaatgttccttttctttgaaattaagctcaccaaagttgagggaacagaggaggatgtatagcagatatccaggaaagacaggttgcccaggaagaagtacatgggggtgtgaagacgagaatcaaagatgcttgctatgatcagaacaccgttgccagttagaatcactagatacattactagaattagaacaaagtacatgatctccagttttgggtaaccggagaatcccagaagaagaaattctgatgtaaatgtctggttaattttatccat

SEQ ID NO: 3570 - protein, 317 aa, Felis catus
MDKINQTFTSEFLLLGFSGYPKLEIMYFVLILVMYLVILTGNGVLIIASIFDSRLHTPMYFFLGNLSFLDICYTSSSVPSTLVSLISKKRNIPFSGCAVQMFFGFAMGSTECFLLGMMAFDRYVAICNPLRYPIIMSKVVYVLMASVSWLSGGINSIVQTSLAMQLPFCGNNVINHFTCEILAVLKLACADISLNIITMVISNMAFLVLPLIVIFFSYMFILYTILRMNSATGRRKAFSTCSAHLTVVIIFYGTIFFMYAKPKSQEFPGDDKLQTSDKLISLFYGVVTPMLNPIIYSLRNKDVKIAVKYLLNQKAIQ

SEQ ID NO: 3571 - DNA, 960 bp, Felis catus
atggaaaggaccaatgattccatgctgacagaatttgtccttgttgggctttctgcccacccaaagctccagacagttttctttgcgctagttttgtggatgtacctgatgatccttctgggaaatggaatccttatctcagtaatcatctgtgattctcacttgcacacccccatgtatttcttcctctgtaatctttccttcctggacatttgttacacaagctcctctgtcccactaattcttgacagttttctgacaggaaggaaaaaggtttccttttctgggtgcatggtgcaaatgtttctctcctttgccatgggggccacagagtgtgtgcttctaggtatgatggcactcgaccgctatgtagccatctgctacccactgagatactctgtcatcatgagcaaaaatgcctacctgcccatggcagctggatcctgggtcactgggcttgtggactcagtggtgcagacatctctcgcaatgcagttaccattctgtactagtaatgtcattaaccattttgtctgtgaaattctagctatcctaaaactggcttgtgctgatatttcaatcaatgtgatcagcatggcagggtcaaatctgattgttctggttattccactgctagtaatttctatatcttacatttttattgtcaccactatattgaggatcccctccaccaaaggaaaacgtaaggccttctccacctgctccgcccacttaacagtagtgattatattctatggaactatcttcttcatgtacgcaaagcccaagtctaaaagttctgttgatgctgataatcaagacatcattgaggccctcatctctctcttctatggagtaatggcccccatgctcaatcctctcatctatagtctgaggaacaaggatgtaaaggctgcagtgaagaacatggtgggtagaaaaaactctgatggaatctga

SEQ ID NO: 3572 - protein, 319 aa, Felis catus
MERTNDSMLTEFVLVGLSAHPKLQTVFFALVLWMYLMILLGNGILISVIICDSHLHTPMYFFLCNLSFLDICYTSSSVPLILDSFLTGRKKVSFSGCMVQMFLSFAMGATECVLLGMMALDRYVAICYPLRYSVIMSKNAYLPMAAGSWVTGLVDSVVQTSLAMQLPFCTSNVINHFVCEILAILKLACADISINVISMAGSNLIVLVIPLLVISISYIFIVTTILRIPSTKGKRKAFSTCSAHLTVVIIFYGTIFFMYAKPKSKSSVDADNQDIIEALISLFYGVMAPMLNPLIYSLRNKDVKAAVKNMVGRKNSDGI

SEQ ID NO: 3573 - DNA, 913 bp, Felis catus
atggacaggatgaactggacagagattgagttcattctgcagggactttctgagtaccccaaagtgaaaaaactccttttcgtcatgtgcttgatgatgtacctggtgatcctgctagggaacagcatcttgatcatactaactctcctagattcccgcctccatacgcccatgtacttcttccttggtaatctttctttcctaaatatttgttacacgtcctcctttatccccttaatgttaattcacttcctatcacagaagaaaaccatctccttccttagatgtgttgttcagatgtctgtctcctacactatggggtccaccgagtgcgtgcttctagcagtgatggcatatgaccgttatgtggccatctgtaaccctctgagataccccatcatcatgagcaaggcactttgtattcagatggcagccctctcctggggactgggctttctcaattcactgattaaaaactatacttgcaatacagttgcccttctgtggaaaaaatgtcatgaaccactttgtgaaatattggcctttgttaagctggcttgtgcacataatactttgactgagattgctataatgttgggcaatgtaatatttttgtttattccattattgtaaatttgtatcccctacattttcatcctttctactgtactaagaatcaattcagcagaaggaagaaaaaaggccttctgtacctgttcagcccacttaacagtagtgaccttgttttatgggacaatcctcttcatatacatgaagccaaagtccaaagactttgctgttgacaaatcgactgctctatggagtagtcactcccatgccaatgatatgcctatcatctatagcctggggaacacagaggtgttggagctgtgagaaaaatgatgagtagaca

SEQ ID NO: 3574 - protein, 210 aa, Felis catus
MDRMNWTEIEFILQGLSEYPKVKKLLFVMCLMMYLVILLGNSILIILTLLDSRLHTPMYFFLGNLSFLNICYTSSFIPLMLIHFLSQKKTISFLRCVVQMSVSYTMGSTECVLLAVMAYDRYVAICNPLRYPIIMSKALCIQMAALSWGLGFLNSLIKNYTCNTVALLWKKCHEPLCEILAFVKLACAHNTLTEIAIMLGNVIFLFIPLL

SEQ ID NO: 3575 - DNA, 910 bp, Felis catus
atggacaggatgaactggacagagattgagttcattctgcagggactttctgagtaccccaaagtggaaaaactccttttcgtcatgtgcttgatgatgtacctggtgatcctgctggggaacagccccttgatcatactaactctcctggactcccacctccatacacccatgtacttcttccttggtaatctttccttcctagatatttgttacacatcctcctttatcccctcaatgttgattcacttcctatcacagaaaaaaaccatctccttccttagatgtgttgttcagatgtctgtctcctacactatggggtccacagagtgcgtgcttctagcagtgatggcatatgaccgttacatggccatctgtaaccctctgagataccccatcatcatgagcaaggcactttgcattcagatggcagccctctcctggggactgggctttctcaattcactgacagaaactatacttgcaatacagttgcccttctgtggaaaaaatgtcattaaccactttgtttgtgaaatactggcctttgtcaaactggcttgcgcagatatttccttgaatgagattgctataatgttgggcaatgtaatatttttgttttctccattattgttaatttgtatctcctacattttcatcctttctaatgtactaagaatcaattcagcagaaggaagaaaaaaggccttttctacctgttcagcccacttaacagtagtgactgtgttttatgggacaatcctcttcatgtatatgaagccaaagtccaaagactctgctgctgacaaactgattgctctgttctatggagtagtcactcccatgctcaatcctatcatctatagcctgaggaatacagaggtgcttggagctatgagaaaattgatga

SEQ ID NO: 3576 - protein, 304 aa, Felis catus
  MOD_RES (304)..(304): Any amino acid
MDRMNWTEIEFILQGLSEYPKVEKLLFVMCLMMYLVILLGNSPLIILTLLDSHLHTPMYFFLGNLSFLDICYTSSFIPSMLIHFLSQKKTISFLRCVVQMSVSYTMGSTECVLLAVMAYDRYMAICNPLRYPIIMSKALCIQMAALSWGLGFLNSLTETILAIQLPFCGKNVINHFVCEILAFVKLACADISLNEIAIMLGNVIFLFSPLLLICISYIFILSNVLRINSAEGRKKAFSTCSAHLTVVTVFYGTILFMYMKPKSKDSAADKLIALFYGVVTPMLNPIIYSLRNTEVLGAMRKLMX

SEQ ID NO: 3577 - DNA, 971 bp, Felis catus
tgtccctttcccatttacttgttaaacatacttcttctcagtaagtgttttactgcctccttaacatctttgttcctaagactgtatattaaaggattcatcataggagttacaatcccatagaacagggatataagtttgtcagtagcatccaagtcctctgaattaagtgtgtctttagacttgggcttcatgtacatgaagagaatggttccatagaatattatcaccacagtcagatgggctgagcacgtggagtaaactttgcttctcccctcagaagagcgaattttgaggatgctgacaatgattaatgtgtaagagataatgattaataacagtggtgtcaatataaacagtgttgtgcccacgagcatgatgaactcgttgcctgagatgtcagcacaggccagtttcatgatagccagaatttcacaggagagatgattgatgacattattcccacagaaaggcaactgtactacaaatgcggtctgtactgcagagttgatgactcctatgatccaggacccaactgccatgggcacataggaatccttgctcatgatgacaggatatcttagagggttgcagatagccacataccggtcaaaggccatcatgcccaggagcacacactctgttgtccccatggccaagccgaggaacatctgtattgcacagccagagaaggatatggtctttctttctgagaggaagctcaccagaatggagggaatggaggtggtggtgtagcagatgtccaagaaggagaggttccccaggaagaagtacataggggtgtgaaggtgggggtcccagatgctgattaaaataagggtgccattgcccagaaggatgacaacatacattattaagattagtgcaaaaaagagtagctcaagccttgggtaatcagaaagccccttgagaaagaattccaccagaatggtttgattttcccattccat

SEQ ID NO: 3578 - protein, 318 aa, Felis catus
MEWENQTILVEFFLKGLSDYPRLELLFFALILIMYVVILLGNGTLILISIWDPHLHTPMYFFLGNLSFLDICYTTTSIPSILVSFLSERKTISFSGCAIQMFLGLAMGTTECVLLGMMAFDRYVAICNPLRYPVIMSKDSYVPMAVGSWIIGVINSAVQTAFVVQLPFCGNNVINHLSCEILAIMKLACADISGNEFIMLVGTTLFILTPLLLIIISYTLIIVSILKIRSSEGRSKVYSTCSAHLTVVIIFYGTILFMYMKPKSKDTLNSEDLDATDKLISLFYGIVTPMMNPLIYSLRNKDVKEAVKHLLRRSMFNK

SEQ ID NO: 3579 - DNA, 963 bp, Felis catus
cttttccattcacttgctaaagaaacttctgttaaatagatgtttcactgtctcctttacatccttgtttctgagactgtagattaaaggattcatcatgggagtcatcactccatagaacatggatatcaatttgtcagtggcatacaagtcctctgaattaagtgtctctttagacttgggcttcatgtacatgaagagaatggttccatagaatattatcaccacaatcaggtgggctgagcaggtggagaaagctttgcttctcccctcagaagtacggatcttcaggatgctagagatgattaatgagtaagatatgacaatcaaaagcaggggcatcagtgtgaacaatgttgtggccacaaccatgatgaattcattgcctgagatgtcagcacaggccagtttcatgacagccagaatttcacaagagaaatgattgatgttattcctacagaagttcaattgtatcacaaatgcagtttgcactgcagagttgataatcccagcaaaccaggacccagctgccatggacacataggaatccttgctcatgatgacaggatatcttagagggttgcagatagccacataccggtcaaaggccatcatgcccaggagcacacactctgttgtccccatggccatgccaaggaacatctgtattgcacagccagagaaggatatggtctttctttctgagaggaagtttaccagagtggagggaatggaggtggtggtgtagcagatgtccaagaaggagaggttccccaggaagaagtacataggggtgtgaaggtgggggtcccagatgctgattaaaataagggtgccattgcccagaaggatgacaacatacattattaagattagtgcaaaaaagagtagctcaagccttgggtaatcagaaagccccttgagaaagaattccaccagaatggtttgattttcccattccat

SEQ ID NO: 3580 - protein, 317 aa, Felis catus
MEWENQTILVEFFLKGLSDYPRLELLFFALILIMYVVILLGNGTLILISIWDPHLHTPMYFFLGNLSFLDICYTTTSIPSTLVNFLSERKTISFSGCAIQMFLGMAMGTTECVLLGMMAFDRYVAICNPLRYPVIMSKDSYVSMAAGSWFAGIINSAVQTAFVIQLNFCRNNINHFSCEILAVMKLACADISGNEFIMVVATTLFTLMPLLLIVISYSLIISSILKIRTSEGRSKAFSTCSAHLIVVIIFYGTILFMYMKPKSKETLNSEDLYATDKLISMFYGVMTPMMNPLIYSLRNKDVKETVKHLFNRSFFSK

SEQ ID NO: 3581 - DNA, 939 bp, Felis catus
atggacaggacgaactggacagagattgagttcattctgcagggactttctgagtaccccaaagtggaaaaactccttttcgtcatgtgcttgatgatgtacctggtgatcctgctggggaacagcactttgatcatactaattctcctggattcccggctccatacgcccatgtacttcttcctcggtaatctttccctcctagacatttgttacacatcctcctttaccccctcagtgttgattcacttcctatcacagaaaaaaaccatctccttcactaggtgtgttgttcagatgtctgtctcctacacaatggcatgcacagaatgcgtgctcttagcagtgatggcatatgaccgttacgtggctatctgtaaccctctgagataccccatcatcatgagcaaggcactttgtattcagatggcagccctctcctggggaatgggctttctcaattcactgacagaaactatacttgcaatacggttgcccttttgtggaaaaaatgtcattaaccactttgtttgtgaaataatggcttttgtcaagctggcttgtgcagatatttccttgaatgagattgctataatgttgggcaatgtaatatttttgtatattccattattgttaatttgcatctcctacattttcatcctatctactgtactaaaaatgaattcagcagaaggaagaaaaaaagctttttctacctgttcagcccacttaacagtagtgaccatgttttatgggacaatcctcttcatatatatgaagccaaagtccaaagactctgctattgacaaactgattgctctgttctatggcgtagtcactcccatgctcaatcctatcatctatagcctgaggaacacagaggtgcttggagctttgagaaaattgatgagtagacactgtttctggagaaaaggatga

SEQ ID NO: 3582 - protein, 312 aa, Felis catus
MDRTNWTEIEFILQGLSEYPKVEKLLFVMCLMMYLVILLGNSTLIILILLDSRLHTPMYFFLGNLSLLDICYTSSFTPSVLIHFLSQKKTISFTRCVVQMSVSYTMACTECVLLAVMAYDRYVAICNPLRYPIIMSKALCIQMAALSWGMGFLNSLTETILAIRLPFCGKNVINHFVCEIMAFVKLACADISLNEIAIMLGNVIFLYIPLLLICISYIFILSTVLKMNSAEGRKKAFSTCSAHLTVVTMFYGTILFIYMKPKSKDSAIDKLIALFYGVVTPMLNPIIYSLRNTEVLGALRKLMSRHCFWRKG

SEQ ID NO: 3583 - DNA, 955 bp, Felis catus
cctctgaggagcatttctgacacagcatattcttcacagcttccttcacatctttgttcctcaaactatagatgaggggattgagcataggtgtcacaactccatagaagagagagatgattttgtctgtgacttgtactttgtctgtaccagagaagtctttagccttaggttttgcatacatgaagaggatggttccatagaatataatcaccacagttaggtgggcggagcaggtggagaaggctttgcgcttcccctctgcagaaggaatcttcaggatagtggagagaatgaaaatataggaaacaaaaatgaaaagtactgggaccacaagaaagataacattagcaataaccatgctaataatatttatggagatatcagcacaagccaattttaagacagccaagatttcacaagtaaaatgattaatgacattatccccacagaaaggaagccgcattgcaagagaggtttgcaacacagaattgacaccccctgcaatccaggacccagcagccatggacatgtatgaagtcttgctcataataacggagtatctcagagggttacagatggccgcatagcggtcaaatgccatcatgctcagaaggacacactctgtggctcccatagcaaaggagagaaacatttgcactccacacccagagaaggaaatggttttctgtgaagttaagaagctgctgagaaataggggaatagaagaactggtatagcaaatgtccaagaatgataagttactgaggaaaaagtacatgggggtgtgcaagtgggagtcacagacacttacaatgatgatgattccatttcccagcaggataaccaggtacatacacagcaccatcacaaagtaaatggcctcaagctctggatagccagaaagccccagtaggacaaattctgtcacagaagactgattggtctttcccat

SEQ ID NO: 3584 - protein, 319 aa, Felis catus
  MOD_RES (319)..(319): Any amino acid
MGKTNQSSVTEFVLLGLSGYPELEAIYFVMVLCMYLVILLGNGIIIIVSVCDSHLHTPMYFFLSNLSFLDICYTSSSIPLFLSSFLTSQKTISFSGCGVQMFLSFAMGATECVLLSMMAFDRYAAICNPLRYSVIMSKTSYMSMAAGSWIAGGVNSVLQTSLAMRLPFCGDNVINHFTCEILAVLKLACADISINIISMVIANVIFLVVPVLFIFVSYIFILSTILKIPSAEGKRKAFSTCSAHLTVVIIFYGTILFMYAKPKAKDFSGTDKVQVTDKIISLFYGVVTPMLNPLIYSLRNKDVKEAVKNMLCQKCSSEX

SEQ ID NO: 3585 - DNA, 888 bp, Felis catus
atgggaaattactcagctgtgactgaattctttctggcgggactttcccaataccaagaggtccagctttctttgtacatgttctgcctcatgatacctgataatccccctggaaaacagtctcctgattatcatcaacaccctagattcttgcctccacacccccatgtacttcttccttgggaacctctcattcttggacatttgtcatacatcatcatccattcctctgatgctgacattaaggtctgagagaaaaatccatctcctttattgactgtgctctgcagatggttgtcttccttgggtgggctgcactgagtgtatcctcctggctgtgatggcctatgattggtatgtggccatcggcaacccactaaggtaccccaccatcatgaatagagggctttatgtgcacatggctgcttggtcttggatcacagtgcaaacagtcctgacaatggtgctgcctttctgtgggaataatgtcatcaaccatcttacctgtgagttattggcccttcttaaactcatatgttcagatgtctccatcaatgtgcttatcataacagtggcaagtattgttttcttagtgacttccctaatgttaatttttatttcttatgtttttatactctctttcatcctgagacttaactctactgaagggagaaagaaagccttttcaacctgttcagcccaccttgctgtagtagttttactctatgattcagtcctctttatgtacatgaagcccaagtcaaaggacgtgaagtttgatgaaatcactgggtgttgaactccatcatctacagcctgaggaataagaaggtgaaagaggctatgaagaaagtcttcagtagacacttacactcatggaaaatatga

SEQ ID NO: 3586 - protein, 83 aa, Felis catus
MGNYSAVTEFFLAGLSQYQEVQLSLYMFCLMIPDNPPGKQSPDYHQHPRFLPPHPHVLLPWEPLILGHLSYIIIHSSDADIKV

SEQ ID NO: 3587 - DNA, 964 bp, Felis catus
atggacacatgaggatggggaattattcaaccatgaccaaattctttatggtgggactttccaaatacctagagctccagctttttctgttcgtgctctgcctcatcatgcatgtgataattctgctgggaaatagcctcctcattgtcatcagcacatttgattctcgcctccacacccccatgtacttcttccttgggaacctctcattcttggacatctgctacacatcatcatccattcccccgatgcttgtcatatttaagtctgagagaaaatctatctccttcattggctgtgctctgcagatggttgtctcccttgggttgggctctactgagtgtatcctcctggctgtgatggcctatgataggtatgtggccatctgcaacccactgaggtaccccatcatcatgaacaggatgctttatgtgcacatggctgcttggtcctggatcataggctgcctaaactccttagtgcaaacagtcctgacaatggtatttgcctttctgtgggaataatgtcattgatcatattacctgtgagatcctggctcttcttaaactcatatgttcagatatctccatcaatgtgcttatcatgacagtggcaaatgttttactggtgattcccctactattaattttcatttcctatgtttttatcctctcttccatcctgagaattaattctgctaagggagaattaattctgctaagggagaattaattctacctgttctgcccacctgactgtggttatcttcttccatggttcagccctttttatgtacatgaagcccaagtcaaaggacacaaacaaatctgatgagatcattggactgtcttatggagtggtaaccccgatgttgaatcccatcatctacagcatgaaggataaagaagtgaaagaagccatgaagaaagtcctaagcagacacctgaatttactgaaatcatga

SEQ ID NO: 3588 - protein, 173 aa, Felis catus
GHMRMGNYSTMTKFFMVGLSKYLELQLFLFVLCLIMHVIILLGNSLLIVISTFDSRLHTPMYFFLGNLSFLDICYTSSSIPPMLVIFKSERKSISFIGCALQMVVSLGLGSTECILLAVMAYDRYVAICNPLRYPIIMNRMLYVHMAAWSWIIGCLNSLVQTVLTMVFAFLWE

SEQ ID NO: 3589 - DNA, 906 bp, Felis catus
ttttttcatggcatctttgacttctttgtttcttaaactgtaaattatggggttcaacataggggtgagcactccataaagcagtgaaatgattttatctacttcttgggagcttgaggaagaaggctttaggtacatggagagggcagccccatagtacaagatcaccaccgtcaagtgggcaccacaggtagaaaaagctttgtttcttccttctgctgagctgattctcaggatagtggaaaggatgaagaaataagagatacaaattaagagcattgggatgggcaggaggagcacgctgaccaccagcatgatcacgtccatgagcaaggaacgtgcacaagctaacttcagcacggccagaatttcacacgtgaagtggtctatgagattcccacagaggggtatctgcagggcgcaagtggtttccagcagggcagtcagacaacccgtcacccaggagacagtggccatctgcacacagacctgcctgttcatgatgacggggtatctcagtgagttgcaaatggccacgtagcggtcatacgccatcacagccagaagcacacactctgtggagcccatggcaagggacagatacatctgtacagcacacccagaaaagacaatggttttctgggatgacagcaagttcaccagcaacgtgggaatagaagcagacgtgtaacaaatatccatgaaagagagatttccgaggaataagtacatgggggtttgaaggcgtgagtctaggacagtgactaaaataagagtgctgttgcccaagagggttatcagatacatcacaagactgaaggcgaagagaacaatctctaactttgggtatctagaaaaaccctccaggaaaaaaaagctccaaatggtgaggttttctccttgcat

SEQ ID NO: 3590 - protein, 302 aa, Felis catus
MQGENLTIWSFFFLEGFSRYPKLEIVLFAFSLVMYLITLLGNSTLILVTVLDSRLQTPMYLFLGNLSFMDICYTSASIPTLLVNLLSSQKTIVFSGCAVQMYLSLAMGSTECVLLAVMAYDRYVAICNSLRYPVIMNRQVCVQMATVSWVTGCLTALLETTCALQIPLCGNLIDHFTCEILAVLKLACARSLLMDVIMLVVSVLLLPIPMLLICISYFFILSTILRISSAEGRNKAFSTCGAHLTVVILYYGAALSMYLKPSSSSSQEVDKIISLLYGVLTPMLNPIIYSLRNKEVKDAMKK

SEQ ID NO: 3591 - DNA, 838 bp, Felis catus
gaactgtgtagacaagtgttgctatgtggtccctggcagtgtaggtggacaggggctgtaaatagacatagaagatgcttccataaaagagggttaccacagtgaggtgagagccacaggtggagaaggctttgcatttcccagcagctgaggggatcttgagaactgtgatgaggattcgtatataagagaaggtgatgcacagaaagggggtcaccaaaacaactgaacattctgacattatcacaatttcattgagaaatgtggaggagcaggacaatttcatcaggggactgaggtcacagaggaagtgatggataacattgttgtcacagaaggtgagacgattcagtagcagtgtgtgtaggagtgagtggaggtgaggaagtgagcagcaaaaggccaccagcaggacacagcggtggtggttcatggtggtgacatagtggaaggggtcacagatggccacatagcggtcaaaggccatgaccgccagaaggaagctgtcagtgttgcccagagcataaataaaatacatctgtgtcagacacccagcataggagatggtcttctctgacaggaagttcactagcatcctggggacaatggttgttgtaaagcaaatgtcagtgaaggacaggaaactcaggaagaaatacatgggggtctggagctgggggtcagagtggatggcgaggatgatgagcaggttccctgttatggtgaccaggtacatggtgaggaagaggataaagagtggtttctggtcctcaggccgggaggagagtcccaggaggataaactcggaaacactgctggtttggttgactctttccat

SEQ ID NO: 3592 - protein, 280 aa, Felis catus
  MOD_RES (280)..(280): Any amino acid
MERVNQTSSVSEFILLGLSSRPEDQKPLFILFLTMYLVTITGNLLIILAIHSDPQLQTPMYFFLSFLSFTDICFTTTIVPRMLVNFLSEKTISYAGCLTQMYFIYALGNTDSFLLAVMAFDRYVAICDPFHYVTTMNHHRCVLLVAFCCSLPHLHSLLHTLLLNRLTFCDNNVIHHFLCDLSPLMKLSCSSTFLNEIVIMSECSVVLVTPFLCITFSYIRILITVLKIPSAAGKCKAFSTCGSHLTVVTLFYGSIFYVYLQPLSTYTARDHIATLVYTVX

SEQ ID NO: 3593 - DNA, 880 bp, Felis catus
atgaggagggagaaccagagcagcgtgtccgagttcctcctcctggggctccccatccagccagagcagcagggcatattcttcaccctgttcctgggcatgtacctgactacagtgctggggaacctgctcatcatcctgctcgtcaggctggactctcgctttcacacgcctatgtacttcttccttagccacttggccttcactgatgtttccttttcatctgtcacagttccaaagatgctcatgaacatgcagactcagcaacaatccattccctatgtggggtgcatttcacaggtgtatttcttaatattttttggttgtcttgacaatttccttcttgcagtgatggcatatgacaggtatgtggccatctgtcagccactccactactctactgtcatgaggcaggagctatgtatctcattagtggctggatcttcgttcttctgttacattcatgccctgttgcacacccttctcttggtccaactgtccttctgtgataataccatccctcacttcttttgtgacctcactgtgctcctgaggataagctgctcagacatctctctcaatgagctgatcatctttactgaaggaggaattcttttcatcctgcctttgagtagtatcttgggctcatatattcgtatagggacaactgtcctaagggtcccctccactaaaggactctttaaagccttttctacctgtggctcccatctttttgtggtgtctgtatactatgggacacttgcaggtgtttactttttctccttatcatggaactttaatgacaaagacataattgcttcagtcatgtacacagtaattacccctatgctgaacccctttatctatagcctgaggaaca

SEQ ID NO: 3594 - protein, 294 aa, Felis catus
  MOD_RES (294)..(294): Any amino acid
MRRENQSSVSEFLLLGLPIQPEQQGIFFTLFLGMYLTTVLGNLLIILLVRLDSRFHTPMYFFLSHLAFTDVSFSSVTVPKMLMNMQTQQQSIPYVGCISQVYFLIFFGCLDNFLLAVMAYDRYVAICQPLHYSTVMRQELCISLVAGSSFFCYIHALLHTLLLVQLSFCDNTIPHFFCDLTVLLRISCSDISLNELIIFTEGGILFILPLSSILGSYIRIGTTVLRVPSTKGLFKAFSTCGSHLFVVSVYYGTLAGVYFFSLSWNFNDKDIIASVMYTVITPMLNPFIYSLRNX

SEQ ID NO: 3595 - DNA, 893 bp, Felis catus
atgaggggggagaaccagagcagcgtgtccgagttcctcctcctggggctccccatctggccagagcagcaggccctgttcttcgccctgttcctgggcatgtacctgatcacggtgctggggaacctgctcatcatcctgctcatcaggctggactcccgcctccacacccccatgtacttcttcctcagccacttggccttcactgatgtctctttctcttctgtcactgtcccaaagatgctgatgaacatgcagactcagcacctatcaatctcctatccaggatgtatttcacagatgtatttttatatacttttcggttgtgttgataacctccttcttgcagtgatggcatatgacaggtatgtagccatctgtcatcctctatactacaccaccatcatgaaggaggatctgtgtgtgctgctggtggctggctcctggattctctcctgtggcagtgccctcttacacaccctcctcctgacccaggtgtccttctgtgctgacaacatcatcccccactttttctgtagcctccccatcctactcaggctgtcctgttcaaacacctctgttaatgagctggtcatatttactgcaggggctgcagttgtcattttcccgttgactggcatcctggtctcttatggacgcattggggcttctattctgaaggtgccctctaccaaaggtatctgcaaagccttgtccacctgtggctcccacctctctgtagtgtctctattctatggaacaattatggcactgtacttttcttcctcatcaagcaactccaatgacaacgacatgattgcctcactgatgtatacagtggtcacccccatgttgaaccccttcatctatagcctaaggaacagagacatgaa

SEQ ID NO: 3596 - protein, 298 aa, Felis catus
  MOD_RES (298)..(298): Any amino acid
MRGENQSSVSEFLLLGLPIWPEQQALFFALFLGMYLITVLGNLLIILLIRLDSRLHTPMYFFLSHLAFTDVSFSSVTVPKMLMNMQTQHLSISYPGCISQMYFYILFGCVDNLLLAVMAYDRYVAICHPLYYTTIMKEDLCVLLVAGSWILSCGSALLHTLLLTQVSFCADNIIPHFFCSLPILLRLSCSNTSVNELVIFTAGAAVVIFPLTGILVSYGRIGASILKVPSTKGICKALSTCGSHLSVVSLFYGTIMALYFSSSSSNSNDNDMIASLMYTVVTPMLNPFIYSLRNRDMX

SEQ ID NO: 3597 - DNA, 879 bp, Felis catus
catgtctgagttccttctcctggggctccccatccagccagagcagcaggccatgttcttcaccctgttcctgggcatgtacctgatcatgtgctggggaacctgctcatcatcctgctcatcagggtggactctcgcctccacacccccatgtacttcttcctcagccacttggccttcactgatgtctccttctcatctgtcaccatccccaagatgctgataaacatgcatacttgggatcagtccatcccctatgcaagctgtgtaacacagatatattttttccatatttttttggctgtatcaataaacttcttcttgcagtgatggcatatgagaggtacatggccatttgccaccctttacactacaccaccatcatgagggagaagctgtgtatatttgttctggctggatcctggttccctctcctgtacaagtgccctgtcccacaccatcttcctggctcaactgtccttttgtgctgacaacaccatctcccacttcttctgtgaccttgctgacctgcttaaactctccagctcagacacttacctcaatgaagtttttatcttcactgttggggaattggtcattaccctgtcgtttattggtgctctagtctcttatggtcgcattggggccaccatcctgagatttccctcgatcaaggggatatataaagctttggccacctatggctcccacctctctgtggtatttctgttctgtgggacaatcacggtactgcactttttcccatcatcaagcaactccaatgacaaagacataattgcttcagtgatgtacatagtggtcacccccatgctgaaccccttcatctatagcctgaggaacagagatataaaaggagcc

SEQ ID NO: 3598 - protein, 73 aa, Felis catus
MSEFLLLGLPIQPEQQAMFFTLFLGMYLIMCWGTCSSSCSSGWTLASTPPCTSSSATWPSLMSPSHLSPSPRC

SEQ ID NO: 3599 - DNA, 905 bp, Felis catus
ctcagggcccctttcatgtctttatttctcaggctgtaaatgaaagggttcaacatgggggtgaccactgtgtacatcaaggaagcaattaggtttttgttattggtgttgttggatgagggaagaaaatataggccaataattgccccataatagagagtcactactgagagatgtgatccacaagtggacaaggctttgcagatgcccttggtagaaggaacccggaggatggtggccccaatatggccgtaagaaaccacaatgcataagaatggaagcataatggctgttaatcctgcagtaaagatcaccaattggttgagggaagtgtctgagcaagacaatttgagcaaggcagcaaggtcacagaagaagtgggggacggtgtggtcagcacagaaggacagctgggctaggagaagggtatgcaaaagagcacaagcacaagcaatgacccaggatccagccactagcatgacacagatgctctgactcatgacgatggtataatgcagagggtgacagatggccacatacctgtcataggccattgaagtgatcaagaaactgtctaaatcagcgcaaaatatgaagaaatatgtctgtgaaatgcatccttcataggagatggatttgtacttagcatgcatgttcatcagcatctttgggacagtgacagatgaaaaggaaacatcagtgaaggccaagtggctgaggaagaagtacatgggggtgtggaggcgagagtccagtctgatgagcaggatgatgagcaggttccccagcaccgtggtcaggtacatgcccaggaacagggcaaagaacatggcctgttgctctggccggatggggagccccaggaggagaaactcggacacgctgctctggttctccctcctcat

SEQ ID NO: 3600 - protein, 302 aa, Felis catus
  MOD_RES (302)..(302): Any amino acid
MRRENQSSVSEFLLLGLPIRPEQQAMFFALFLGMYLTTVLGNLLIILLIRLDSRLHTPMYFFLSHLAFTDVSFSSVTVPKMLMNMHAKYKSISYEGCISQTYFFIFCADLDSFLITSMAYDRYVAICHPLHYTIVMSQSICVMLVAGSWVIACACALLHTLLLAQLSFCADHTVPHFFCDLAALLKLSCSDTSLNQLVIFTAGLTAIMLPFLCIVVSYGHIGATILRVPSTKGICKALSTCGSHLSVVTLYYGAIIGLYFLPSSNNTNNKNLIASLMYTVVTPMLNPFIYSLRNKDMKGALX

SEQ ID NO: 3601 - DNA, 923 bp, Felis catus
atgaggagggagaaccagagcagcgtgtccgagtttctcctcctggggctccccatccggccagagcagcaggccatgttcttcgccctgttcctgggcatgtacctgaccacagtgctggggaacctgctcatcatcctgctcatcaggctggactctcgcctccacacccctatgtacttcttcctcagccacttggccttcactgatgtctccttctcatctgtcactgtcccaaaaatgttgatggacatgcatgctaagtacaaatccatcccctatgaagggtgtatttcacaaatgtatttttttatattttttactgacctggacagcttccttattacatcaatggcatatgatcgctatgcggctatatgtcaccctcttcattataccaccatcatgagggaagagctgtgtgccttactagttgctatatcttggatcctgtcctgtgccagctctctttcccacacccttctcctcacccagttatccttctgtgctgacaatgccatcccccatttcttctgtgaccttggtgctctgcttaagatatcctgttcaggcatcttcctcaatgagttggtcatgttcacagtaggggtggtggtcattaccctgccattcatatgtattctggtatcttacggttacattggggccaccatcatgaaaggtccttccaccaaggggatctgcaaagcactgtccacatgtggctcccacctttctatagtgtctctgtattatggggcaatatttgggcagtatcttttccccaaattaagcaatttcattgacaaggacatcattgtggctctcatgtacacagtggtcacacccatgttgaacccctttatctacagcctcaggaacagggacatgaaagaagccctggggaaactcttcggtagggc

SEQ ID NO: 3602 - protein, 308 aa, Felis catus
MRRENQSSVSEFLLLGLPIRPEQQAMFFALFLGMYLTTVLGNLLIILLIRLDSRLHTPMYFFLSHLAFTDVSFSSVTVPKMLMDMHAKYKSIPYEGCISQMYFFIFFTDLDSFLITSMAYDRYAAICHPLHYTTIMREELCALLVAISWILSCASSLSHTLLLTQLSFCADNAIPHFFCDLGALLKISCSGIFLNELVMFTVGVVVITLPFICILVSYGYIGATIMKGPSTKGICKALSTCGSHLSIVSLYYGAIFGQYLFPKLSNFIDKDIIVALMYTVVTPMLNPFIYSLRNRDMKEALGKLFGRA

SEQ ID NO: 3603 - DNA, 711 bp, Felis catus
atgaggagggagaaccagagcagcgtgtccgagttcctcctcctggggctccccatccggccagagcagcagggcatgttcttcaccctattcctgggcatgtacctgaccacggtgctggggaacctgctcatcatcctgctcatcaggctggactcttgcctccacacccctatgtacttcttcctcagccacttggccctcacagatgtctccttctcatctgtcaccgtccccaagatgctgataaacatgcactttcaggatcaatccatcccctacacaggctgtgtaacacagatgtattttttcatattttttactgatctggacaattttcttctcacatcgatggcatatgatcggtatgtggctatctgtcacccactccactataccaccatcatgagagagggggtgtgtatcttactagtagctgtatcttggatcctgtcctgtgccagtgccctgtctcacactctcctcttggcccagctgtccttttgtgctgacaatgccatcccccatttcttctgtgaccttggtgtcctgctcaagctctcctgctcagacacctcccttaatgagctggtcattttcacagcaggtgtggcagtcattactatcccactaatttgcatcttgatctcttatggccacattggggccaccatcttgaaggttccctctaccagggggatctgcaaagcc

SEQ ID NO: 3604 - protein, 237 aa, Felis catus
MRRENQSSVSEFLLLGLPIRPEQQGMFFTLFLGMYLTTVLGNLLIILLIRLDSCLHTPMYFFLSHLALTDVSFSSVTVPKMLINMHFQDQSIPYTGCVTQMYFFIFFTDLDNFLLTSMAYDRYVAICHPLHYTTIMREGVCILLVAVSWILSCASALSHTLLLAQLSFCADNAIPHFFCDLGVLLKLSCSDTSLNELVIFTAGVAVITIPLICILISYGHIGATILKVPSTRGICKA

SEQ ID NO: 3605 - DNA, 863 bp, Felis catus
gagttccttctcctggggctccccatccggccagagcagcagggcatgttcttcaccctgttcctgggcatgtacctgaccacagtgctggggaacctgctcatcatcctgctcatcaggctggactctcgccttcacacccccatgtacttcttcctcagccacttggccttctctgacatttccctttcatctgtcacagttccaaagatgctcatgaacatgcagactcagcaacaatccatcccctatatggggtgcatttcacaggtgtatttctttatattttttggttgccttgacaactttcttctcacagtgatggcatatgacaggtatgtggccatctgtcaccctctccactacaccaccaccatgagggaggagctatgtatcatcctagtggctggatcctggttcttctcttgcatccaagctcttttgcacaccctcctcgtggaccagttgtccttctgtgcagggactgtcatcccacacttcttttgtgatcttgctgctgtgctcaagtcttcctgctcagacacctctttcaatgagctgcttatcctcactgaaggagcattggtactcattctaccattgagtggtatcttgggctcatatatccatatggcaggcatcattctgaaggtcccctcctttaaaagaatctccaaagccttgtctacatgtggctcccatctctttgtggtgtgtttatactatgggacaattgcaggtgtttactttttctcttcatcaggcaactcccaagacaaggacataattgcttctgtaatgtacatggtggtcacccctatgctgaacccctgcatctacagcctgaggaataaggacatgaa

SEQ ID NO: 3606 - protein, 288 aa, Felis catus
  MOD_RES (288)..(288): Any amino acid
EFLLLGLPIRPEQQGMFFTLFLGMYLTTVLGNLLIILLIRLDSRLHTPMYFFLSHLAFSDISLSSVTVPKMLMNMQTQQQSIPYMGCISQVYFFIFFGCLDNFLLTVMAYDRYVAICHPLHYTTTMREELCIILVAGSWFFSCIQALLHTLLVDQLSFCAGTVIPHFFCDLAAVLKSSCSDTSFNELLILTEGALVLILPLSGILGSYIHMAGIILKVPSFKRISKALSTCGSHLFVVCLYYGTIAGVYFFSSSGNSQDKDIIASVMYMVVTPMLNPCIYSLRNKDMX

SEQ ID NO: 3607 - DNA, 849 bp, Felis catus
ccacagcagcagcctctcctattcggactcttcctgggcatgtacctggtcaccatggtggggaatctgctcatcatcctggccattgcctcagacctgcatctccacacccccatgtacctctttctagccaacctttccttttctgacattggtttcatctctacagtaattcccaagatgctagataatattggctcaggaagtaaaaggatttcttatggtgggtgtctgacacagctttatttctttggcctatttgcagatctggacaactttctcctggctgtgatggcacttgaccgctatgtggccatcagccaccccctccattatgccatgatcatgaactaccaacgctgtgtcctattagtggctgggtcatgggtggtcactaccttccacgccctagtgcataccttcctggtaactaggctttctttctgtggccccaatatcatcccccatttcttctgtgatcttgtcccactcctgaatctggcctgctccagtacttatgtcaatgacctggtgctcatccttgtggcaggaacattgctaattggacccttcatctgcatccttacttcttacttttatattgcattggctatcctaagaatcaattccccaaagggtaagcaaagggccttctccaactgcacctcccacctctctgtggtctctctgttttatagcacagctattggggtctatttatgtcctccatcatccccctcaggtggaaagaatagagtcttctcaataatgtacacagtggtgacccccatgctgaaccccttcatctacagcctaagaaacagggatatgaagggggcgctaggaaaa

SEQ ID NO: 3608 - protein, 283 aa, Felis catus
PQQQPLLFGLFLGMYLVTMVGNLLIILAIASDLHLHTPMYLFLANLSFSDIGFISTVIPKMLDNIGSGSKRISYGGCLTQLYFFGLFADLDNFLLAVMALDRYVAISHPLHYAMIMNYQRCVLLVAGSWVVTTFHALVHTFLVTRLSFCGPNIIPHFFCDLVPLLNLACSSTYVNDLVLILVAGTLLIGPFICILTSYFYIALAILRINSPKGKQRAFSNCTSHLSVVSLFYSTAIGVYLCPPSSPSGGKNRVFSIMYTVVTPMLNPFIYSLRNRDMKGALGK

SEQ ID NO: 3609 - DNA, 929 bp, Felis catus
atggttaataacagctggaccagtgtatcccattttgttctcttgggcatatctacccacctggaagagcagatcccactctttcttctttttctactgatgtatgcgatcaacatttttgggaactttgccatcatcacactgattatctctactccacgtctccacacccccatgtacatcttcctcagtaatttggctttggcagacatctgtttcacctccaccacggtccccaagatgctacagaacattttctcgcctacaaaggccatttcctacatgggctgcttagcccagacctatttcttcatttgctttgcagccatggaaaacttccttctggctgtgatggcctatgatagatacatcgctatctgctaccctttccgctaccctatgatcctgaccagaatgctgtgttcacagatggtggctctgtgccatatcctctcccatcttcatgccctgctgcacacctttcttatgggccgattaatcttctgtgcagataacaagatcccccatttcttctgtgacctctaccctctgatgaagatttcctgctccagcccctacctcaacaccctgatgattcacacggagggtgttattgtcatcaatggagctctggctttcatcattgcctcctatgcccgcatcatctcagtggtcctccagatcccctcggccaagagcaaatggagagctttttctacctgtggctcccacctcactgtggtgtctatcttctatggcacactcacatgggtctacttccggccccttaccagctattcagtgactgagggtcgcattctgacagtcatgtacacagtggtgacccccatgctgaaccccttcatttacagcctgaggaatggggatgtcaagggagccttcagaaaatgggtgagcagaatgtggac

SEQ ID NO: 3610 - protein, 310 aa, Felis catus
MVNNSWTSVSHFVLLGISTHLEEQIPLFLLFLLMYAINIFGNFAIITLIISTPRLHTPMYIFLSNLALADICFTSTTVPKMLQNIFSPTKAISYMGCLAQTYFFICFAAMENFLLAVMAYDRYIAICYPFRYPMILTRMLCSQMVALCHILSHLHALLHTFLMGRLIFCADNKIPHFFCDLYPLMKISCSSPYLNTLMIHTEGVIVINGALAFIIASYARIISVVLQIPSAKSKWRAFSTCGSHLTVVSIFYGTLTWVYFRPLTSYSVTEGRILTVMYTVVTPMLNPFIYSLRNGDVKGAFRKWVSRMWT

SEQ ID NO: 3611 - DNA, 933 bp, Felis catus
atggagaccaagaactacagcagtgactcaggctttatcctcctgggcctctcttccaaccctcagctacagaaacctctctttgccatcttcctcatcatgtacttggtcaccgtgctgggcaatgtactcatcatcctggccatccactcagacccccgactccatacccccatgtactttttcgtcagcaacctgtccttcatagatatctgcttcacaactgtcattgtgcccaagatgctggtgaatttactgtcagagacaaaggcgatctccttcctgggatgcctggtccagatgtacttcttcatggcctgtgggaacactgacagttacctgctggcctccatggccatagaccggctggtagccatctgccaccccttccattacaatagggttatgaatccacggcgctgcctcctcatgctgctgggttcttgcaccatctcccacctgcactccctgctccgtgtgctactcatgtcccgcctgtccttctgtgcctcccatgtcattaagcactttttttgtgacacccagcctgtgctaaagctatcctgctctgacacgtcctctagccagattgtggtcatgaccgagaccctggctgtcatcgcgaccccctttctgtgcattctcttctcctacctgcgaatcatcgtcactgtgctcagaattccctctgcagccggcaagtggaaggccttctctacctgtagctcccaccttaccgtagtggccttgacctatgggagtgtcatctatgtgtatttcaggcccctgtcgatgtactcagtggtgaaggaccgggtagccacagtcatgtacacagtagtgacacccatgctgaaccccttcatctatagtctgaggaacaaagacatgaacaggggcttaaagaaattaaggaacagaattcacttatag

SEQ ID NO: 3612 - protein, 310 aa, Felis catus
METKNYSSDSGFILLGLSSNPQLQKPLFAIFLIMYLVTVLGNVLIILAIHSDPRLHTPMYFFVSNLSFIDICFTTVIVPKMLVNLLSETKAISFLGCLVQMYFFMACGNTDSYLLASMAIDRLVAICHPFHYNRVMNPRRCLLMLLGSCTISHLHSLLRVLLMSRLSFCASHVIKHFFCDTQPVLKLSCSDTSSSQIVVMTETLAVIATPFLCILFSYLRIIVTVLRIPSAAGKWKAFSTCSSHLTVVALTYGSVIYVYFRPLSMYSVVKDRVATVMYTVVTPMLNPFIYSLRNKDMNRGLKKLRNRIHL

SEQ ID NO: 3613 - DNA, 905 bp, Felis catus
aggggaaaccagagtcacatcacagaattcctccttctgggactgaccagtgaccccaaatatcaggagtggctctttaccagctttctggccatgtatctggtcaacgtggctggcaactcagtcatcattgcagccatccggggggacacccgcctccacacccccatgtacttcttcctctccaatctgtccctggtggacatctgctttacaaatgtcattgtgccacggatgctggcaaacatgctgaacaagaccaagaagatctcctttgcccagtgcctcacacagatgtatttctttgtgacctgtgcgatcactgacagcttcctcctggctgccatggctattgaccgctacatggccatctgtaacccactgcattacaccacgaccatgagcccccagcgctgtctcctgctggtgacggtgtcctgggtgctgtcccaccttcactcactcacccacacgattctcatggcccgcctctccttctgtgggcccaacgtcatccaccacttcttctgtgacgtccagccactgctgacgctctcctgctctgacacctctgtcaatgagcttttggccttcacagagggctccttggtgatcatgagtcctttcatcttgatcattgtctcttacgtccacatcacccgtgccgttctgagggtcccttctcgaggaggcaggcacaaggtcttctccacctgtgggtcccacctcacagttgtggcactcttctatgggactgccatctctgtgtacattcgcccctcatctacctactcagtgacaaaggacagtgtggtcactgttatttatactgtggtaatccccatgttgaacccttttatctacagtcttaggaacaaggacatgaaacaagccttgagaaagct

SEQ ID NO: 3614 - protein, 302 aa, Felis catus
RGNQSHITEFLLLGLTSDPKYQEWLFTSFLAMYLVNVAGNSVIIAAIRGDTRLHTPMYFFLSNLSLVDICFTNVIVPRMLANMLNKTKKISFAQCLTQMYFFVTCAITDSFLLAAMAIDRYMAICNPLHYTTTMSPQRCLLLVTVSWVLSHLHSLTHTILMARLSFCGPNVIHHFFCDVQPLLTLSCSDTSVNELLAFTEGSLVIMSPFILIIVSYVHITRAVLRVPSRGGRHKVFSTCGSHLTVVALFYGTAISVYIRPSSTYSVTKDSVVTVIYTVVIPMLNPFIYSLRNKDMKQALRKL

SEQ ID NO: 3615 - DNA, 921 bp, Felis catus
cctgctgaattcatcctcctgggcatcacggatcgctgggacctacgtgtgaccctcttcctgattttcctaccagtctacctggtgagcctgctgggaaatgtgggcatggtgctgctaatccaagtggatgcccggctccacacacctatgtacttcttcctggccaacctctccctgctggacacctgctattcctcagccatcgcccccaagatgctggtggacttactgctgccccacgccaccatcccttacacggcctgtgccctccagatgtttgtgttcgcaggactggctgatgccgagtgttgcctgttggcagcgatggcctatgaccgctacgtggccatcggaagccctcttctctacacaacagccatgtcgcagcgtgtatgcctggccttgctgggagcatcaggcctgggcggggcagtgagtgccattgtccacacgactttcaccttccgcctgaatttctgccgctcccgggaggtcaacagcttcttctgtgatatccctccactgctggccatctcctgcaatgacaccagtctcaatgagctcctcctctttgccatctgtggcttcatccagacagccacggtgttggttattgtcgtgtcatatggtttcattgccggggctgtgattcgcatgccctcggctgagggccgtcggcgagcagcctctacctgtggctcccacctcacggctgtaaccatgctgtatgggacactcactttcatgtacctgcgtcccagctccagctatgccctggacactgacaagatggcatccgtgttctacactcttgtcatcccagctcttaaccctctcatctacagcctccgcaacaaggaggtcaaggaggcagtcaaaagaacctggagccgattccgccgtccaggtccggagcac

SEQ ID NO: 3616 - protein, 307 aa, Felis catus
PAEFILLGITDRWDLRVTLFLIFLPVYLVSLLGNVGMVLLIQVDARLHTPMYFFLANLSLLDTCYSSAIAPKMLVDLLLPHATIPYTACALQMFVFAGLADAECCLLAAMAYDRYVAIGSPLLYTTAMSQRVCLALLGASGLGGAVSAIVHTTFTFRLNFCRSREVNSFFCDIPPLLAISCNDTSLNELLLFAICGFIQTATVLVIVVSYGFIAGAVIRMPSAEGRRRAASTCGSHLTAVTMLYGTLTFMYLRPSSSYALDTDKMASVFYTLVIPALNPLIYSLRNKEVKEAVKRTWSRFRRPGPEH

SEQ ID NO: 3617 - DNA, 951 bp, Felis catus
atggatgctaccaatgagtcttcagagggagccccattcatcctgctgggactgacaacaagtcctgaacagcggcggcctctctttgggttattcttggtcctgtacgtagcaggcatcctgggtaatggactcatcgtggctgccgtacgggccagtccagcccttcgtgcacccatgtacttcctgctggcccatctgtcctttgctgacctctgctttacctccgtcactgtacccaagatgttggccaacttgttggcccacgaccgctccatctccgtggctggctgtctgacccagatgtacttcttctttgccctgggtgtaaccgatagctgtctcctggccgccatggcctatgaccgctatgtggccatccgccaccccctccactatgccacaaggatgtcccgggccgtgtgcaaagccctggtggggaccgcatggctggtgtcccacgtccactccctcctgcatatcctgcttatggcccgcctgtccttctgtgcctcccaccatgtgccccacttcttctgtgaccaccagcctctcttaaggctctcgtgctctgacacccgccacatccagctgctcatcttcactgagggtgccgcggtggtggtcactcccttcctgctcatccttacctcctacggggccatcgcagctgcggtgctccggctgccgtcagcctctgggaggctccgggctgtgtccacctgtggctcccacctggcagtggtgagcctcttctatgggacagtcattgcagtgtacttccagcccacatctcggtatgaggcagagcggggccgtgtggccactgtcatgtacaccgtagtcacccccacactaaaccctgtgatctatagcctccggaaccgtgacgtgcagggggcactccgagccctcttcaccggacggaggatctcagctggcgactcctaa

SEQ ID NO: 3618 - protein, 316 aa, Felis catus
MDATNESSEGAPFILLGLTTSPEQRRPLFGLFLVLYVAGILGNGLIVAAVRASPALRAPMYFLLAHLSFADLCFTSVTVPKMLANLLAHDRSISVAGCLTQMYFFFALGVTDSCLLAAMAYDRYVAIRHPLHYATRMSRAVCKALVGTAWLVSHVHSLLHILLMARLSFCASHHVPHFFCDHQPLLRLSCSDTRHIQLLIFTEGAAVVVTPFLLILTSYGAIAAAVLRLPSASGRLRAVSTCGSHLAVVSLFYGTVIAVYFQPTSRYEAERGRVATVMYTVVTPTLNPVIYSLRNRDVQGALRALFTGRRISAGDS

SEQ ID NO: 3619 - DNA, 941 bp, Felis catus
atgacaagaagaaatcaaactattgtctcagtcttcctccttctgggcctgccaattgagccagagcaacaaaatccgttttatgtcctgttcctggccatgtatcttatcaccgtactggggaatctcctcataattttcctgatttgcctggactcccacctgcacacacccatgtatttttttctcagcaatttgtctttctctgatatctgcttctcttctgtgaccattccgaaattgttgcaaaccatgcagagccaagactcatccatcccctatgccggctgcctgacccaaatgtacttctttctgttttttgcagacctggagagtttcctcctagtggccatggcctatgaccgctatgtggccatctgcttccccctccactacaccattatcatgagctccaagctctgtctctccctggttgtgctgtcctgggtgctgaccacgttccatgctatgttacacactctcctcatggccagattgtgtttctgtgctgacaacataatcccccactttttctgtgacatgtctgctctgctgaagctggcgtgctctgacactcgagtcaatgagttggtgatatttatcatgggagggctcattctcgtcatcccattcctactcatcgtcatgtcttatgcacggattgtgtcctccatcctcagggtcccttctgccaggggcatccgcaaggccttctccacctgtggctcccacctctccgtgctgtctcttttctatgggacagttattggcctctacttgtgcccttcagctaataattctgctgttaaggagactgtgatggccgtgatgtacactgtggtcacccccatgctgaatcccttcatctacagcctgaggaacagagacatgatgggagctctgggaagactccttttcaaaaagaaaatttccttctctgt

SEQ ID NO: 3620 - protein, 314 aa, Felis catus
MTRRNQTIVSVFLLLGLPIEPEQQNPFYVLFLAMYLITVLGNLLIIFLICLDSHLHTPMYFFLSNLSFSDICFSSVTIPKLLQTMQSQDSSIPYAGCLTQMYFFLFFADLESFLLVAMAYDRYVAICFPLHYTIIMSSKLCLSLVVLSWVLTTFHAMLHTLLMARLCFCADNIIPHFFCDMSALLKLACSDTRVNELVIFIMGGLILVIPFLLIVMSYARIVSSILRVPSARGIRKAFSTCGSHLSVLSLFYGTVIGLYLCPSANNSAVKETVMAVMYTVVTPMLNPFIYSLRNRDMMGALGRLLFKKKISFSV

SEQ ID NO: 3621 - DNA, 945 bp, Felis catus
atgacaggaaagaatcaaactgttgtcttagaattcctcctcctgggcctgcccatcaagtcagagctacgagaccagttctatgccctgttcctgctcatgtatgttaccaccatcctggggaacctgctcatcatcgttctcatttgcctggactcccgcctccacacgcccatgtatttgtttctcagtaacttgtccttctctgacctctgcttctcctctgtcacaatgcccaatctgctgcagaacatgcagagccaggtcccgtccatcccctatgccggctgcctgacccagatgtacttcttcctattttttggagacctggagagcttcctcctggtggccatggcctatgaccgctatatggccatctgtttccccctgcactacaccaccatcatgagccccaagctctgtctctccttggtggtgctgtgctgggtgctgactgctgcccatgccatgttgcacaccctgctcatggccaagctgtccttctgtgccgacaacataatcccccactttttctgtgacatgtctgctctgctgaagctggcctgctctgacactcgaatcaatgagttggtgatatttatcatgggagggctcattctcgtcatcccattcctattcattgtcatgtcttatgcacggattgtgtcctccatcctcagggtcccttctgccaggggcatccgcaaggccttctccacctgtggctcccacctctccgtgctgtctcttttctatgggacagttatcggcctctacttgtgcccttcagctaataattctgctgttaaggagactgtgatggccgtgatgtacactgtggtcacccccatgctgaatcccttcatctacagcctgaggaacagagacatgaagggagccctgggaagagtcttttgtggaaagaaaattcccttctctgtatga

SEQ ID NO: 3622 - protein, 314 aa, Felis catus
MTGKNQTVVLEFLLLGLPIKSELRDQFYALFLLMYVTTILGNLLIIVLICLDSRLHTPMYLFLSNLSFSDLCFSSVTMPNLLQNMQSQVPSIPYAGCLTQMYFFLFFGDLESFLLVAMAYDRYMAICFPLHYTTIMSPKLCLSLVVLCWVLTAAHAMLHTLLMAKLSFCADNIIPHFFCDMSALLKLACSDTRINELVIFIMGGLILVIPFLFIVMSYARIVSSILRVPSARGIRKAFSTCGSHLSVLSLFYGTVIGLYLCPSANNSAVKETVMAVMYTVVTPMLNPFIYSLRNRDMKGALGRVFCGKKIPFSV

SEQ ID NO: 3623 - DNA, 945 bp, Felis catus
atgaaaatgggaaaccaaagtgtcatctcagagttcctcctcctgggtctgcctattgagccagagctgcgggaccagttctatgccctgttcctgctcatgtatgttaccaccatcctggggaacctgctcatcatcatcctcattctcctggactcccgcctccacacgcccatgtatttgtttctcagtaacttgtccttctctgacctctgcttctcctctgtcacaatgcccaaactgctgcagaacatgcagagccaggtcccgtccatcccctatgccggctgcctggcccagatgtacttcttcttgctttttgcagacctggagagcttcctcctggtggccatggcctatgaccgctatgtggccatttgctttcccctgcactacaccaccatcatgagccccaagctctgtctctccctggtggtgctgtcctgggtgctaaccacttttatctctttattgcacacactactcatggctcggctgtccttctgtgctgataatgtgattcctcactttttctgtgacatgtcagctctgctaaagttggcctgctctgacattcatataaatgaaatggtgatatttattttgggagggcttgtcattattgttccattcctgttgatctttttatcctatgcacggattgtgtcctccatcctcagggtcccttctgccaggggcatccgcaaggccttctccacctgtggctcccacctctccgtggtgtctctcttctacgggacaatcattggcctctacttgtgcccttcagacaacaattctactgttaaggagactgtcatggccgtgatgtacactgtggtcacccctatgctgaatcccttcatctacagcctgaggaatcgggacataaagggagccttaggaagagtatgttccaaatggacgattcagctttctctggga

SEQ ID NO: 3624 - protein, 315 aa, Felis catus
MKMGNQSVISEFLLLGLPIEPELRDQFYALFLLMYVTTILGNLLIIILILLDSRLHTPMYLFLSNLSFSDLCFSSVTMPKLLQNMQSQVPSIPYAGCLAQMYFFLLFADLESFLLVAMAYDRYVAICFPLHYTTIMSPKLCLSLVVLSWVLTTFISLLHTLLMARLSFCADNVIPHFFCDMSALLKLACSDIHINEMVIFILGGLVIIVPFLLIFLSYARIVSSILRVPSARGIRKAFSTCGSHLSVVSLFYGTIIGLYLCPSDNNSTVKETVMAVMYTVVTPMLNPFIYSLRNRDIKGALGRVCSKWTIQLSLG

SEQ ID NO: 3625 - DNA, 944 bp, Felis catus
tcacacctcttggggtgcagccctccatctgagcccccttttcagggcgcccttgacctccttgttgcgaaggctgtagatgaaagggttcaaggtcggtgtgagcacagcatagaccacgctggccaggcggtcatagcgggctgagtaggcggaggacggccggaaatagacggagaggacagagccgaagaaaagcgacaccaccaccaggtgggccccgcaggtggcgaaggcgcggcgccggcccccggccgcccgcactcccagcaccgcgacgaggatgcgcgcgtaggacagcgacacgaggagcagcggggtgagcaccacggccaggccctcggagaagatggcagcctccgcggtcgccgtgtccgaggtcgccaggctcagcatcaccgtcatgtcacagaagaagtggcgcacaggggcgggcacgggtaggagagcgccgagatgagcagcgtgtgcagcagcgagtgcaggtgggccaccgcccaggacgtggtcaccagcgccgcgcagcgccggggcgtcatgaccgcgcagtagtgcagggggcggcagacggccaccgcgcggtcgtaggacatggctgccagcaggtagctctcggtgatgcccagagccacgaagaagtacatctgggaaaagcatccctggaaggacacggcctggcgcgggtggagcaagccggccagcagtctggggacggtgacagtggtaaagcagacgtccacgaggctcaggtgacccaggaaatagtacatgggggagcggagggccccatccgacctcaccaccaccaccatggccaggttgcccagggcattgagcaggtagacgccgaggaagagcaggaagagcagcgggtggatgtctgttccatccaccaggccgaggaggaggaattctggggccgtcgtgaggttggccagggccat

SEQ ID NO: 3626 - protein, 313 aa, Felis catus
GPGQPHDGPRIPPPRPGGWNRHPPAALPALPRRLPAQCPGQPGHGGGGEVGWGPPLPHVLFPGSPEPRGRLLYHCHRPQTAGRLAPPAPGRVLPGMLFPDVLLRGSGHHRELPAGSHVLRPRGGRLPPPALLRGHDAPALRGAGDHVLGGGPPALAAAHAAHLGALLPVPAPVRHFFCDMTVMLSLATSDTATAEAAIFSEGLAVVLTPLLLVSLSYARILVAVLGVRAAGGRRRAFATCGAHLVVVSLFFGSVLSVYFRPSSAYSARYDRLASVVYAVLTPTLNPFIYSLRNKEVKGALKRGLRWRAAPQEV

SEQ ID NO: 3627 - DNA, 948 bp, Felis catus
tcattcaggaggccgcttccccatcagcacccttttcagggcgccctgcacatcagggttccggaggctatagatgagtgggttcaacatggggctgaggatagtattgaggatcccaatccctttgtctttgtctgaggctgacactgagcccagacgcatgtaactgaagaagccagttccataaaagatacagaccacggtgaggtgggagccacacgtggagaaggccttcttcctcccctctgctgaacggattcgtagcactgcagctgtgacgtgggcgtaagacactgagatgaggatcatggggaacacccccatgaaagtggcccccacaaaaagcagctgcccattgaggtggatactggagcaggagagctggaaaaggggtgggaggtcgcagtagaagtggttgaccacattagggccgcagaagtcaagcacagacagggccactgtgtgagtcagagcattgataaaggagatagtgcagcaaatggccaccagggcaccccggacttcacggcgcatgcgggtgctgtaggtgaggggctggcagatggccaggtagcggtcataggccatggctgtcaggaggtgacagtccacaccggccaggaggtggaagaagaagagctgtgaaaggcaggcagcgtaggggactctgcactgggggggcaggagacatgctagcattggagggacagtaacagtgatgcatccaatgtccagcagagataggttccccaagaagtagtacatgggagtgtggagtttgggctccacaaagatggcagccaggatgctgaagttgccccctatggtgagtacataggcaaagaggaagacgacaaaaaggatgggtttcagtcttacgttttctgtcaggccaagaaggatgaactcagtgaccgttgtcctgttcccccaggcgcctggctccat

SEQ ID NO: 3628 - protein, 315 aa, Felis catus
MEPGAWGNRTTVTEFILLGLTENVRLKPILFVVFLFAYVLTIGGNFSILAAIFVEPKLHTPMYYFLGNLSLLDIGCITVTVPPMLACLLPPQCRVPYAACLSQLFFFHLLAGVDCHLLTAMAYDRYLAICQPLTYSTRMRREVRGALVAICCTISFINALTHTVALSVLDFCGPNVVNHFYCDLPPLFQLSCSSIHLNGQLLFVGATFMGVFPMILISVSYAHVTAAVLRIRSAEGRKKAFSTCGSHLTVVCIFYGTGFFSYMRLGSVSASDKDKGIGILNTILSPMLNPLIYSLRNPDVQGALKRVLMGKRPPE

SEQ ID NO: 3629 - DNA, 899 bp, Felis catus
tccctgcgaacacccgctgcagggcgccctgcacatcagggttccggagactgtagatgagtgggttcagcatggggctgatgacagtgttgaggatgccaatccctttgtctttgtccgaagcctccactgagcccagcctcatgtagctgaagacgcctgtcccgtagaatacgctgacaaccgtgaggtgggagccacacgtggagaaggctttcttcctgccctcagcagagcggattcgcaggactgcggctgccacgtgtgcataggacacagtgatgaggaccagtggggccacacccatgaaggctgctgctacaaagagcagcagctcattgagctgggtgctggagcaggagagctggaagagctgtgggaggtcacagtagaagtgattgatcacatgggggccacagaagtcaagagtagataaggcaacagtttgggtcagcgcgttggtgaaggaaaaggcacacgacacgcccactagcgcttgctgaattccccagctcatgcgggtgctgtaggtgaggggctggcagatggccagatagcggtcataggccatgactgtcagcaggaagcagtccgcccctgccaggaggtggaaactgaagagctgtgagaggcaggccccgtagggaatgcttctgttattggacatgaagcgtctcagcatggcagggacagtgacactgatgcacccgacatccagcagggacaagttccccaggaagaagtacatgggggtgtggagtttgggttcggcgaggatggcagccaggatgctgaggttgcccccaagagtagctacgtaagcgagaaggaagacggtgaagaggacgggctgcagagctggggtctctgacagacccagcaggacaaactcagtgaca

SEQ ID NO: 3630 - protein, 300 aa, Felis catus
  MOD_RES (300)..(300): Any amino acid
VTEFVLLGLSETPALQPVLFTVFLLAYVATLGGNLSILAAILAEPKLHTPMYFFLGNLSLLDVGCISVTVPAMLRRFMSNNRSIPYGACLSQLFSFHLLAGADCFLLTVMAYDRYLAICQPLTYSTRMSWGIQQALVGVSCAFSFTNALTQTVALSTLDFCGPHVINHFYCDLPQLFQLSCSSTQLNELLLFVAAAFMGVAPLVLITVSYAHVAAAVLRIRSAEGRKKAFSTCGSHLTVVSVFYGTGVFSYMRLGSVEASDKDKGIGILNTVISPMLNPLIYSLRNPDVQGALQRVFAGX

SEQ ID NO: 3631 - DNA, 946 bp, Felis catus
atggacccagaatccaagaccaatggaacagctgttactgagttcatcctgctgggcttagtggagacaccagggctacggccagttgtctttgtagtcttcctcttagcctatctgctcactgttgggggcaacctcagcatcctggccgccatcttggtggagaccaaactccacacccccatgtacttcttcctggggaacctatcggtgctggacgttgggtgtatcaccgtcactgttccttcaatgttggctcgtctcctgtcccacaagcatactgttccctatggagcctgcctcacacagcttttcttctttcaccagttggctggtgtggactgcttcctgttgacagccatggcctatgaccgattcctggccatctgccagcccctcacctacagcacccgaatgagccagacagtccagaggatattggtggctgtgtcctgggctttagccttcactaatgcactgacccacacagtagccatatccaccctgaacttctgtggtcccaatgtgatcaatcacttctactgtgacctcccacagctcttccagctctcctgctccagcacccaactcaatgagctgctactctttggtctgggtatcctcatggcaggtgcacctgtgattctcattgtcacctcctacatccatgtggcagctgcagtcctacgaatccgttctgctgagggcaggaaaaaagccttctccacatgtggttctcacctcactgtggttggcatattctatgggacaggtgtcttcagctacatgaggctgggctcagtggaagcttcagacaaagacaaagggattggcatcctcaacactgtcatcagccccatgctgaacccactcatctacagccttcggaaccctgatgtacagggggctctgtggcaggtgctcacggggaagcgagcccttgcat

SEQ ID NO: 3632 - protein, 316 aa, Felis catus
  MOD_RES (316)..(316): Any amino acid
MDPESKTNGTAVTEFILLGLVETPGLRPVVFVVFLLAYLLTVGGNLSILAAILVETKLHTPMYFFLGNLSVLDVGCITVTVPSMLARLLSHKHTVPYGACLTQLFFFHQLAGVDCFLLTAMAYDRFLAICQPLTYSTRMSQTVQRILVAVSWALAFTNALTHTVAISTLNFCGPNVINHFYCDLPQLFQLSCSSTQLNELLLFGLGILMAGAPVILIVTSYIHVAAAVLRIRSAEGRKKAFSTCGSHLTVVGIFYGTGVFSYMRLGSVEASDKDKGIGILNTVISPMLNPLIYSLRNPDVQGALWQVLTGKRALAX

SEQ ID NO: 3633 - DNA, 948 bp, Felis catus; identical to SEQ ID NO: 21

SEQ ID NO: 3634 - protein, 315 aa, Felis catus; identical to SEQ ID NO: 51

SEQ ID NO: 3635 - DNA, 948 bp, Felis catus
atggaaccagaagttggggttaacaggacatctgttactgagttcattctactcggcctagtggaaacagaacagctgcagtctgtggtctttgtagtcttcctctttgcctatctgctcacagttgggggcaacctcagcatcctggccgccatcttggtggagcccaaactccacacccccatgtacttcttcctggggaacctatcggtgctggacgttgggtgcatcaccgtcactgttccctcaatgttggcccgtctcctgtcccacaagcgtaccgttccctatagagcctgcctcacacagcttttcttctttcacctcctggctggtatggactgcttcctattgacagtgatggcctatgaccgattcttggccatctgccggcccctcacctacagcacccaaatgagcaagacagtccagaggatgttggtggttgtgtcctgggctttgggtttcaccaatgcattaaatcacactcttaccctaaccaccctgaacttctgtggtcccaatgtgatcaatcacttctactgtgacctcccacagctcttccagctctcctgctccagcacccaactcaatgagctgctgctcttcgtagcagcagccttcatggctgtaacccccttggtcctcatcactgtgtcctatgcacacgtggcagctgcagtcctacaaatccgttcagtggaaggcagaaagaaggccttttccacatgtggctcccacctcacagtggtttgcctcttctatggtactggtatcttcaactacatgcgtcttggttccgaggagtcttcagacaaggataaaggggttggggtctttaatactgttatcaaccccatgctgaaccctctcatttacagtcttagaaatcctgatgttcagggcgccctgtggcgggtacttgtggggaagcagtcactgacttaa

SEQ ID NO: 3636 - protein, 315 aa, Felis catus
MEPEVGVNRTSVTEFILLGLVETEQLQSVVFVVFLFAYLLTVGGNLSILAAILVEPKLHTPMYFFLGNLSVLDVGCITVTVPSMLARLLSHKRTVPYRACLTQLFFFHLLAGMDCFLLTVMAYDRFLAICRPLTYSTQMSKTVQRMLVVVSWALGFTNALNHTLTLTTLNFCGPNVINHFYCDLPQLFQLSCSSTQLNELLLFVAAAFMAVTPLVLITVSYAHVAAAVLQIRSVEGRKKAFSTCGSHLTVVCLFYGTGIFNYMRLGSEESSDKDKGVGVFNTVINPMLNPLIYSLRNPDVQGALWRVLVGKQSLT

SEQ ID NO: 3637 - DNA, 907 bp, Felis catus
agtcttcccagagccccatgcatgtccttgttcctcaggctgtagatgaaagggttcatcatgggggtcaccacagcatacatcactgtggctactgagtccttcatggagtaagtttggagggctgcagatataccataccaagtgtcccatagaagagggagaccacagccaaatgtgaggcacaggtggagaaggctttgtacttcccagtcactgagggtatttggagaatagttctgacaatccggacataggacatgatcatgaatcctaagggggtaaggaagataaagcagcctgtggcaatcagcaccatgtgattgacttgggtgttagaacacgcgagcctcagcaggacatacatctcacagaagatgtagtggatcttccgggaaccacagaaggtcaccctggtcatgaggagggtgtgggtgaggccatagaggacagaaagtgcccaacacaaggtgaggagcaaaatgcagagtccaggactcatggccgtggtgtaatggagggggcggcagatggccacatagcggtcataggccattgtggccaggatgaggttgtccagggccaccaaggagacgaggaagtagagctgcgtcagacaccctgcataggagatggctttgttctgagactgaaggctcaccagcatcttggggattgtgttggtgacgaagaagaggtcggtgaaggagaggttggccaggaagaagtacatgggagtgtgcaagcggggatcaaagctgatggccaggatgatgagcacatttcccaccactgtgaccatgtacatggacaggaacatccagaataggatccgctgctgctcaggactctccgagatccccaggagcaggaactcggagactctactctggttgcttccatgcat

SEQ ID NO: 3638 - protein, 267 aa, Felis catus
MHGSNQSRVSEFLLLGISESPEQQRILFWMFLSMYMVTVVGNVLIILAISFDPRLHTPMYFFLANLSFTDLFFVTNTIPKMLVSLQSQNKAISYAGCLTQLYFLVSLVALDNLILATMAYDRYVAICRPLHYTTAMSPGLCILLLTLCWALSVLYGLTHTLLMTRVTFCGSRKIHYIFCEMYVLLRLACSNTQVNHMVLIATGCFIFLTPLGFMIMSYVRIVRTILQIPSVTGKYKAFSTCASHLAVVSLFYGTLGMVYLQPSKLTP

SEQ ID NO: 3639 - DNA, 954 bp, Felis catus
tcactggcccaaggaaaagaagactttgcccctgagacatctcgccagggcacacttcatgtccttgttcctcaggctgtaaatgaaggggttcagcaggggagttatcactgtgtacatgacagcagcagccgtatcctcttctatggagttggaggaagaggatgaggggcacagataagccctgatcactgtcccaaagaagagggcaacaacagcaaggtgggacccacatgtagaaaaggctttgtgccttccctgggcagaggggactctgaggatggctgaaacaatgtggatatacgaaaccaggatgagaataaaggggatcaaaatgactgctcctcccaagaagagcagcacaagctcattgacctgagtgtcagagcaagacactttcatcagaggtcccagatcacagaagaagtcaggaatgatcttcttagagcaaaaggaaagtcgaaagatgaggaaagtgtgggtcatggcaacaagactcgtaaggacccagcaggcagtaaccaggagggtgcagcgctggcggctcatgactatcttatagtggagagggtggcagatggccacgtagcggtcataggccattgtggccaggagaaagatgtccatgtccccaaaagtcaagaagaagtagagctggaccaagcatcccgcataggaaatggacctgctctgggtctggatattcaccagggccttgggcacggtggtggaggtgaaaaggatgtcagcacaggacaggctggcgaggaagaagtacatgggtgtgtgaagacgtgcgtcagtgccaatggccagaacgatgagcaggttcccagtcacggtgaccacatacatgcacaggaacagcaggaagaggatgcgctgctgctctggccgctctgagagtccccagaggaggaactccaagatgctggtctggttccctcctgccat

SEQ ID NO: 3640 - protein, 317 aa, Felis catus
MAGGNQTSILEFLLWGLSERPEQQRILFLLFLCMYVVTVTGNLLIVLAIGTDARLHTPMYFFLASLSCADILFTSTTVPKALVNIQTQSRSISYAGCLVQLYFFLTFGDMDIFLLATMAYDRYVAICHPLHYKIVMSRQRCTLLVTACWVLTSLVAMTHTFLIFRLSFCSKKIIPDFFCDLGPLMKVSCSDTQVNELVLLFLGGAVILIPFILILVSYIHIVSAILRVPSAQGRHKAFSTCGSHLAVVALFFGTVIRAYLCPSSSSSNSIEEDTAAAVMYTVITPLLNPFIYSLRNKDMKCALARCLRGKVFFSLGQ

SEQ ID NO: 3641 - DNA, 922 bp, Felis catus
agataaccagtcctttgcccttggtttcattctcctgggacttactggtcaacaacaacaggaaaatttcttcttcatcctcttcctcttcatttaccccatcacattgattggaaacctgctcatcatcttggccattcactctgacattcaccttcacaaccccatgtattttttccttgccaacctctcctttgttgacatcttattctcctctgtaaccatcccaaagatgctagccaaccatgtcttgggcagcaaagccatctcctttgggggatgtctaacacagatgtatttcatgattgacatgtctaacacagatagctatatcctggctgtgatggcatatgatcgtgccgtggccatcagctgcccacttcgttacacaacaattatgagcccacggacttgtgtcttgctggttgttgggtcttgggtggttggaaacgccaatgccctcccccacactctgctcacagctagtctgtctttctgtggcaaccaggaagtagccaacttctactgtgacactgcctctttactcaagctgtcctgttctgacattcattttaatgtgaagatgatgtacctaggggttggtattttctctgtgccattactatgcatcatcatctcctacatccgggtcttttccacagtcttacgggttccatccaccaagggtgtgctcaaagccttctccacctgtggcttgcacctcacagttgtttctctgtattatgggacagtcatgggcatgtatttccgccctctgactagttatagcctgaaggacgcagtgataactgtgatgtacattgcagtgaccccaatgctaaatcctttcatctacagtctgagaaaccgagacatgaaggctgccctgggaaaactcttcagcaaaagactctcctcataa

SEQ ID NO: 3642 - protein, 306 aa, Felis catus
DNQSFALGFILLGLTGQQQQENFFFILFLFIYPITLIGNLLIILAIHSDIHLHNPMYFFLANLSFVDILFSSVTIPKMLANHVLGSKAISFGGCLTQMYFMIDMSNTDSYILAVMAYDRAVAISCPLRYTTIMSPRTCVLLVVGSWVVGNANALPHTLLTASLSFCGNQEVANFYCDTASLLKLSCSDIHFNVKMMYLGVGIFSVPLLCIIISYIRVFSTVLRVPSTKGVLKAFSTCGLHLTVVSLYYGTVMGMYFRPLTSYSLKDAVITVMYIAVTPMLNPFIYSLRNRDMKAALGKLFSKRLSS

SEQ ID NO: 3643 - DNA, 930 bp, Felis catus
atgagggaaaacaaccagtcctccaccctggaattcatcctcctgggagttactggtcagcaggaacaggaagacttcttcttcatcctcttcctgttcatttaccccatcacattgattggaaacctgttcatcatcttggccattcactctgacattcaccttcacatccccatgtactttttccttgccaacctttcctttgttgacatcttattctcctctgtaaccatccccaagatgctaaccaaccatctcatgcacagcaaagccatctcctttggaggatgcctagcacagttgtattttatgattgccttgggtaacacagatagctatatcctggctgcgatggcatatgatcgtgccgtggccatcagccgcccacttcattacacaacaattatgagcccacggacttgtgtcttgctagttgttgtgtcctgggtggttggaaatgccaatgccttcccgcacactctgctcacatccagtctgtccttctgtggcaataaagaagtagccaacttctactgtgacactatccctttgctgaagctcgcctgttctgacatccgttttaatgtgaaggtgatgtacctaggggctggcgttttctctgtacccttactattcatcatcatctcctatattcaggtcttttccacagtcctgagggttccatccaccaagggtgtgctcaaagccttctctacctgtggttcccacctcactgttgttactctatattatgggacagtcatgggcatgtatttccgccctctgtctagttacagcctaaaggatgcagtggtaactgttatgtacatgacagtgatcccaatgttaaatcctttcatttatagcctgagaaatcaggacatgaaggctgccctggggaaactcttcagaaaaagactctcctcataa

SEQ ID NO: 3644 - protein, 309 aa, Felis catus
MRENNQSSTLEFILLGVTGQQEQEDFFFILFLFIYPITLIGNLFIILAIHSDIHLHIPMYFFLANLSFVDILFSSVTIPKMLTNHLMHSKAISFGGCLAQLYFMIALGNTDSYILAAMAYDRAVAISRPLHYTTIMSPRTCVLLVVVSWVVGNANAFPHTLLTSSLSFCGNKEVANFYCDTIPLLKLACSDIRFNVKVMYLGAGVFSVPLLFIIISYIQVFSTVLRVPSTKGVLKAFSTCGSHLTVVTLYYGTVMGMYFRPLSSYSLKDAVVTVMYMTVIPMLNPFIYSLRNQDMKAALGKLFRKRLSS

SEQ ID NO: 3645 - DNA, 924 bp, Felis catus
gaagacaaccaatcttctaccctggaattcattctcctgggagttactggtcagcaggcacaggaagacttcttcttcatcttcttcctgttcatttaccccatcacattgactggaaacctgctcatcatcttggctattcgctctgacattcgccttcacaatcccatgtattttttccttgccaacctctcctccgttgacatcttattctcctctgtaaccatccccaagatgctagccaaccatgtcttgcacagcaaatccatctcctttgggggatgtctaacacaaatgtattttatgattgccttgggtaacacagatagctatatcctggctgtgatggcatatgatcgtgccatggccatcagccgcccacttcattacacaacaattatgagcccacagacttgtgtccttctagttgttggatcttgggtggttggaaacgccaatgccctcccccatactctgctcacagctagtctgtccttctgtggcaacaaggaggtagccaacttctactgtgacattacccctttgcttaagctgtcctgttctgacatccacttcaatgtgaagatgatgtacgtaggggttggtattttctctgtgccattactatgcatcatcatctcctatgtccgggtcttttccacagttttatgggttccttccactaagggcatgctcaaagccttctccacctgtggctcccacctcactgttgtttctctgtattatgggacagtcatgggcatgtatttccgccctctgactagttacagcctaaaggatgcaatcatgactgttatgtacatggcagtgactccaatgctaaatcctttcatttatagtctgagaaacagagacatgaaggctgccctgaggatactattcagcaagagaatttcctcataa

SEQ ID NO: 3646 - protein, 307 aa, Felis catus
EDNQSSTLEFILLGVTGQQAQEDFFFIFFLFIYPITLTGNLLIILAIRSDIRLHNPMYFFLANLSSVDILFSSVTIPKMLANHVLHSKSISFGGCLTQMYFMIALGNTDSYILAVMAYDRAMAISRPLHYTTIMSPQTCVLLVVGSWVVGNANALPHTLLTASLSFCGNKEVANFYCDITPLLKLSCSDIHFNVKMMYVGVGIFSVPLLCIIISYVRVFSTVLWVPSTKGMLKAFSTCGSHLTVVSLYYGTVMGMYFRPLTSYSLKDAIMTVMYMAVTPMLNPFIYSLRNRDMKAALRILFSKRISS

SEQ ID NO: 3647 - DNA, 909 bp, Felis catus
atggatggaggcaaccagactagaatctctgacttcctactcctggggatttcagagagtcctgagcagcagcaagtcctgttctggatgttcctgtccatgtacctggtcacagttgtgggaaatgtgctcatcatcctggccatcagctttgatccccgcttgcacactcccatgtacttcttcctggccaacctctccttcaccgaccttttctttgtcaccaacacaatccccaagatgttggtgaaccttcagtcccagaacaaagccatctcctatgcggggtgtctgacacagctctacttcctggtctccttggtgacactggacaatctcatcctggctacgatggcctatgaccgctatgtggccatctgccgccccctccactatgtcacagccatgagccctgggctctgtatcttgctcctcaccttgtgttggtcactttctctcctctatggcctcaccctcaccctcttcatgaccaaggtgactttctgtggttcccggaagatccactacatcttctgtgagatgtatgttctcctgaggttggcctgttccaacacccagatcattcacatagtgctgattaccacaggcatctttatcttcctcaccccctttgggttcatgatgatatcctacattcgtatcgtcagaaccatcctccaaataccttcagcctctagtaaatacaaagccttctccacctgtgcctctcatttggctgtggtctccctcttctatgggacgctttgtatggtatatctgcagcctctccaatcctactccatgaaggactcagtagccacagtgatgtatgctgtggtgacccccatgatgaaccctttcatctacagcctgaggaacaaggacatgcatggggctctgggaagactg

SEQ ID NO: 3648 - protein, 303 aa, Felis catus
MDGGNQTRISDFLLLGISESPEQQQVLFWMFLSMYLVTVVGNVLIILAISFDPRLHTPMYFFLANLSFTDLFFVTNTIPKMLVNLQSQNKAISYAGCLTQLYFLVSLVTLDNLILATMAYDRYVAICRPLHYVTAMSPGLCILLLTLCWSLSLLYGLTLTLFMTKVTFCGSRKIHYIFCEMYVLLRLACSNTQIIHIVLITTGIFIFLTPFGFMMISYIRIVRTILQIPSASSKYKAFSTCASHLAVVSLFYGTLCMVYLQPLQSYSMKDSVATVMYAVVTPMMNPFIYSLRNKDMHGALGRL

SEQ ID NO: 3649 - DNA, 925 bp, Felis catus
tttctttttccaaaagactcttcccagggctcccttcatgtctctgttcctcagactttggatgaagggattcagcacgggggtgaccacagtgtacatcatggccaagacagtctccttaacagcagaattattagctgatggacacaagtagagaccgataactgtcccatagaagagagacagcacagagaggtgggagccacaggtggagaaggccttgaggacgcccctggcagaagggaccctgaggatggaggacacaatccgtgcataagacatgacgatgagtaggaatgggatgacgagaatgagccctcccatgataaatatcaccaactcattgattcgagtatcagagcaggccagcttcagcagagcagacatatcacagaaaaagcgggggattatgttgttggcacagaaggacagcttggccatgagcagggtgtgcaacatggcatgggcagtagtcagcacccaggaccaccaccaaggagagacagaggttggggctcatgatggtggtgtagtgcagaggaaaacagatggccacatagcgaccataggccatgacaacaatgaggaagctctcaagaactccaaaaaacaagtaacaatacatctgggccaggcagctggcataggggaggggcgggacctggctctgcatgttctgaagcagtttgggcattgtgacagaggagaagcagaggtcagagaaggattaattgctaagaaacaaatacatgggcacgtggaggtgggagtccaggcgaatgaggacgacgatgagaaggttccccaggacggtggtaacatacacagccaggaacagagcacagaacagattccactgctccggttcgatgggcaggcccagaaggaggaactctgagacgacagtttggttcctctctgccat

SEQ ID NO: 3650 - protein, 153 aa, Felis catus
MLHTLLMAKLSFCANNIIPRFFCDMSALLKLACSDTRINELVIFIMGGLILVIPFLLIVMSYARIVSSILRVPSARGVLKAFSTCGSHLSVLSLFYGTVIGLYLCPSANNSAVKETVLAMMYTVVTPVLNPFIQSLRNRDMKGALGRVFWKKK

SEQ ID NO: 3651 - DNA, 909 bp, Felis catus
atgcatggaggcaaccagagtgagacctcagagttcctactcctggggctctcggagagtcctaaagagcagctggtcttgttctggatgttcctgtccatgtacctggtcacagtggtgggaaatgtgctcatcatcctggccatcagcattgatccccacttgcacactcccatgtatttactcttggccaacctctccctcactgacctcttctttgtcaccaacacaatccccaacacattagtgaaccttcagtctcagaacaaagccatctcctatgcagggtgtctgacacagctctacttcctggtctccttggtgactctggacaacttcatcctggccacaatggcatatgaccgctatgtggccatctgccgccccctccactatgtcacagccatgaaccctgggctctgtattttgctcctcaccctgtgttggggactttctgtcctctatggcctcttcctcaccctcttcatgaccaaagtgacattctgtggttcccggaagatccactacatcttctgtgagatgtatgtgctgctgaggcttgcatgctccaatacccaggtcattcacacagtgcagattactacaggctgcttcattttcttcacccccctagggatcatgatcatgtcttatgtctggattgccagagccatcctccgaataccctcagcttctagtaaatacaaagccttctccacctgtgcttcacatttggctgtggtctccctcttctatgggacacttggtatggtatatctgcagcccctccaaacttactccatgaaggactcagtagccacagtgatgtatgctgtggtgacccccatgatgaaccctttcatctacagcctgaggaacaaggacatgcatggggctctgggaagactg

SEQ ID NO: 3652 - protein, 303 aa, Felis catus
MHGGNQSETSEFLLLGLSESPKEQLVLFWMFLSMYLVTVVGNVLIILAISIDPHLHTPMYLLLANLSLTDLFFVTNTIPNTLVNLQSQNKAISYAGCLTQLYFLVSLVTLDNFILATMAYDRYVAICRPLHYVTAMNPGLCILLLTLCWGLSVLYGLFLTLFMTKVTFCGSRKIHYIFCEMYVLLRLACSNTQVIHTVQITTGCFIFFTPLGIMIMSYVWIARAILRIPSASSKYKAFSTCASHLAVVSLFYGTLGMVYLQPLQTYSMKDSVATVMYAVVTPMMNPFIYSLRNKDMHGALGRL

SEQ ID NO: 3653 - DNA, 917 bp, Felis catus
atggaaggaagaaatcaaactcatgttacggaatttatcctcttgggactctcagaccagggggcgctgcagtcactgctcttttggctgttcctgtccttgtacttggtcaccttcactgggaacctactcatgatcctggccattatcacagactcctgcctccacatgcccatgtacttcttcctctccaacctgtccttttcagacatatgtttcacctccaccaccatcccaaagatgctgctgaacatccagacgcagagcagagggatctcctacaaaggttgcctcagccagatgtactttttcatgctttttgcaggaatcgacaacctcctcttgacagtgatggcctatgaccggttcgtggccatctgtcacccattgcgctacatggtcatcatgaaccccaagttctgtggcatcctgcttctgggatcctgttattgagtgttcttgtttctctgttacatgacttactgattttgcgactctctttttgcgcagatctggaaatccttcactttttctgtgaacttaagcaggtgatccaacttgcttgctctgataccttcctcaatgacctggtaatgtatttgtcaagtggacttctgggtgttgttccactcactggcatcctctcctcttactctagaattgtagcctccatcttgagaatttcatcagtgaaaggcaagtataaagcattttccacgtgtgggtctcatctctcagttgtgttcttgttctatggtacaagccttggtgtatattttaattctgctgcttcacaaacctccagcacaggtgccatagcctcagtaatgtacacggtggtgatgcccatgctgaaccccttcatctatggtctcaggaacagagacatcaagcaagccctgagaaagctctttagc

SEQ ID NO: 3654 - protein, 150 aa, Felis catus
MEGRNQTHVTEFILLGLSDQGALQSLLFWLFLSLYLVTFTGNLLMILAIITDSCLHMPMYFFLSNLSFSDICFTSTTIPKMLLNIQTQSRGISYKGCLSQMYFFMLFAGIDNLLLTVMAYDRFVAICHPLRYMVIMNPKFCGILLLGSCY

SEQ ID NO: 3655 - DNA, 933 bp, Felis catus
cttccttttacaaaccagccggcgcctccctagtctcttcactgctgcctgcacctcctggttcctcagggtgtagatcatggggttgagcatgggggtcatgaccgtgtggctgatggacacagccttgtccatggagaagggggtgaagggccgggcatagaggtaaatgcttggaatgaaaaccatagacaccacgacgatgtgggtggtgcaagtggaagctgccttcctcctcgcctgcccagagtgggacctcagcatcaccaggatgactgagtaggaggtcaggaggagaaagaaccagatgacatccagcagcccactgttggagatcatgaggaactccaggagggtggtgtcagtgcaggcaagtctcagcacttgtgggacatcacagtagaagttatccaggacgttggggccacagaaaggcaacgggagcatcagagccagttgggcaacggaatggacgaatcctcctatccagctagccaccacaagtcccacacagagctgtgtattcatgatggtcacatagtggaggggtcgggagatggcaacaaggcggtcataggccatgactgagaggaagaagaccatggcgcctcccagaaagtggaagaagaagatctgggccatgcagccctggtaggagatggtcttcttctcagagaggaagtccaccagcatctttggggcagtgacagaggagaaacagaggtctaagacagccagatttcggagcagaaagtacatgggtgtgtggagccgtgtgtctgaggtcaccgtgaccataatgaggaggtttcccatgacagtggtggtatagacaaacaggaacaccagaaacagaaaaagctggagctctcgagtctgtgagagtcccaggaagacaaattctgatacccacgtgaggtttccttgttccat

SEQ ID NO: 3656 - protein, 311 aa, Felis catus
MEQGNLTWVSEFVFLGLSQTRELQLFLFLVFLFVYTTTVMGNLLIMVTVTSDTRLHTPMYFLLRNLAVLDLCFSSVTAPKMLVDFLSEKKTISYQGCMAQIFFFHFLGGAMVFFLSVMAYDRLVAISRPLHYVTIMNTQLCVGLVVASWIGGFVHSVAQLALMLPLPFCGPNVLDNFYCDVPQVLRLACTDTTLLEFLMISNSGLLDVIWFFLLLTSYSVILVMLRSHSGQARRKAASTCTTHIVVVSMVFIPSIYLYARPFTPFSMDKAVSISHTVMTPMLNPMIYTLRNQEVQAAVKRLGRRRLVCKRK

SEQ ID NO: 3657 - DNA, 942 bp, Felis catus
ttaagttcactccctgttacatatcactagacgcttgcctaatctcttcatggctgcctgcatctcctggttcctcagagtatagatcatggggttgagcatgggggtcatgaccgtgtagctgatggacacagccttgtccatggggaagggggtgaagggccgggcatagatatagatgcagggaatgaagatcatagacaccacaatgatgtgggtggtgcaggtagaagctgccttcttcctcgcctgctctgaatgggacctcaacatcaccaggatgactgtgtaagaaatcagaaggagaaggaaccagatgaggaccagcattccactgttggagatcatgaggaactccaggagggaggtgtcagtgcaggcaagtctcagcacttgtgggatgtcacagtagaagttatccagaacattgggaccacaaaaaggcaaggggagcatcaaagccagctggacaatggagtgaacaaatccccctaaccaagcagccaccactagccccacacagagctgagtgttcatgatggtgacatagtggaggggccgggagatggctatgtagcggtcataagccatcactgagagaaagaagacagtcccacctcccaagaggtgaaagaagaagatctgagtcatgcagccctggtaggagatggtcttgacctcatgaaggaagtccaccagcatctttggagaagtgacagtggaataacagaggtctatgacagccaggtttcggagcagaaaatacatgggcatgtggagccggcagtcaaaagtcactgtgaccatgataaggaggtttcccacaacagtggtgacatagacaaataggaacaccaggaacaggaatttctcaaggtcccgggtctgtgagaatcctaagaggataaactctgacacccttgtgatattctgtgcttccat

SEQ ID NO: 3658 - protein, 311 aa, Felis catus
MEAQNITRVSEFILLGFSQTRDLEKFLFLVFLFVYVTTVVGNLLIMVTVTFDCRLHMPMYFLLRNLAVIDLCYSTVTSPKMLVDFLHEVKTISYQGCMTQIFFFHLLGGGTVFFLSVMAYDRYIAISRPLHYVTIMNTQLCVGLVVAAWLGGFVHSIVQLALMLPLPFCGPNVLDNFYCDIPQVLRLACTDTSLLEFLMISNSGMLVLIWFLLLLISYTVILVMLRSHSEQARKKAASTCTTHIIVVSMIFIPCIYIYARPFTPFPMDKAVSISYTVMTPMLNPMIYTLRNQEMQAAMKRLGKRLVICNRE

SEQ ID NO: 3659 - DNA, 939 bp, Felis catus
atggagaggtccctggagttggtcaacatgacaagagtccaggagtttgtcttgttgggtttgtccacaaggctgggcataaggattgtcctgtttgccatcttcctgaccctctacctgctgaccctcctggagaacacgctcatcatctacctcatctgcagtcacatcgagctccacaagcccatgtatttcttcctgggcaacctgagctgcctggagatgtgctacgtgtccgtgacaatgcccagtctgctcgtgggtttgtggactggacctttccatatctccttcacagcctgcatgacacagcttttcttcttcatagtcctcatcggcacggagtgcaccctcctggcctccatggcctatgaccgctacgtggctatctgccgcccactccactacccactgctcatgaggccccaggtctgcctgggcttagccttgtcctcatggcttggggggctgttggtctcggtggccaagacgacatgcattgccagcctttcctactgtggccccaatgtcctcaaccacttcttctgtgacgtctcccctctgctcaacctgtcctgcacccacgtggccctgacggagctggtggacttcatctctgccattgtcatcttctgtggaacactgttggtagcattggcttcctactcggccatcgtggtggctgtgctccgcatgccatcagctgctgcccagcgcaaggccttttccacctgtgcctcccacctgattgtggtgggcatcttctactcagcagccctcttcatttattgtcgtcccagccgtatcaaatccatggacctcaacaaggtgctatctgtcatctacacagtggtcacgcccatgtgcaaccccatcatctactgcctgcggaacaaggaggtccatgtagtgcttcggaaaactctccactggccttga

SEQ ID NO: 3660 - protein, 312 aa, Felis catus
MERSLELVNMTRVQEFVLLGLSTRLGIRIVLFAIFLTLYLLTLLENTLIIYLICSHIELHKPMYFFLGNLSCLEMCYVSVTMPSLLVGLWTGPFHISFTACMTQLFFFIVLIGTECTLLASMAYDRYVAICRPLHYPLLMRPQVCLGLALSSWLGGLLVSVAKTTCIASLSYCGPNVLNHFFCDVSPLLNLSCTHVALTELVDFISAIVIFCGTLLVALASYSAIVVAVLRMPSAAAQRKAFSTCASHLIVVGIFYSAALFIYCRPSRIKSMDLNKVLSVIYTVVTPMCNPIIYCLRNKEVHVVLRKTLHWP

SEQ ID NO: 3661 - DNA, 975 bp, Felis catus
atggagaggcccctggagttgggcaacgtgaccagagtccaggagtttgtcttgttgggtttgtccacaaggctgggcataaggattgtcctgtttgccatcttcctggccctctacctgctgaccctcctggagaacacgctcatcatctacctcatctgcagtcacatcgagctccacaagcccatgtatttcttcctgggcaacctgagctgcctggagatgtgctacgtgtccgtgaccgtgcccagcctgctcgtggggctgggctccagtccatgccatgtgcccttcgcagcctgcatgacacagctttttttattcatagctctcattagtaccaagtgcaccctcctggcctccatggcctatgaccgctacgtggccatctgccgcccactccactacccactgctcatgaggccccaggtctgcctgggcttagccttgtcctcatggcttggggggctgttggtctcagtggccaagacatcatgcatcgccagcctgtcctactgtggccccaatgtcctcaaccactttttctgtgatgtctcccctctgctcaacctgtcctgcactaacgtggccctgacggagctggtggacttcatctctgctatcgtcatcttctgtgggtcattgctagtggctctggcctcctatgtggccatcgggagggctgtgctccacatgccatcagccgtcacccgctgcagagccctctccacctgtgcctcccacctggtggtggtgggcatcttctatggggtggtcctcttcatgtattcccgcccccgcctcatcggttccacagacctcaacaaggtgctgtctgtcatctacacggtggtcacgcccatgtgcagccccatcatctactgcctgcggaacagggaggtccaggcagtgctgcagaaaaccctccactcaccccgggtctcttcagcaacaacacactttgcccactcctga

SEQ ID NO: 3662 - protein, 324 aa, Felis catus
MERPLELGNVTRVQEFVLLGLSTRLGIRIVLFAIFLALYLLTLLENTLIIYLICSHIELHKPMYFFLGNLSCLEMCYVSVTVPSLLVGLGSSPCHVPFAACMTQLFLFIALISTKCTLLASMAYDRYVAICRPLHYPLLMRPQVCLGLALSSWLGGLLVSVAKTSCIASLSYCGPNVLNHFFCDVSPLLNLSCTNVALTELVDFISAIVIFCGSLLVALASYVAIGRAVLHMPSAVTRCRALSTCASHLVVVGIFYGVVLFMYSRPRLIGSTDLNKVLSVIYTVVTPMCSPIIYCLRNREVQAVLQKTLHSPRVSSATTHFAHS

SEQ ID NO: 3663 - DNA, 945 bp, Felis catus
tcagcttcaggactggtgtagggttctgcagaatgctgcctggacctccctgttccgcaggcagtagatgacgggattgcacatgggtgtgaccaccgtgtagatgacagacagcaccttgttgaggtccatggcttctatgcggctgggacgggcgtagatgaagagagtggctgagtagaagatgcccaccaccaccaggtgggaggcgcaggtggagagggctttgcggcgggcagcggctgatgacatgtggagcacagccctcccgatggccacataggaggtgatggccatgagaagggaaccccagaggatgacgatggcagagatgaagtccaccagctccgtcagggccacgtgggtgcaggacaggttgagcagaggggagacgtcacagaagaagtggttgaggacattggggccacagtaggaaaggctggcaatgcatgtcgtcttggccaccgagaccaacagccccccaagccatgaggacaaggctaagcccaggcagacctggggcctcatgagcagtgggtaatggagtgggcggcagatggccacgtagcggtcataagccatggaggccaagagggtgcactctgtgcagatgaggactatgaagaagaaaagctgtgtcatgcaggctgtgaaggaaatatggtaaggtccagtccacagccccacgagcagactgggcatggtcacggacacgtagtacatctccaggcagctcaggttgcccaggaagaaatacatgggcttgtggagctcgatgtgactgcagatgaggtagatgatgagcgtgttctccaggagggtcagcaggtagagggtcaggaagatggcaaacagaacatcccttacgtctggccttgtggacaaacccaacaagacaaactcctggactctggtcacattgcccaactccaagggcctctccat

SEQ ID NO: 3664 - protein, 312 aa, Felis catus
MERPLELGNVTRVQEFVLLGLSTRPDVRDVLFAIFLTLYLLTLLENTLIIYLICSHIELHKPMYFFLGNLSCLEMYYVSVTMPSLLVGLWTGPYHISFTACMTQLFFFIVLICTECTLLASMAYDRYVAICRPLHYPLLMRPQVCLGLALSSWLGGLLVSVAKTTCIASLSYCGPNVLNHFFCDVSPLLNLSCTHVALTELVDFISAIVILWGSLLMAITSYVAIGRAVLHMSSAAARRKALSTCASHLVVVGIFYSATLFIYARPSRIEAMDLNKVLSVIYTVVTPMCNPVIYCLRNREVQAAFCRTLHQS

SEQ ID NO: 3665 - DNA, 939 bp, Felis catus
tcagccgaattctcttccctttccccggagcctcctcagtgccgcctttacctccttgtttctcagagtgtagatgagagggttcaccattggcgtgaccacagagtagaagagggaaatgaatttgccttggccctggtggctggtcttagccggaaggaggtacccgtagatagctgacccatagaagaggagcaccaccaccagatgggaaaggcaagtattaaaggcctttctctgtccctcagctgagcggatcttcagcactgcccgagctatggagcagtaggagatcaggatgatgctcagcgggacggcagtgaagaaggtgcagacaccattgagcacggcctcgttgagacttgtgtctccacaggccagtttgatcatggcaggcacctcacacaggaagttgtccaccctccggtgcccacacaatgggagctggagagtgaacgttgactggatcatggagttgctcaagccgcccagccatgcaatggcagccagcagccggcagagccgagggctcacgatgacggtgtagcgcaggggctggcaaactgccacatggcggtcgaatgccatcaccacgagcaggatgcactcagtggcccctagccagaggaaaacatagagctggatcacacagccagcgtagcttatagtcttatctggtccccataagttggtcagcatttgggggaccgagctggtagtaaaagcgaggtccagggaggagaggttgctgaggaagaagtacatgggggtgtggagccgggcatccaggcaggagagcaggatggtggtcgaattcccaactagggtcagcgagtaagagaagagaatgactatgaaaaagacgatctccagctggggatggtcagatatacccatcaggatgaagccctctgaaaagctgttgttggcctctgccat

SEQ ID NO: 3666 - protein, 312 aa, Felis catus
MAEANNSFSEGFILMGISDHPQLEIVFFIVILFSYSLTLVGNSTTILLSCLDARLHTPMYFFLSNLSSLDLAFTTSSVPQMLTNLWGPDKTISYAGCVIQLYVFLWLGATECILLVVMAFDRHVAVCQPLRYTVIVSPRLCRLLAAIAWLGGLSNSMIQSTFTLQLPLCGHRRVDNFLCEVPAMIKLACGDTSLNEAVLNGVCTFFTAVPLSIILISYCSIARAVLKIRSAEGQRKAFNTCLSHLVVVLLFYGSAIYGYLLPAKTSHQGQGKFISLFYSVVTPMVNPLIYTLRNKEVKAALRRLRGKGREFG

SEQ ID NO: 3667 - DNA, 939 bp, Felis catus
accaggtagaaaaatattcagagcaaccacttttccaagagccccttttatgtccttgttcctcaggctgtagatgaaggggttcaacatgggggtcaccaccgtgaacatcacagcagatgctatatctgcctcagctgagtgtgaggctaaagggttgaaatacacagcaatgatggtgccatagaagagggaaaccacggccaggtgcgagccacaggtggagaaggctttccatcttcccttcgtggacgggactctcaggacagcgcgggtaatatggacatacgaagccaggatgcaaataaatggagagatcatgatcaaccctgcttcaataagaaccatcatctcattgagatgggtgtcagagcaggacagtttcaggaggggagtcacatcacagaagaagtgggggatggcattgtctgcacagaacgagagtcgagccatcagcagggtatgcagtaggacatccaggttggcaatgacccatgacccaacaaccagcagggcacagagctggtgggtcatctttgtcgagtagtgtaaggggtggcatatggcaacaaagcggtcataggccatcacagccaggaggaaattgtccatgtccacgaacatgaacacaaaatacatctgtgtgagacacccagagaaggagatggcctgagtcccaaggatgtggttggccagcatcttggggacggtggtggtggagaagcagatgtccacaaaggacaggtggctgaggaggaagtacatggggatgtgcaggcgggggtccacgcagatggccaggaggatgagcaggtttcccaggaccgtggccaggtacatgctcaggaagagcgcaaagagggcctgctgctgctggggctgcctggagagcccgaggaggaggaactcggagacactcgactggtttgctcctctcat

SEQ ID NO: 3668 - protein, 313 aa, Felis catus
MRGANQSSVSEFLLLGLSRQPQQQQALFALFLSMYLATVLGNLLILLAICVDPRLHIPMYFLLSHLSFVDICFSTTTVPKMLANHILGTQAISFSGCLTQMYFVFMFVDMDNFLLAVMAYDRFVAICHPLHYSTKMTHQLCALLVVGSWVIANLDVLLHTLLMARLSFCADNAIPHFFCDVTPLLKLSCSDTHLNEMMVLIEAGLIMISPFICILASYVHITRAVLRVPSTKGRWKAFSTCGSHLAVVSLFYGTIIAVYFNPLASHSAEADIASAVMFTVVTPMLNPFIYSLRNKDIKGALGKVVALNIFLPG

SEQ ID NO: 3669 - DNA, 978 bp, Felis catus
ttagctgacctcggcccggacgacgttccctgacgtcctgccgccgaccacccgccacagggcaccctgcacgtcccggttgcgcagcgtgtagatggcagggtagagcaacggcgtgaggttgatgtagacgagcgacaccagcttgtcctcctcgagggagcggctgctcaggggtcgggcgtacatggccgtggcacagccatagtggagcacggccacggtgagatgcgacgccaccgtgttgaaggccttgcggcggcccgccacccccccgactcccaggatgaccgccagcaccctggtgtaggacagcaggatcaggaccagaggcagcaccagcagcagcaggcaggcggccagcaggaccctctcctgcaggtcccggtccccacaggccagcaccaacacggccgggaggtcacagaagacgtggttgacgaggcccccccggcagaagggcagctggaagatggccacggtgaggcccaaggccaggagagagcccccaacgcagcaggaggcgagaaggcaccggcagcgccccgcggtcatgagccgggggtagcagagagggcggcagatggccaggtagcggtccagtgccatggcggccagcagcaggcactcggagcctcccagcgccacgaagaggcccatctgggcagcacaggtggagcgggccaccgcctggccccccgggggcagcaggaagcccgcgagcatgcgcggagtcagcaccagcgtgtaggccacctccacggccgacagcgcccccagaaagaagtacatgggggtgtgcagggcggggtccccgacggccaggcccaggatgagcaggtttcccaccagcgtggccaggtagagtggcagcaggaaggcaaagagcagcagccgcagcccccggggccacccggagaaacccaggatcacgaactcccgcggagccgtccggtttgacccaggccaggggctcat

SEQ ID NO: 3670 - protein, 325 aa, Felis catus
MSPWPGSNRTAPREFVILGFSGWPRGLRLLLFAFLLPLYLATLVGNLLILGLAVGDPALHTPMYFFLGALSAVEVAYTLVLTPRMLAGFLLPPGGQAVARSTCAAQMGLFVALGGSECLLLAAMALDRYLAICRPLCYPRLMTAGRCRCLLASCCVGGSLLALGLTVAIFQLPFCRGGLVNHVFCDLPAVLVLACGDRDLQERVLLAACLLLLVLPLVLILLSYTRVLAVILGVGGVAGRRKAFNTVASHLTVAVLHYGCATAMYARPLSSRSLEEDKLVSLVYINLTPLLYPAIYTLRNRDVQGALWRVVGGRTSGNVVRAEVS

SEQ ID NO: 3671 - DNA, 945 bp, Felis catus
tcacagcccacaggataaagcctttatactgaacagttttcttgtggctcccttcatgtccttgtttctcaggcagtaaatgaaggggttcagcatgggtgtgaccaccatatacatcactgaagccagtgaatccttgtcagttgaatgggatgatgagggactcaagtagacccccgtgatagtcccatagaagagggtgactacagcaagatgagaaccacaggtagaaaaggccttttgtttgccctgggtagatgggaccttaagcacagcagacacaatgtgggtgtaggacacaagaatggcgaggaaaggaatgaggacaatcaaaccccccaccagcagaatcatgagctggttgagctgtgtattggaacaggatagctggagcaggggaatgaggtcacaaaagaagtaagggatgacgttgctggcacagaactccagccgagccatgaggatagtgtgtagcagggagtggaggctggcgatgagccaggagctccccagcatcagggcacagatttgcagactcatcatggtggaatagtgaagggggtggcagatggccacataacggtcataagccattgccatcaggagaaagttgtccatgttggcaagcaaaatgcagaagtagatctgggttaggcagccacaataagaaatggactgagtctgcatctggatgttcacaagcatcttagggactgtggaggagatgaagcagaaatccacaagggaaaggttgctgaggaagaagtatatgggtgtgtggaggtgggagtctgaaccaatggccaggatggtgagcaagttccctgctgccccgaccaggtacatgacaaggaagagcccaaagatcagatcttgcctttcgggctggctggagagccctaggaggatgaactcagaggcactcgtgtagttttcttcctccat

SEQ ID NO: 3672 - protein, 314 aa, Felis catus
MEEENYTSASEFILLGLSSQPERQDLIFGLFLVMYLVGAAGNLLTILAIGSDSHLHTPIYFFLSNLSLVDFCFISSTVPKMLVNIQMQTQSISYCGCLTQIYFCILLANMDNFLLMAMAYDRYVAICHPLHYSTMMSLQICALMLGSSWLIASLHSLLHTILMARLEFCASNVIPYFFCDLIPLLQLSCSNTQLNQLMILLVGGLIVLIPFLAILVSYTHIVSAVLKVPSTQGKQKAFSTCGSHLAVVTLFYGTITGVYLSPSSSHSTDKDSLASVMYMVVTPMLNPFIYCLRNKDMKGATRKLFSIKALSCGL

SEQ ID NO: 3673 - DNA, 949 bp, Felis catus
gcaattgccatctctgagtgagaatctccctccccatcactcctctcagagccttggctacatccttattccggagagtataaatcaaaggattcagggtaggagtaatgatgctatagaacacagaaccaactttgtcttgcagtggagttctctgggatccgggcctcatatatgagaagatgcaggcaccaaaccaaaaggaaaccacaatgaggtgagagctacaagtggcaaaagcatttctcttactcccagctgaacgcatctgaatgacactgtggagaatgaaggcatacgatgtagaaatgaagagggtggggaggaggagaagtacaatgctgatgatgtacactatggtctcatatacagtgatgtctccacacaccaacttcaaaatagctggaaactcacaatagaagtggtggatttttcgagacccacagaaaggtaagtgcatcaagatcactgtgtgaattagagagtttatggatgctcccaaccacgacatgaccaccatcatcagtcccacctttctgctcatgagaacagtatagcgaagtggatgacagatggcaacatagcggtcataagacatgagagctaagagaagacactcagcaccacccagagacaaatacaggaagtgctgggttgcacagcccacaaaggagatggtcttcttgccagataggtagttggtagccatcttggggatggttgtggagacatgcatcagatccatgagggagagctggctgagcaggaagtacatgggtgtatgaagccgagcatcagcacagatgaggagaatagtgagcatgttgccactcaccgcaataaggaagaccactatggttaaagagaaaaggaaaagatgggtgagagagtcatcaaagagcccttcaaggatgaagtctgccagagaggtctgattcctctgccacat

SEQ ID NO: 3674 - protein, 317 aa, Felis catus
  MOD_RES (317)..(317): Any amino acid
MWQRNQTSLADFILEGLFDDSLTHLFLFSLTIVVFLIAVSGNMLTILLICADARLHTPMYFLLSQLSLMDLMHVSTTIPKMATNYLSGKKTISFVGCATQHFLYLSLGGAECLLLALMSYDRYVAICHPLRYTVLMSRKVGLMMVVMSWLGASINSLIHTVILMHLPFCGSRKIHHFYCEFPAILKLVCGDITVYETIVYIISIVLLLLPTLFISTSYAFILHSVIQMRSAGSKRNAFATCSSHLIVVSFWFGACIFSYMRPGSQRTPLQDKVGSVFYSIITPTLNPLIYTLRNKDVAKALRGVMGREILTQRWQLX

SEQ ID NO: 3675 - DNA, 852 bp, Felis catus
acaacagggctcaacaaaggagtgatgatggtataagtcactgagagaaggtctttttctattgagttctctgacttgggcttgcggtagatgatggaggtgcagccgtagtggacgatgaccatcgtgaggtgggaggtgcaggtggcaaaggccttcttccggccccgggcggaggggatcttgaggctggtggagacgaggaggacgtaggtgatgaagttcaagctcatggggaccaggatcacagaggaactgacaccataattgttggtctcaatgacagtggtgtcattacgggagagttttagaacagggaggatgtcacagaagaaatgtccgaccacactgacaggagggtaaggtaaacacggatgtcacctggacggccaccacggccaggccaaggccgaaggctccgcacatcaggtgcacatacaccctcatgctcatgatgactgtgtacctcagggttgcagatggccacacggcggtcatagcccgtgaccgtgagcagaaatcagctggctaaggcaacaaagaacagccatctgggcggcacagcctgccgaggagttgggctgattctgggctaggagaccagccggcatccgtggcctggtgaccagtgtgtatgtggcctctgaactccccagcatgttcaggaagaagtacacgggtgttatgggggtgacggctaatgcagacgaccgtcacgatgatggcattgccagctggggttaatgtgtacaggatgagaaagaccacgaacagagtgggctgatgctcctggaatctggagaatcccaggaaaacgaactcagtcacttctgcgacgttctttctctgcat

SEQ ID NO: 3676 - protein, 107 aa, Felis catus
MQRKNVAEVTEFVFLGFSRFQEHQPTLFVVFLILYTLTPAGNAIIVTVVCISRHPHNTRVLLPEHAGEFRGHIHTGHQATDAGWSPSPESAQLLGRLCRPDGCSLLP

SEQ ID NO: 3677 - DNA, 972 bp, Felis catus
atgcagagaaagaacctcacagaagtgacagaattcatcttcctgggattctctgtctttggaaagcaccagataaccctctttgtggttttcctaaccatctacattttaactctagctggtgacatcgtcattgtgaccatcatccgtgttgaccatcatctccgcactcccatgtacttcttcctgagcatgctggcgagttctgaggctgcgtacacactggtcattgtcccacgaatgcttttcagtctcattcttcataaccagcctatctccttggaaggctgtgcaactccgatgttcttttttgtcaccttggctgtaaatagtggcttcttgctcacagcaatgggctatgaccgctatgtggctatctgcagccctctgaggtacactgtcgtcatgagtaaaggaatgtgtgccgggttggtatgtgggtcctttggcactggtctggtaatggcagttctccacgtagcagccatgttccacttgtccttctgtggcacagtggtggaccatttcttctgtgacatttaccctgtcatgaagctttcttgcactgattccactatcaatgagatgatcagttatggtgtcagttcctctgtgatcctggtccccgtgggcttgaacttcatcacctacatcctccttgtctccaccagcctcaagatcccctccacccggggccggaagaaggcctttgccacctgcacctcccacctcacggtggtcatcgtccactacggctgcacctccatcatctaccgcaagcccaagtcagagaactcaatagaaaaagaccttctctcagtgacttataccatcatcactcctttgttgagccctgttgttgaaccctgttgtttacagcctgaggaacagggaggtcagggatgctctacgtagagccgtgggcaaaaacacttcttaacagatcgaatcattttgtcaggagacctttag

SEQ ID NO: 3678 - protein, 304 aa, Felis catus
MQRKNLTEVTEFIFLGFSVFGKHQITLFVVFLTIYILTLAGDIVIVTIIRVDHHLRTPMYFFLSMLASSEAAYTLVIVPRMLFSLILHNQPISLEGCATPMFFFVTLAVNSGFLLTAMGYDRYVAICSPLRYTVVMSKGMCAGLVCGSFGTGLVMAVLHVAAMFHLSFCGTVVDHFFCDIYPVMKLSCTDSTINEMISYGVSSSVILVPVGLNFITYILLVSTSLKIPSTRGRKKAFATCTSHLTVVIVHYGCTSIIYRKPKSENSIEKDLLSVTYTIITPLLSPVVEPCCLQPEEQGGQGCST

SEQ ID NO: 3679 - DNA, 914 bp, Felis catus
ggaaagcttcctgccagcggcccggagcagagcatccttgacctccttgttcctcagggtgtacaccaccgggttcagcaggggggtgatgacggtgtaggtcaccgagatcagctggtcctgatccctggtgttctccgacttgggcttgaggtaggcgacggaggcacagccgtagtggacgacgaccaccgtgaggtgagaggcgcaggtggcaaaggccttcttccggccccgggccgaggggatcttgaggacggtggagacgatgaggacgtaggagatgaagaccaggcccatggggaccacgagcaccagcacgctgatgatcacggtcagggtctcgttgaccgaggtgtcgacgcaggagagcttcattacgggtcggatgtcacagaagaagtgggccaccttcgtagcacagaaaggcaacctgaacacagatgtcacttgcgtcgtcgccacgatcagcccaatgccgcaggcgccccccaccagctggacacaccctctcttgttcatgatgaccgagtatctcagggggttgcagatggccacgtagcggtcgtaccccatcgccgtgagcaggaagcagttagtgatgccaaaggttacgaaaaagaacatctgggtggcacagcctgcccgtgagatggaccggttcgtacctacaagactggagagcatccttgggagaatgacgagtgtatatacggtctctgaggaggacagcatgctcaggaagaagtacatgggcgtgtgcaggtgagggtccgttcggatgatggtcacaatgaccgcgttgccggccagggtcacgacgtacagtgcaaggaacacgacaaacaggccgagctggtgctcgcggaagctggagaaaccctggaagacgaactcagttatgagagtgtggt

SEQ ID NO: 3680 - protein, 304 aa, Felis catus
HTLITEFVFQGFSSFREHQLGLFVVFLALYVVTLAGNAVIVTIIRTDPHLHTPMYFFLSMLSSSETVYTLVILPRMLSSLVGTNRSISRAGCATQMFFFVTFGITNCFLLTAMGYDRYVAICNPLRYSVIMNKRGCVQLVGGACGIGLIVATTQVTSVFRLPFCATKVAHFFCDIRPVMKLSCVDTSVNETLTVIISVLVLVVPMGLVFISYVLIVSTVLKIPSARGRKKAFATCASHLTVVVVHYGCASVAYLKPKSENTRDQDQLISVTYTVITPLLNPVVYTLRNKEVKDALLRAAGRKLS

SEQ ID NO: 3681 - DNA, 906 bp, Felis catus
gagaggatttttgcccaaagctctgagcaaggcatccttgatgtctttgttcctcaggctgtacacaacagggttgaggaggggtgtgatgaccgtgtaggtcacggagatgagtctgtccttcagggagttgtgagatttgggttttaggtagatgacggaggcgcagccgtagtggacgacgaccaccgtgaggtgggaggcgcaggtggcaaaggccttcttccggccccgggcagaggggatcttgaggatggtggagacaatcaggacgtaggagatgaagatcagcaccatgggcagaacaaggacacacagactgatgagcaaggtgacaagttctttgatggtggtgtcagcacaggccagctgcatcaggggccggatgtcacagaagaagtgggagatgacattggcatcacagaagggcaggctgaacacagacgacacctgaatgatggccgtgctcaggccaatgctccaggagccactcgccaattgtagacaagtccttttgcccatgacgacggaataccgcagggggttgcagatggccgcgtagcggtcataccccatggccgtgagcaggaagcagttgttgatgccgaaggcgagatagaagaagagctgagtggcacagtgtgggatggagatggctcgttggggactgaggagactggacagcatgcaggggatgatggccactgtataacaggtctcagagatggacagtacgctcaggaagaagtacatgggtgtgtgaagttgacggttgaggcggataacggtcaagatgatggcattgctggcgagggtcaacaggtacaagaccagaaagaccacaaagagaatgagtctgtgctgccaccccaaaacggaaaaaccttcaaaggtgaactctgtcac

SEQ ID NO: 3682 - protein, 302 aa, Felis catus
VTEFTFEGFSVLGWQHRLILFVVFLVLYLLTLASNAIILTVIRLNRQLHTPMYFFLSVLSISETCYTVAIIPCMLSSLLSPQRAISIPHCATQLFFYLAFGINNCFLLTAMGYDRYAAICNPLRYSVVMGKRTCLQLASGSWSIGLSTAIIQVSSVFSLPFCDANVISHFFCDIRPLMQLACADTTIKELVTLLISLCVLVLPMVLIFISYVLIVSTILKIPSARGRKKAFATCASHLTVVVVHYGCASVIYLKPKSHNSLKDRLISVTYTVITPLLNPVVYSLRNKDIKDALLRALGKNPL

SEQ ID NO: 3683 - DNA, 920 bp, Felis catus
tcaggaaagcttcctgccagcggcccggagcagagcatccttgacctccttgttcctcagggtatacaccaccgggttcagcaggggggtgatgacggtgtaggtcaccgagatcagctggtcctgatccctggtgttctccgacttgggcttgaggtaggcgacggaggcacagccgtagtggacgacgaccaccgtgaggtgagaggcgcaggtggcaaaggccttcttccggccccgggcggaggggatcttgaggacggtggagacgatgaggacgtaggagatgaagaccaggcccatggggaccaggatcaccagcacgctgatgatcacggtcagggtctcgttgaccgaggtgtcgacgcaggagagcttcattacaggtcggatgtcacagaagaagtgggccaccttcgtagcacagaaaggcaacctgaacacagatgtcacttgtgtcgtcgccacgatcagcccaatgccgcaggcgccccccaccaactgcacacacaccctcttgttcatgatgaccgtgtacctcaaggggttgcagatggccacgtagcggtcgtaccccatcgccgtgagcaggaagcagttgttgatggccaaggtgatgaagaagaacatctgggtggcacagccagccaaggagatgggctgactcaggcctacaaggttacagagcattttgggtataatgacgagtgtatatacggtctctgaagtggacagcatgctcaggaagaagtacatgggcgtgtggaggtgacgatccacactaatgatggtcacgatgacgacgttgccggccagggttacgacgtacagtgcaaggaacacaacaaacaggctgagctggtgctcgtggaagctggagaagccctggaaagtgaactcactcacccaagtgtgattct

SEQ ID NO: 3684 - protein, 305 aa, Felis catus
NHTWVSEFTFQGFSSFHEHQLSLFVVFLALYVVTLAGNVVIVTIISVDRHLHTPMYFFLSMLSTSETVYTLVIIPKMLCNLVGLSQPISLAGCATQMFFFITLAINNCFLLTAMGYDRYVAICNPLRYTVIMNKRVCVQLVGGACGIGLIVATTQVTSVFRLPFCATKVAHFFCDIRPVMKLSCVDTSVNETLTVIISVLVILVPMGLVFISYVLIVSTVLKIPSARGRKKAFATCASHLTVVVVHYGCASVAYLKPKSENTRDQDQLISVTYTVITPLLNPVVYTLRNKEVKDALLRAAGRKLS

SEQ ID NO: 3685 - DNA, 933 bp, Felis catus
ttagggaagggatttcctccccaccactctcctcagagcatcctggacttctttgtttctcagactgtacacaacagggttcagcaatggtgttatcacagtgtaggtcactgagattaactggtcctgatccttggtgttctctgacttgggcttgaagtaggcgatagaagcacagccatagtggataatgaccaccgtgaggtgggaggagcaagtggcaaaggctttcttccggccctcagctgaggcaatcttgaggatggtagagatgatgaggaagtaggagatgaggaggaaagtggcaggggctgtgatggccaagaggcttatagttaaggtcaagatatcattaacgattggagtaacacaggctaaatccaacacaggtcgaacatcacagaagaagtgctcaatcagtgagttacagaaaggcagtcggaaaatggccacagcctgaaccagagagagcaagaaccccgaggcacagaccgaggatgccagaatggtacaggccctccaattcatgacaattgggtaacgaagtgggttgcagatggccacgtagcgatcaaaccccatgactgctagcaggaggcagttggtgatggcaaagccaaggaagaaaaagagctgagtcccacagcccaccagggagatggactggctcagacccacgaggccggaaagcatgcgtgggatgatgaccagggaatagcacgtctctgatgtggagagaacacttagaaagaagtacatgggggtgtggaggtggtggtcaacacggataatagtcacgatgatgacattgccggccagagttaagaggtacagggttaggaacacggcaaacagtatgagttgatgttctcggaagttggagaaaccttggaaaacaaaccccctcacctctgtgtgattggctgtcttcat

SEQ ID NO: 3686 - protein, 310 aa, Felis catus
MKTANHTEVRGFVFQGFSNFREHQLILFAVFLTLYLLTLAGNVIIVTIIRVDHHLHTPMYFFLSVLSTSETCYSLVIIPRMLSGLVGLSQSISLVGCGTQLFFFLGFAITNCLLLAVMGFDRYVAICNPLRYPIVMNWRACTILASSVCASGFLLSLVQAVAIFRLPFCNSLIEHFFCDVRPVLDLACVTPIVNDILTLTISLLAITAPATFLLISYFLIISTILKIASAEGRKKAFATCSSHLTVVIIHYGCASIAYFKPKSENTKDQDQLISVTYTVITPLLNPVVYSLRNKEVQDALRRVVGRKSLP

SEQ ID NO: 3687 - DNA, 911 bp, Felis catus
gggtggccgcacaggctggtctttgccgtctttctgagtttgcacctgctgactctgtccagcaatatcatcatcatcgtgactgttgttcgtctgaaccatcacctccatacccccatgtacttcttcctgagcatgctgtccctctctgagacctgctacactgtggccatcatctatgcttcctggcctcctgagtccccaccagcccatttctgtccagtctcctcagtccccaacgagccatctccatcccagactgtgccactcagctcttcttctatctcaccttcggcatcaacaactgcttcctgctcacggccacggggtatgactgctacgtgaccacctgcaaccccctgtggtattcagtcatcatgagtaaagaggcctgtgtccagttagcaagtggctccctgggaactggcctgggcgtggccactgtccaggtaacatctgtgtttggcctgcccttctgtgatgcccttgtcatatttcacttcttctgtgacgtcaggcccctgctgaagctggcctgcgtggacacccctgtcaacgagatcatcaactttgtcgtcagcgtctgtgtcctgattctgcccacgggcctggtcttcttctcctgtgtcctcatcgtctccgccagcctcaagatcccccccgcccggggctggaagaaggcctttgccacctgcacctcccgcctcagagtggtcatcgtccactatggctgtgcctctgtcgcctacctcaagcccaagtcccggagttccctggggcaggacagactcatctctgtgacctacaccgtcctcactcccctgctgagccctgtcgtgtacagcctgaggaacaaggaagtcaaggatgccctgcgcagaggcgtggggcagaagcccctttcctcttaa

SEQ ID NO: 3688 - protein, 177 aa, Felis catus
MSKEACVQLASGSLGTGLGVATVQVTSVFGLPFCDALVIFHFFCDVRPLLKLACVDTPVNEIINFVVSVCVLILPTGLVFFSCVLIVSASLKIPPARGWKKAFATCTSRLRVVIVHYGCASVAYLKPKSRSSLGQDRLISVTYTVLTPLLSPVVYSLRNKEVKDALRRGVGQKPLSS

SEQ ID NO: 3689 - DNA, 933 bp, Felis catus
atgaagagagagaaccatactgcggtgggtgaatttgttctccagggtttttccagctttcgtgaacacaagatcatcctctttgtgatatttcttaccttgtaccttttaactctggctggcaatgtcatcattgtgacagtcatcagctttgctcgtcacctgcacacccccatgtacttcttccttggtgttctttccacttctgagactgtctacacactggtcattgtaccgcggatgctttgcagcctcacaggcctgagtcagcccatctccttggctggctgtgccacccagatgttcttcttcatcaccttggccatcaacaactgcttcctgctcacggcgatggggtacgaccgctacgtggccatctgcaaccccttgaggtacacggtcatcatgaacaagagggcgtgtgccctgctcgtatcaggggcttgcagcattgggctgtttgtggccatcattcagatttcctctgtattcagactgcccttttgtgacagagaggtggcccactatttctgtgacatccgcccagttatgaaactctcctgtgctgataccactctacatgacataattaattttatcatcagctcactcgttattgtggttcccatgggcctggtcttcatctcctacatcctcatcgtctccaccatcctcaagatcccctccgcccggggccggaagaaggcctttgccacctgcgcctctcacctcacggtggtcgtcttccactacggctgtgcctccgtcgcctacctcaagcccaagtcggagaacaccagggatcaggaccagctgatctcggtgacctacaccgtcatcacccccctgctgaacccggttgtgtacaccctgaggaacaaggaggtcaaggatgctcttcaccgtgctattcgcaaaaaccctcttgcttag

SEQ ID NO: 3690 - protein, 310 aa, Felis catus
MKRENHTAVGEFVLQGFSSFREHKIILFVIFLTLYLLTLAGNVIIVTVISFARHLHTPMYFFLGVLSTSETVYTLVIVPRMLCSLTGLSQPISLAGCATQMFFFITLAINNCFLLTAMGYDRYVAICNPLRYTVIMNKRACALLVSGACSIGLFVAIIQISSVFRLPFCDREVAHYFCDIRPVMKLSCADTTLHDIINFIISSLVIVVPMGLVFISYILIVSTILKIPSARGRKKAFATCASHLTVVVFHYGCASVAYLKPKSENTRDQDQLISVTYTVITPLLNPVVYTLRNKEVKDALHRAIRKNPLA

SEQ ID NO: 3691 - DNA, 945 bp, Felis catus
atggatccgctcaaccacacgtggacccagagtttcatcctctctggtttcagtgtccccggaaccctgcgacctcttgccttcttggggaccctgtgcctctatctcctcacactgtctgggaacctcttcatcgttgtcctggtccaggtggatgctggactgtccacgcccatgtacttcttcatcggcgtcctctccttcctggagctcgggtacgtcagcgccacggtgcccacgctgctgcacacgtggctccgtgggcgctcagccatctcggcagcggtgtgcttcatccagctgtacgtcttccactctctgggcatgaccgagtgccatctgctgggcgtcatggcgctggaccgctacctggccatctgccgcccgctccactaccgggcactcatgaccagaaaggtccagttctggctggcaggggccgcttgggtggctggcttctcagcggcactggtgccagccagcctcacggccaccctgcccttctgtctgaaagaggtggcccactacttctgtgacctggcacctttgatgcggttggcgtgcgtggacgcaggctggcacgctcgagtgcacggggcggtgattggtgcggccactggctgcaacttcgtgctcatttggggactctacgggggcatcttgagggccgtgctgaagctgccctcggctgccagccgggtcaaggccttctccacctgctcctcccacatgatcgtggtggccctcttttatgcctccgccttcacggtctatgtggggccacctgggaaccgctctgagggcacagacaagtgtatcgccttggtgtatgcccttctcactcctctcctcaaccccatcgtctatacccttcgcaacaaggaagtgagggaggccgtgaagagggtcactgtcagggtcaggactattctgaagggaccctga

SEQ ID NO: 3692 - protein, 314 aa, Felis catus
MDPLNHTWTQSFILSGFSVPGTLRPLAFLGTLCLYLLTLSGNLFIVVLVQVDAGLSTPMYFFIGVLSFLELGYVSATVPTLLHTWLRGRSAISAAVCFIQLYVFHSLGMTECHLLGVMALDRYLAICRPLHYRALMTRKVQFWLAGAAWVAGFSAALVPASLTATLPFCLKEVAHYFCDLAPLMRLACVDAGWHARVHGAVIGAATGCNFVLIWGLYGGILRAVLKLPSAASRVKAFSTCSSHMIVVALFYASAFTVYVGPPGNRSEGTDKCIALVYALLTPLLNPIVYTLRNKEVREAVKRVTVRVRTILKGP

SEQ ID NO: 3693 - DNA, 922 bp, Felis catus
atggaacggagaaaccattcgagcctggccgagttcgtgttccttggtttccccaaagtgggacatgtcaggggctggctttttgccctgttgctgttggcatatctgttcactttctgcggcaacttgctcaccttcttggccatacgactgaacgcggccctgcacacacccatgtaccactttgtcagtatactctccttattggaactgtggtatacagccaccaccatccccagcatgctagccaatcttctccgtgagaagaagaccatttcttttgccggatgcctccttcagacctacttcttccactctctaggggcctcggaatgctaccttcttacagccatggcctatgaccgatacctggccatctgccggcccctccactaccctgcagtcatgaccccgacactctgtggcaagttggctgctggttgttggacttgtggcttcctgtgtcccatttctgaagtatcctggtctcccagctccccttttgtggctataatgaaattcaacacatcttctgtgactttccacctctgctgagcctggcctgcaaggacacatccacgaatgtccttgtggactttgctatcaacgcctttatcatccttatcaccttcctctttattatggtttcttatggaagaatcatcagtgctgtactgaagataaaaacagccgaaggaagaaagaaggccttctctacctgtgcctcacatctcactgtggttctcatcttttttgggagtatcattttcatgtacgtgcgcctaaagaagagctattccctgacccttgaccgcacacttgctgtagtctactctgtactaacaccactcgtcaacccaattatctacagtcttcgtaacaaggaactcattaaggccatcaagaggaccatctgccagaa

SEQ ID NO: 3694 - protein, 184 aa, Felis catus
MERRNHSSLAEFVFLGFPKVGHVRGWLFALLLLAYLFTFCGNLLTFLAIRLNAALHTPMYHFVSILSLLELWYTATTIPSMLANLLREKKTISFAGCLLQTYFFHSLGASECYLLTAMAYDRYLAICRPLHYPAVMTPTLCGKLAAGCWTCGFLCPISEVSWSPSSPFVAIMKFNTSSVTFHLC

SEQ ID NO: 3695 - DNA, 946 bp, Felis catus
atgaatggtgagccatggatgctgggaattggagccaggtaacagagttcatcatcttgggctttccccatctccagggtatccaggcttacctcttcgtcttgttacttctaatttatgtcaccaccgtactgggaaacctgctggtattcctagtggtccgcctggactcccagctccacacacccatgtaccactttgtcagcatcctctccctgctggagcttggctacacggctgccaccgtccccaagatgctgtcgaacctgctcagggaggagaagaccatttctttctccggatgcctcctgcaaatctacttctttcactctcttggggccactgagtgctatctcctcacagctatggcttatgacaggtatttagccatctgccggcccctccactactccaccctcatgaccccagcacgctgcgccaagatcgccgttggctgttggttgggaggtctggctgggccggtggctgagatttccctggtgtcccgtctccctttctgtggccccaatcgcattcagcacatcttttgtgatttcccacccgtgctgagcttggcttgtactgacacatctatcaacgtcctagtggactttgctatcaactcctgcaagatcctggccaccttcctgttgatcctcagctcctatgtccagatcgtccgcacggtgctcaggattccttcggttgcaggcaagaccaaagccttctccacctgtgcctcccacctgactgtggttctcatcttctacgggagcatcctctttatgtatgtgcggctgaagagtagctactcactggactatgaccgcgccctggctgtgatctactcggtgctcacacctttcctcaaccccttcgtctatagcttgcgcaacaaggatattaaggaggccgtgaggaggcagttgaagaggtcagggatact

SEQ ID NO: 3696 - protein, 311 aa, Felis catus
MDAGNWSQVTEFIILGFPHLQGIQAYLFVLLLLIYVTTVLGNLLVFLVVRLDSQLHTPMYHFVSILSLLELGYTAATVPKMLSNLLREEKTISFSGCLLQIYFFHSLGATECYLLTAMAYDRYLAICRPLHYSTLMTPARCAKIAVGCWLGGLAGPVAEISLVSRLPFCGPNRIQHIFCDFPPVLSLACTDTSINVLVDFAINSCKILATFLLILSSYVQIVRTVLRIPSVAGKTKAFSTCASHLTVVLIFYGSILFMYVRLKSSYSLDYDRALAVIYSVLTPFLNPFVYSLRNKDIKEAVRRQLKRSGIL

SEQ ID NO: 3697 - DNA, 942 bp, Felis catus
cccgaccccactagccctcctccgacggcagaaaagccttccaagagcatctttcatgtccttgtttctgaggctgtagataatggggttcaggaagggggcaaggatgacaaaagtgatagcaattgctgtgtcccaaaatacggagtaggtggctgagaatcgcaggtacatgacggcgacactgccgaaaaacagcaagaacacagccaggtgggcggcgcaggtagaaaaggccttgcggcggccctcggccgagggcatccccagaatcaccacgatgatccggatgtaggatagggcgatggccaggaaggaggccacaatctcccctgcatggatggcgtccacaatgaccgccagggacgtgtccgtgcaggccaagctcagcacgggcgtaaagtcgcagaatatctgccggatctggttggagccacagaaaggcagggtggcaatccacacgatctcgggaagcacgaggaggaagccacagacgcaggacccagcggccagctgggtgcacagcctgggagtcatgatggtcgcgtaccggagaggcctgcagatggcgacgtacctgtcaatggccatggccgtcaggacgcagccttctgtgatgcccagggagtggaagaaatacatctgtaggaggcagccagccacagagatggtcttgtgctcactgatcaggctggagagcatcttggggatggtggtcgtggtgtaccagatctccaggaaagagaggacgctgatgaagaaatacatgggggtgtgcagggccctgtccagccggacgacgatgaatatcattaggttcccagttacgataaatccgtaggtgagaagcagaagaacgaagaagaggacgccaccttcaggcagatgtgggaacacagagaagaggaactcagtcaccgtagtcaaattcccactggtcac

SEQ ID NO: 3698 - protein, 314 aa, Felis catus
VTSGNLTTVTEFLFSVFPHLPEGGVLFFVLLLLTYGFIVTGNLMIFIVVRLDRALHTPMYFFISVLSFLEIWYTTTTIPKMLSSLISEHKTISVAGCLLQMYFFHSLGITEGCVLTAMAIDRYVAICRPLRYATIMTPRLCTQLAAGSCVCGFLLVLPEIVWIATLPFCGSNQIRQIFCDFTPVLSLACTDTSLAVIVDAIHAGEIVASFLAIALSYIRIIVVILGMPSAEGRRKAFSTCAAHLAVFLLFFGSVAVMYLRFSATYSVFWDTAIAITFVILAPFLNPIIYSLRNKDMKDALGRLFCRRRRASGVG

SEQ ID NO: 3699 - DNA, 918 bp, Felis catus
cagtgacggagtttctcttctctggattcccccagtttgaagacggcagcctcctcttcttcattcctttgttcatcatctacatcttcattgtgattggaaatctcattgtattttttgcagtcaggatggacacccgtctccacaaccccatgtacaatttcatcagcatcttctcctttctggagatctggtacacaacagccaccatccccaagatgctctccaacctcatctgcgagaagaagaccatctccattactggctgcctcctgcagatgtacttcttccattcactgggaaattccgaggggattttgttgaccaccatggccattgacaggtacattgccatctgcaaccctctccgctacccgaccattatgaccccccagctgtgtgctcagctctctgcaggctcctgcctctttggctttcttgtgttgctcccagagattgtttggatttccaccctgcctttctgcgggcccaaccaaatccatcagatattttgtgactttgaacctgtactgcgcttggcttgtacagacacgtccatgatcctgcttgaggatgtgatccatgctgcggccatcatcttctctgtcctggttatcgctgtctcttatgtcagaatcatcactgtgaccctgaggatcccgtctgccgaaggccgccggaaggccttctcgacctgtgcgtctcatcttggtgtctttctgatgttctatggcagcgtgtccctcatgtacctgcgcttctctgccactttcccaccaactttggacacagtcattgcactgatgtttgccgttctcgctccctttttcaaccctatcatctatagtttgagaaacaaggacatgaagattgcgattaagaagcttctctgccttcagaaggtgtttaatgcacctg

SEQ ID NO: 3700 - protein, 306 aa, Felis catus
  MOD_RES (306)..(306): Any amino acid
VTEFLFSGFPQFEDGSLLFFIPLFIIYIFIVIGNLIVFFAVRMDTRLHNPMYNFISIFSFLEIWYTTATIPKMLSNLICEKKTISITGCLLQMYFFHSLGNSEGILLTTMAIDRYIAICNPLRYPTIMTPQLCAQLSAGSCLFGFLVLLPEIVWISTLPFCGPNQIHQIFCDFEPVLRLACTDTSMILLEDVIHAAAIIFSVLVIAVSYVRIITVTLRIPSAEGRRKAFSTCASHLGVFLMFYGSVSLMYLRFSATFPPTLDTVIALMFAVLAPFFNPIIYSLRNKDMKIAIKKLLCLQKVFNAPX

SEQ ID NO: 3701 - DNA, 904 bp, Felis catus
ggaggggaaacctgtcagccgtgactgaattcatcgtcactggcttcctgcagctccaagatggtggcctcctgtacttcttccccctacttttcgtctacacttttattgtcatcaggaacctgatggtcttctttgctgcccggctggacacccatcctcacaaccccatgtacaatttcatcagcatcttcgccttcctggggatccggtacatgacagccaccatccccaagatgctctccaacctcatctgtgagaagaagaccacctccattactggctgcctcctgcagatgtacttcttccattcactgggaaatcccgaggggatgctgttgaccaccatggccatcgacatgtccgtggccatctgcgaccctctccgctaccagaccatcctgaccccctggctgtgtgctcggctctctgcaggctcctgcatcttgggtctcctcatcctgcttcctgagattgtgatgatttccacaccgcttctctgtgggcccgaccaaatctgtcaaatcttctgtgacttggtcctcacgctgagcctggcctgtacagacacgtccacgattctggttggagatgtgatccatgctgtggccatcatcgttaccgtcctaatcattgccctgttctctatcaggatggtcactgtggtcctgaggatcccctctgctgagggcgggcgaaaggccttttctacctgtgcaggccatctcgctgtgtccctgattttcttaggccacgtgtccctcatgtactcacgattcaatgccacctacctcccagtcctggacaccacaactgcactgatgtttattatctttgcccccttcttcaatcccatcatctatagtctgagaaacaaggacatgaagaacacgattagaacact

SEQ ID NO: 3702 - protein, 301 aa, Felis catus
RGNLSAVTEFIVTGFLQLQDGGLLYFFPLLFVYTFIVIRNLMVFFAARLDTHPHNPMYNFISIFAFLGIRYMTATIPKMLSNLICEKKTTSITGCLLQMYFFHSLGNPEGMLLTTMAIDMSVAICDPLRYQTILTPWLCARLSAGSCILGLLILLPEIVMISTPLLCGPDQICQIFCDLVLTLSLACTDTSTILVGDVIHAVAIIVTVLIIALFSIRMVTVVLRIPSAEGGRKAFSTCAGHLAVSLIFLGHVSLMYSRFNATYLPVLDTTTALMFIIFAPFFNPIIYSLRNKDMKNTIRTL

SEQ ID NO: 3703 - DNA, 946 bp, Felis catus
atggagagtgaaaatctatcagctgtgactgaattcatcttcactggcttcccgcagctccaagatggcggcctcctgtacttcttccccctccttttcgtctacacctttattgtcgttgggaacctgatggtcttctttgctgtccggctggacacccgtctccacaaccccatgtacaatttcatcagtatcttctcatttctggagatctggtacaccacggccaccatccccaagatgctctccaatctgatcagcagccaaaagaccatctccttgactggctgcctcttgcaaatgtacttcttccattcactcggaaacactgaaggagccttgctgaccatcatggccatcgacagatacgttgccatctgcaaccctcttcactacctgaccatcatgaccccccgactatgcgctcagctttctgcaggctcttgtgtctttggtttcctcatccttctacctgaggttgtatggatttctaccctacctttctgtggccccaaccaaatccatcagatcttctgtgatttcggtccattattaaatttagcctgtacggatgcctctgtgatcctagtgcaagacgtgattcatgcttcggccattctgataacgagtctgattatttccctttcgtacatcagaattgtggttgttatcctgggcatcccttcagcggagggtcgtaaaaaggccttctccacctgcgtcgcccacattgccgtcttcctgatgttttttggcagtgtggccctcatgtatctcagattctctgccacgtatacgccgttctgggacacagccattgctgtaaccttctctgtcctttctccccttttcaatcccatgatatacagcctgagaaataatgatatgaaagatgctattaagaagctcctttgccctcaaaaggtgtttcgtgtacgtggtaggt

SEQ ID NO: 3704 - protein, 316 aa, Felis catus
  MOD_RES (316)..(316): Any amino acid
MESENLSAVTEFIFTGFPQLQDGGLLYFFPLLFVYTFIVVGNLMVFFAVRLDTRLHNPMYNFISIFSFLEIWYTTATIPKMLSNLISSQKTISLTGCLLQMYFFHSLGNTEGALLTIMAIDRYVAICNPLHYLTIMTPRLCAQLSAGSCVFGFLILLPEVVWISTLPFCGPNQIHQIFCDFGPLLNLACTDASVILVQDVIHASAILITSLIISLSYIRIVVVILGIPSAEGRKKAFSTCVAHIAVFLMFFGSVALMYLRFSATYTPFWDTAIAVTFSVLSPLFNPMIYSLRNNDMKDAIKKLLCPQKVFRVRGRX

SEQ ID NO: 3705 - DNA, 963 bp, Felis catus
atggagagccccaatcaaagtgccgctcaggagttcatcttctctgctttcccttattcctggggaagttctgtcacctgttttattccactgctcttcatttacaccttcattgtcattggaaaccttgtcatcatcgcagtggtccagctgaatgctcccctccacacacccatgtacttcttcatcggcaccctttcctttctggagatctggtacaccacagcgaccattccaaagatgcttgccagcctgctcggtgagaagacaatttccttaaatggttgcctcctgcagatgtatttcttccattccactggcatcagtgaggtttgtctcttgacagctatggcctttgaccgctacctggccatctgcagccctcttcattatcccactatcatgacccccaggctgtgtgcccaattgactttaggttgctgtgtttgtggctttatcacacccctccctgagattgcctggatctcgacactgccattttgtggctctaatcgcctggagcatatcttctgtgacttcctccccgtgctacggctggcctgcacagacacacaagccatcgtcatgattcgggtggtggatactgtccacgcagtggagattatcacagccgtaatgctcattttcatgtcctatgttggcattgtggctgtaattgtacgtattcggtcagctgaaggccgccgcaaggccttttccacgtgcgtctcccacatcactgtctttttgcttttctttggcagtgtggccctcatgtacctacgcttctcggccacctactccttattctgggacacagccattgctctggcctttgcagtcttgtcccccttcttcaaccccataatctacagtctgaggaacaaagagatgaaggaagctataaaaaaacacttgggtcaagctaaaatcttttttcataagaccgaggacctcaagtaa

SEQ ID NO: 3706 - protein, 320 aa, Felis catus
MESPNQSAAQEFIFSAFPYSWGSSVTCFIPLLFIYTFIVIGNLVIIAVVQLNAPLHTPMYFFIGTLSFLEIWYTTATIPKMLASLLGEKTISLNGCLLQMYFFHSTGISEVCLLTAMAFDRYLAICSPLHYPTIMTPRLCAQLTLGCCVCGFITPLPEIAWISTLPFCGSNRLEHIFCDFLPVLRLACTDTQAIVMIRVVDTVHAVEIITAVMLIFMSYVGIVAVIVRIRSAEGRRKAFSTCVSHITVFLLFFGSVALMYLRFSATYSLFWDTAIALAFAVLSPFFNPIIYSLRNKEMKEAIKKHLGQAKIFFHKTEDLK

SEQ ID NO: 3707 - DNA, 942 bp, Felis catus
tcatcctgcacccaacaacctcccttggaaggcacttctcagggctgtttgcacagcccgattccttaaactataaacaatagggttgaggagaggggtcaccacagtataggtgaccgcaatcagctgatcccgctcaagagagtaactggctttgggcctcaagtacatgaaggaggcacagccatagtggatgatgaccactgtgagatgtgaggcacaggtggagaaggccttcttccgcccctcagtggaggggatcctcaggatagctgccagaatgtaggcgtaggagatggtgatgaaggagaaagagaccaggaggaccagcaggctaaggatgaggatgcccagctcactcgggcctgtgtccccacaagccaggctcagcactggcggcgtgtcacagaaaaagtgctggatctcgtgggagccgcagaatgggaggtggaaaatgaccagtgtcattcccagcccaaagaggtacccactcaggaaggaggtgccaaccagccgggcgcagaaaggaggatccatgcggctggcatagtgcaacggggcacagatggccacatacctgtcaaagcccatgacggccaggaggaagcagttggtacaggcccacgaggcagagaagaacatctgagcagcacagccctcataggagatggcctggccccccatgaccaggctggagagcatcttagggatgatgcccaaggtgtagcaggtctcagagaaagacaggaaggaaaggaggaggtacatgggggtgtgcagatggctgtccagcctgatgaccacaataatgaagacattgctggtcagggttaccagatacagagagaagaagagtgcaaagagcaggagctgaagctccccgaagccggagaagcccaggaagacaaagcccctccaggcggttgcattggtctgccccat

SEQ ID NO: 3708 - protein, 313 aa, Felis catus
MGQTNATAWRGFVFLGFSGFGELQLLLFALFFSLYLVTLTSNVFIIVVIRLDSHLHTPMYLLLSFLSFSETCYTLGIIPKMLSSLVMGGQAISYEGCAAQMFFSASWACTNCFLLAVMGFDRYVAICAPLHYASRMDPPFCARLVGTSFLSGYLFGLGMTLVIFHLPFCGSHEIQHFFCDTPPVLSLACGDTGPSELGILILSLLVLLVSFSFITISYAYILAAILRIPSTEGRKKAFSTCASHLTVVIIHYGCASFMYLRPKASYSLERDQLIAVTYTVVTPLLNPIVYSLRNRAVQTALRSAFQGRLLGAG

SEQ ID NO: 3709 - DNA, 935 bp, Felis catus
acaatgaaggccaaccagacagtgctgaaagatttcattcttgtgggcttctcctcgtacccacacatgcggacattcctcttcgtgctcttttttggcctctaccttctcaccctcacaggtaacctggccatcctgggtctaacttgggcggacagatctctccacacccctatgtacctcttcctccgtgccctctctttctccgagacctgctacacgctgaccatcatccccaagatgctggcagacctgctcactgagaagagaagcatttcagtcccggggtgtggcttgcagatgtgtttcttcctgggacttggtggcaccaactgcatcatcctcacactgatggggtacgatcgctttctggccatctgccaccctctccgatacccactgctgatgaccaatgtggtgtgtgggcagctggtggtctctgcttgggccggaggcttccttatctctgtgacagagactgcactgatattcgggggctccttctgcacccccaacctcatccaccatttcttctgccacatgcgggccgtggtgaggctgtcctgtctagacagcgacctcaccgaactccttgtaacaatgatctcggtgtcaggcttgacgggcaccttcctgtttatcgtcattacttatgttttcattctgtccactgtcttcaggatcccttcagccgagggcaagcagaaggccttttctacctgcgcctctcatctcactgtggtcatcgtccactttggcttcgcggctattgtctatctgaagccagaaggctcgggaggagatgacacactcatcgctgtcccttacaccgtcatcacccctttcctcagccccctcattttcagcctcaggaatagagacatgaagaatgcgttcagaaagctgctggcaaagaggagtttctgaatacataa

SEQ ID NO: 3710 - protein, 307 aa, Felis catus
MKANQTVLKDFILVGFSSYPHMRTFLFVLFFGLYLLTLTGNLAILGLTWADRSLHTPMYLFLRALSFSETCYTLTIIPKMLADLLTEKRSISVPGCGLQMCFFLGLGGTNCIILTLMGYDRFLAICHPLRYPLLMTNVVCGQLVVSAWAGGFLISVTETALIFGGSFCTPNLIHHFFCHMRAVVRLSCLDSDLTELLVTMISVSGLTGTFLFIVITYVFILSTVFRIPSAEGKQKAFSTCASHLTVVIVHFGFAAIVYLKPEGSGGDDTLIAVPYTVITPFLSPLIFSLRNRDMKNAFRKLLAKRSF

SEQ ID NO: 3711 - DNA, 955 bp, Felis catus
gatgggaaattggagcagaggccacatagcagagttcgtgttggtgggcttccctacctctccgcccctccagtgcctcctctttgtcctcttcctggcaatttacctgttgacattgttggagaacgcactcatcgtttccacagtctggctcacgccaagccttcaccgcccgatgtactttttccttggccatctctccttcctggagctgtggtacatcaatgtcacagttccccggcttttgggagcatttcttacccaggagcgtagagtctcctacgtaggctgcatgactcagctctacttctttattgccctagcctgcaccgaatgtgtcctgctggcggtcatggcctatgaccgctacctggccatctgtgagcccctccgttatcctagtctcatgccatccagcctggccattcgcctcgctgcttcctcttggggtagtggcttcttgagctccatgatgaagcttcttttcatttcccggctgtcctactgtggacccaacgtcatcaaccactttttctgcgatatctccccactactcaacctcacctgctctgacaaagagcaagcagaactagtagacttcctcttggccctggtgatgattctgctccctctgttggccgtggtttcatcatatgctgccataatggctgccatcctcaggattcctactgcccagggacgtcgcaaagccttctccacctgtgcctctcacctggcagtggttgttatctactactcctccaccctcttcacctatgcacggccccaggccatgtacaccttcaaccataacaaggtcatctctgtgctctatacagtcattgtaccgttcctcaatccagccatctactgcctgaggaacaaggaggtgaaggatgctctcaggaagtcagtcctgggcagatgccactatccgagggacgtcccagattga

SEQ ID NO: 3712 - protein, 317 aa, Felis catus; identical to SEQ ID NO: 52

SEQ ID NO: 3713 - DNA, 701 bp, Felis catus
atgatccccaaagttctggaagcaggtaaccacacggcaaccatacacttcgttcttctgggatttccaacacggccagccttccagcttctcctcttcttcgtgttcctggcaacctacctgctgactctgctggagaacgctctcatcatcctggcccttcgcggtgacagacaactgcacaagcccatgtacgtctttctgagccacctctccttcctggagatgtggtatgtcaccgtcatcagccccaagatgctggtggacttcctcagccatgacaagaccatttccttcaatggctgcatgactcaactgtacttctttgtgacctttgtctgcgcagagtacctcctcctcgctgcgatggcctttgaccgccacgtggccatttgtaatccactacgctacccagttatcgtgaccaaccagctctgtggtaccctggcggcgggatgctggctctgtgggctcacaactgccacgattaagatggttttcatagcccgactccactactgtggcaaacctcacatcaaccattatttctgcgatatttctccgctcctcagcatcccctgcgaagactcctcgcaggcggagcgagtggacttctttctggccctcgtggttattgccgtccccctttgtgcggtggtggcgtcttatgccaccattgtcagtgccatccttaggatccc

SEQ ID NO: 3714 - protein, 234 aa, Felis catus
MIPKVLEAGNHTATIHFVLLGFPTRPAFQLLLFFVFLATYLLTLLENALIILALRGDRQLHKPMYVFLSHLSFLEMWYVTVISPKMLVDFLSHDKTISFNGCMTQLYFFVTFVCAEYLLLAAMAFDRHVAICNPLRYPVIVTNQLCGTLAAGCWLCGLTTATIKMVFIARLHYCGKPHINHYFCDISPLLSIPCEDSSQAERVDFFLALVVIAVPLCAVVASYATIVSAILRIP

SEQ ID NO: 3715 - DNA, 733 bp, Felis catus
ttcgttcttctgggatttccaacacggccagccttccagcttctcctcttcttcgtgttcctggcaacctacctgctgactctgctggagaacgctctcatcatcctggcccttcgcggtgacagacaactgcacaagcccatgtacgtctttctgagccacctctccttcctggagatgtggtatgtcaccgtcatcagccccaagatgctggtggacttcctcagccatgacaagaccatttccttcaatggctgcatgactcaactgtacttctttgtgacctttgtctgcgcagagtacctcctcctcgctgcgatggcctttgaccgccacgtggccatttgtaatccactacgctacccagttatcgtgaccaaccagctctgtggtaccctggcggcgggatgctggctctgtgggctcacaactgccacgattaagatggttttcatagcccgactccactactgtggcaaacctcacatcaaccattatttctgcgatatttctccgctcctcagcatcccctgcgaagactcctcgcaggcggagcgagtggacttctttctggccctcgtggttattgccgtccccctttgtgcggtggtggcgtcttatgccaccattgtcagtgccatccttaggatcccttcttcacaaggccgccaaaaggcgttttccacctgtgcctctcacctgactgttgtaattctcttctattccacaaccc

SEQ ID NO: 3716 - protein, 245 aa, Felis catus
  MOD_RES (245)..(245): Any amino acid
FVLLGFPTRPAFQLLLFFVFLATYLLTLLENALIILALRGDRQLHKPMYVFLSHLSFLEMWYVTVISPKMLVDFLSHDKTISFNGCMTQLYFFVTFVCAEYLLLAAMAFDRHVAICNPLRYPVIVTNQLCGTLAAGCWLCGLTTATIKMVFIARLHYCGKPHINHYFCDISPLLSIPCEDSSQAERVDFFLALVVIAVPLCAVVASYATIVSAILRIPSSQGRQKAFSTCASHLTVVILFYSTTX

SEQ ID NO: 3717 - DNA, 924 bp, Felis catus
agctttaggataaaattctcttctgccaatcactttccaaatggccatcttgatagccttgtttctgaggctctacaccacggggttcaacagcggagtcacaactgtgtaggtcactgtcacaagcctgtcttcgctggatgagaacttggctgagggctgcaggtagacagaggaggcacggccatggtggacgatgaccacagtgaggtgggaggcacaggtggggagggcttcccgcttgctgtcagtggatgggatcttcaagatggtgtggacaatgaagccatacgagatgcagaaaaaagtcagggagatcatgagtgttgggaccccaccaatgaagatgatcagctcatggatgtaggtttcagtacatgcaagttggataactgacaagatgtcgcagaaccagtggttgatcttattggggccacataaagggagttcaaagactaagagggagcctatcagtgagaacaaaagccaatcacagcacaagtggccaccagctgtctgcatatctgccagctcatgaggatagggtaccgaagtggatgacagatggcagcatagtggtcataacccatgacccccagcagcatgcaattagtgacagcaaaaccaaagaaggaaagcatccgagtggcaccgtcgacaaatgaggttgttctgagcagggacaacagatttatgagcatcttgggcaggatgaccagagtgtagcatgtctcagagatgggaaggatccccaggaagaagcacataggtacgtggaggctgcgagccaggcatacgaccgtgacaatggtgatgttcccactgagaacgatcagatacaggcacagaaatacagcaaagaggatgagctttggatttctccgaggttggagaagcccagcagcaacctctgtgacagaggag

SEQ ID NO: 3718 - protein, 150 aa, Felis catus
SSVTEVAAGLLQPRRNPKLILFAVFLCLYLIVLSGNITIVTVVCLARSLHVPMCFFLGILPISETCYTLVILPKMLINLLSLLRTTSFVDGATRMLSFFGFAVTNCMLLGVMGYDHYAAICHPLRYPILMSWQICRQLVATCAVIGFCSH

SEQ ID NO: 3719 - DNA, 942 bp, Felis catus
tataaagtcttaagagaaaaccccgtctttgtgatcatttcccgaatggccagctgcacacctctgttcctaaggctgtacaccatagggttcaactgtggggtgacgatggtgtaggtcgctgtcactggtctgtctttgcctgatgagtatttggctgagggccgcaggtagacagaggaggcacagccatggtggacgatgaccacagtgaggtgggaggcacaggtggggagggctttccgcttgccgtcagccgacgggatcttcaggatggtgtggacaacgaagccgtaagaggtgcggaagaagagcaagggtacaactagcaccaaggcgccacagatgaagaagaccagctcattggtgtacgtttcagcacaggcaagtcggatgactggtgagatgtcgcaaaagtagtagttgaccttgttggagccacagagagggaggctgaagaccaaagttgttcccaccagagatactaggaagccactaacaatacagattcctgcccgctgggcacataccctccagttcacaagaaccgggtagcgcaaaggctggcagatggcggcatagcggtcataacccgtaactcccagaagcaggcagttggtgacagcaaagccaaggaagaagaacatctgggtggtacagcccacgaaggagagtgtcctgaggacagagagcaggttgataagcatcctgggcagggtaacaatggtgtagaagacctccgaggttgaaaggacacagaggaaaaaaggacatgggggtgtggaggctgcggtccagccggatgacggacaagagggtgcggttcccactcgggatgatcaaattagaggccgagaaagaggacaaacaggacaggctgaaattcgccaagtctggagaaacccagcagcaggaattcagtgacccgggaggaattggcca

SEQ ID NO: 3720 - protein, 236 aa, Felis catus
  MOD_RES (236)..(236): Any amino acid
MLINLLSVLRTLSFVGCTTQMFFFLGFAVTNCLLLGVTGYDRYAAICQPLRYPVLVNWRVCAQRAGICIVSGFLVSLVGTTLVFSLPLCGSNKVNYYFCDISPVIRLACAETYTNELVFFICGALVLVVPLLFFRTSYGFVVHTILKIPSADGKRKALPTCASHLTVVIVHHGCASSVYLRPSAKYSSGKDRPVTATYTIVTPQLNPMVYSLRNRGVQLAIREMITKTGFSLKTLX

SEQ ID NO: 3721 - DNA, 933 bp, Felis catus
aggatatgaagtatggcccattacccttcgaagggctgacttgaactcctgatttctcagactgtaaatcattggattgaacagcggagtcaggatggtgtaggacacagatatgagggtgtcttgacttgaggagtagctggacttgggccttaagtagatgaaagaggcacaaccataatgaacagttaccacgatgagatgagaggcacaggtggagaaagccttgtacctgccggtggaggatgggatcttcagaatggcggaaatgatacgaatgtaggagatcaggataagtagcaggggaatgaccaagacaaacacaccaatcatgaatatgaccaactggctgaggcgtgagtggtgcgatgccaccgcgaggacaggggcgatgtcacaaaagtagtgacggagctggttggaggcgcggaagggcaggtggaataccatggacgtgataatctgtgcaatagtaaagccacaggcacaggcagcagccacgagtcccacacacaccccgtgtcccatgagctccgtgtagcgcagagggttacagatggccacgtagcggtcataccccatggccgccagcaggaaggagtgagagcagccgaggaagaggaaggtgaacatctggatggcacagcccaggaaggagatggtcttcttctgggccaggaggtcaaccagcatcttgggtacgatgacgaaggtgtagcaggtctcagagcaggagaggacggcgaggaagaagtacatgggggcatgaagggctctgtctagcacgatggtggaaacgatgatggcattggtgcccagagtgaacaggtagaggggcaggaaggcaacaaagagtagccgctgcagcccggccagagaagagaagccgaggaagacgaactctgtcaccagggtcccgttgccccgctccat

SEQ ID NO: 3722 - protein, 311 aa, Felis catus
MERGNGTLVTEFVFLGFSSLAGLQRLLFVAFLPLYLFTLGTNAIIVSTIVLDRALHAPMYFFLAVLSCSETCYTFVIVPKMLVDLLAQKKTISFLGCAIQMFTFLFLGCSHSFLLAAMGYDRYVAICNPLRYTELMGHGVCVGLVAAACACGFTIAQIITSMVFHLPFRASNQLRHYFCDIAPVLAVASHHSRLSQLVIFMIGVFVLVIPLLLILISYIRIISAILKIPSSTGRYKAFSTCASHLIVVTVHYGCASFIYLRPKSSYSSSQDTLISVSYTILTPLFNPMIYSLRNQEFKSALRRVMGHTSYP

SEQ ID NO: 3723 - DNA, 945 bp, Felis catus
atgaagagacagaaccagagcatgaccactgagttcatcctcgtaggcttctcaaatcaggggaatctgcagatacttctcttcttcgtcttcctcctggtttacctgaccactctgatggccaatgccaccatcatgatcgtcattcgtctggacaggactctgcacaccccaatgtacttctttctctttgtcctctcctgctctgaaacctgctacaccttggtcattgtaccaaaaatgctgaccaacctgctttccgcaagccagactatttctttctccggatgtgctgctcagctctacttcttcgtgggctttgcctgtaccaactgttttctaattgctgtcatgggctatgatcgctacgttgccatctgcaaccctctcaactacgcactggttgtcggccgagccacctgcgttcagctggtcctcgcctccggcttctgtggcttcctcatctctgcggtggtcaatgccttggtgtttagcgtgcctttctgtgcctcccatcggatcaaccactttttctgtgacatttccccggtcataaaactaggctgcacggacaccaacagaaaggagatggtcatcttcttcctcagtattctggtattgctggtgccctctgtgctgatcttcatctcctacgtcctgatcgtctccaccatcctcaagatagcctcggctgagggccggaagaagacctttgccacctgcgcctcccacctcacggtggtcgtcgtccactacggctgcgcctcctttatctacctgaggcccacgtccctgtactcctcagataaggaccggcttgtggcagtgacctacactgtgatcaccccactgctcaatcctcttgtgtacgcactgagaaataaagaagtaaaggtgtctctgagtaaagttctcagcaggtactcatttcccaaaactgtatga

SEQ ID NO: 3724 - protein, 314 aa, Felis catus
MKRQNQSMTTEFILVGFSNQGNLQILLFFVFLLVYLTTLMANATIMIVIRLDRTLHTPMYFFLFVLSCSETCYTLVIVPKMLTNLLSASQTISFSGCAAQLYFFVGFACTNCFLIAVMGYDRYVAICNPLNYALVVGRATCVQLVLASGFCGFLISAVVNALVFSVPFCASHRINHFFCDISPVIKLGCTDTNRKEMVIFFLSILVLLVPSVLIFISYVLIVSTILKIASAEGRKKTFATCASHLTVVVVHYGCASFIYLRPTSLYSSDKDRLVAVTYTVITPLLNPLVYALRNKEVKVSLSKVLSRYSFPKTV

SEQ ID NO: 3725 - DNA, 945 bp, Felis catus
atggagtggggcaacgggaccctggtgacagagttcgtcttcctcggcttctcttctctggccgggctgcagcggctgctctttgttgccttcctgcccctctacttgttcactctgggcaccaatgccatcattgtttccaccatcgtgctagacagagcccttcacgcccccatgtacttcttcctcgctgtcctctcctgctctgagacctgctacaccttcgtcatcatacccaagatgctggttgacctcctggcccagaagaagaccatctccttcctgggctgtgccatccagatgttcaccttcctcttcctcggctgctctcactccttcctgctggcggccatggggtatgaccgctacgtggccatctgtaaccctctgcgctacacggtgctcatgggacacagggtgtgtgtgggactcgtggctgctgcctgtgcctgtggctttactattgcacagattatcacctccgtggtattccacctgcccttctgcgcctccaaccagctccatcatttcttctgtgacatcgcccctgtcctcacagtggcatctcatcatacctacctgagtcagattgtcatcgtcatgctctgtgcactggtcctggttatccccctgtcactgattttggtgtcctatattcacatcatctctgccatactccagtttccttccacattgggcaggtacaaagccttctccacctgtgcgtcccacctcattgttgtcaccatccattatggctgtgcctcctttatctacttacggctcaagtccaactactcctcaagccgagatgctctcatatcagtctcctacaccatcctgactcccttgttcaatccactgatttacagcttgagaaataaggagttcaagtcagctcttcgtagagctgcgggaaaaaccatttccctgccacgatgttaa

SEQ ID NO: 3726 - protein, 314 aa, Felis catus
MEWGNGTLVTEFVFLGFSSLAGLQRLLFVAFLPLYLFTLGTNAIIVSTIVLDRALHAPMYFFLAVLSCSETCYTFVIIPKMLVDLLAQKKTISFLGCAIQMFTFLFLGCSHSFLLAAMGYDRYVAICNPLRYTVLMGHRVCVGLVAAACACGFTIAQIITSVVFHLPFCASNQLHHFFCDIAPVLTVASHHTYLSQIVIVMLCALVLVIPLSLILVSYIHIISAILQFPSTLGRYKAFSTCASHLIVVTIHYGCASFIYLRLKSNYSSSRDALISVSYTILTPLFNPLIYSLRNKEFKSALRRAAGKTISLPRC

SEQ ID NO: 3727 - DNA, 925 bp, Felis catus
ttcaacaggaccaccgtggttacccagttcaccctggtgggcttctctagcctgggggcactccaactgctgccgtctgtcctctttcttctcctctacgtgaccatcctgctggccgatgccaccaccatgactgtcatccgctgcagcaggactctacaccctcccacgtatgggttcctgttcatcctttccttctccgaatcctgcgacactcttggcatcatccctcagctgctggcccacctgctcccagccaccaagggcatctcctctgtggcctgtgccacgcagctcttcttccttggctttgcctgcaccaattgctttctcatccctgtgatggggtacgatcgttaggtggcgatttgccactctatgagctacacgctcatcatgaacaagagggtagggttggggttggtttccctgtccggagtcacaggcttcttcattgctttgctggccaccaaactcgtctgtggcatgactttctgtggtcccaacagagtcaaccgctatttctgtgatatggcgtccgtcactaagttggcctgtgcagacacccatgtgaaagaaccggctccattcagccgaagcattctggcgatcatggcgcctttcctgctgattctgatctcctgtggcttcatcgttaacaccatcctgaagatcccctgggctgaggggaagagaaggcctttgccccacctcgcggtagtcttcgtgcactacggctgtgcctccatcacctacctgaggcccagatcaaagtctgcctcagacaaggatcagttggtggcagtgacctacactgtggtcactcccctgctcaatcctctggtctacagtctgaggaatcaggaggtgaagtctgccccgaaaagatttttgggaaagccctggagccgccaaggtgatctaa

SEQ ID NO: 3728 - protein, 183 aa, Felis catus
  MOD_RES (183)..(183): Any amino acid
MSYTLIMNKRVGLGLVSLSGVTGFFIALLATKLVCGMTFCGPNRVNRYFCDMASVTKLACADTHVKEPAPFSRSILAIMAPFLLILISCGFIVNTILKIPWAEGKRRPLPHLAVVFVHYGCASITYLRPRSKSASDKDQLVAVTYTVVTPLLNPLVYSLRNQEVKSAPKRFLGKPWSRQGDLX

SEQ ID NO: 3729 - DNA, 942 bp, Felis catus
tcagttttgtttagcgaaccatctctggatcctgctacgtatttgttgggttttgacactgtagatgatagggttcatcaagggtgggaaaaggatatagatattgcccatgaggacatggaccacaggagagaggtgctttccaaagcggtgcaccatagtcaacccaataattgggatatagaaaaccagaacagcacagatgtgggagacacaggtcttcaaggacttgagccgctcgtcccgggatgcaatagtcaagactgaatgcaggatcgcgatgtaggagatgagaatgagcaccgaatccaaaaagagtgtgcagatcaccagggctaacgcatagaagctgttgaagcggatgtcggagcaggcgagccgaagtaagtcttggtgcaggcagaaggaatgggagaggatatgaggatggcagtaatcgaagaactttaggcggacaatgggagcggtaatgaacaggaaactcctccctaaaatggccacaccaatggtgatgattctcatattggtgaggatggatgtatatctcagaggattgcagatggcagtaaagcgatcaaaggccatggcaagaaggactccagactccatgcatgatagaccatgaacaaagaaggtttgagcaatgcaggcatcgagaccaatctcttggctgatcccccacaggatcccgagcaccgtgtgcactgtggacagccccatgcacaggtcagtgagggccaacatggccaggaagtagaacatgggctcatgtaggctgggctcggtccggatcacatgcaacaccaggcaattccctaagagtaccatagcatagatacaggagaaaggaatggagagccaaggatattcccgttccaggccagggaaacccgtaaggagaaaggtggagttactgattttggaatcaggttgaacagacat

SEQ ID NO: 3730 - protein, 313 aa, Felis catus
MSVQPDSKISNSTFLLTGFPGLEREYPWLSIPFSCIYAMVLLGNCLVLHVIRTEPSLHEPMFYFLAMLALTDLCMGLSTVHTVLGILWGISQEIGLDACIAQTFFVHGLSCMESGVLLAMAFDRFTAICNPLRYTSILTNMRIITIGVAILGRSFLFITAPIVRLKFFDYCHPHILSHSFCLHQDLLRLACSDIRFNSFYALALVICTLFLDSVLILISYIAILHSVLTIASRDERLKSLKTCVSHICAVLVFYIPIIGLTMVHRFGKHLSPVVHVLMGNIYILFPPLMNPIIYSVKTQQIRSRIQRWFAKQN

SEQ ID NO: 3731 - DNA, 903 bp, Felis catus
atggaaccaagaaatcaaacgagtgtttcagaatttttactcctgggattttcccaagactcagagcatcaacccattctatttgggctattcctgtccatgtacctggtcaccgtgctcgggaatctgctcatcatcctggctgtcagctctgactctcacctccacacccccatgtacttcttcctctccaacttgtcctttgctgacatctgcttcacctccaccaccgtccctaagatgctggtgaacatccaaacacagagcaaatccatcacctatgcaggctgcatcacccagatgtattttttcatggtttttggaggtatggacacttttctcctcactgtgatggcctatgaccggtttgtagccatctgtcaccccttgcactacacagtcatcatgaacccgtggctctgtggcctcctggttcttgtgtcctggttcatcagcttgtcatactccctgatccagagtctcttaatgttgcggctgtccttctgcaccaactgggtaattccacacttttactgtgaacttgctcaggccatcatgcttgcctgctcagacaccttggccaatcacatcctgctatatattgtaactagctttcttggcattgttcccttctcagggatccttttctcctatagccgaattgcctcctcaatcctgagaatcccatcagctaatgggaagtacaagacattttccacctgtgcatctcacttgtctgtggtttctttgttctatgggacagggcttggtgtgtatctcagttctgatgcatcttcctggaggggcatgattgcctcattgatgtacaccgtggtcaccccaatgctgaatcccttcatctacagcctgcggaacagggacatcaagagggctttacaaaaa

SEQ ID NO: 3732 - protein, 301 aa, Felis catus
MEPRNQTSVSEFLLLGFSQDSEHQPILFGLFLSMYLVTVLGNLLIILAVSSDSHLHTPMYFFLSNLSFADICFTSTTVPKMLVNIQTQSKSITYAGCITQMYFFMVFGGMDTFLLTVMAYDRFVAICHPLHYTVIMNPWLCGLLVLVSWFISLSYSLIQSLLMLRLSFCTNWVIPHFYCELAQAIMLACSDTLANHILLYIVTSFLGIVPFSGILFSYSRIASSILRIPSANGKYKTFSTCASHLSVVSLFYGTGLGVYLSSDASSWRGMIASLMYTVVTPMLNPFIYSLRNRDIKRALQK

SEQ ID NO: 3733 - DNA, 996 bp, Felis catus
atgaattgcttgaatcaaaatattcacacttagctggatgtctctacacttgttttgtttattcaacactctcttctttttcaagaggtgtcccatcttcatggaaccacagaatctaactggtgtctcagaattcttcctcatgggactctcagatgacctggaactacagccccttctctttgggctgttcctgtccatgtacctggtcactgtgctggggaacctgctcatcatcctggctgtcagctctgacccccacctctacacacccatgtacttcttcctttccaacctgtccttggctgacattggtttcagtaccactacgatccccaagatgctgttgaacattcaaacacacagtagatctatcacctatgcagactgcctaactcaggtgtccttttttttcctatttggatgtttggacaatctactcctggctgtgatggcatatgaccggtttgtggccatttgtcaccccctgcactacccagtcatcatgaacccacgcctctgtggctttttggtcctcgtgtcatttttcagcagccttttggactctcagattcactgtttgatggtgtcacaacttaccttctgcacaagtgtggaaatgcatcatttcttttgtgatgcacctcaacttctccaccttgcctgttctgatacctccatcaatatcatactaatgtatttcatgggggccatttttggtggcattccactctcagggatcctttgctcttatactcgaattgtttcctccattctgagagtcccatcaacaggcgggaagtacaaagccttttctacctgtggctctcacctatcagttgtttgcttgttttatggaacaggtcttggggtatacctcagttcatctgtctccccctaccctaggaagggtgcagtggcctcggtcatgtacactgtggtcaccccaatgctgaaccccttcatctacagcctgagaaacaaggatatcaagag

SEQ ID NO: 3734 - protein, 320 aa, Felis catus
  MOD_RES (320)..(320): Any amino acid
MSLHLFCLFNTLFFFKRCPIFMEPQNLTGVSEFFLMGLSDDLELQPLLFGLFLSMYLVTVLGNLLIILAVSSDPHLYTPMYFFLSNLSLADIGFSTTTIPKMLLNIQTHSRSITYADCLTQVSFFFLFGCLDNLLLAVMAYDRFVAICHPLHYPVIMNPRLCGFLVLVSFFSSLLDSQIHCLMVSQLTFCTSVEMHHFFCDAPQLLHLACSDTSINIILMYFMGAIFGGIPLSGILCSYTRIVSSILRVPSTGGKYKAFSTCGSHLSVVCLFYGTGLGVYLSSSVSPYPRKGAVASVMYTVVTPMLNPFIYSLRNKDIKX

SEQ ID NO: 3735 - DNA, 1037 bp, Felis catus
ttaagactaggctgttctgttaaggagcctctgcaaggccctcttgatgtccctgttcctcaggctgtagatgaagggattcagcatgggaacaaccacagcatacatcatggaggccactgcatccttcctgggagaatgtgagacagtcgatcccaggaacaccccaagacctgtcccataaaataagcaaacaactgacaggtgagagccacaggtggagaaggctttgtacttcccacctgttgatgggactctcagaacggaggaaagaattcgtgtataagagaaaaggatccctgagactggaataccaccaaagatggcaccaataaaatacatgaatattttattggtggaagtgtcattacaggaaagcttgaggagttgaggagggtcacagaagaaatggggaatttccacgtttgtacagaaggtaagttgtgacacaatgaggcactgcagctgagagtccagaaggctgatcaaaaaagacaccagaatcagcaggcgacagaggcgggggttcatgatgactgggtagtacagaggatagcaaatagctacaaatcgatcataggccatcacggttaagagtacactgtccaaacagccaaaaagattaaagagagacaactgaatcaggcagcccgcatgggagatcactcggttatgagtctgaatgtccaaaatcaccttcgggacggtggtagatgtgaaaccgatgtcagccacggacagggtggaaaggaagacgtacatgggagtgtggaggtgggagtcagagctgacagccaggatgatgagcagattccctagcatggtgaccacatacatggacaggaacaggctgaaggttagaggctgccggtctggatcatctgagaaccccaggaggaggaactccaacacatctgttagattatctggttccacagagcagagacagcttttggaaaataaatgagagtttacataacagaaacaagtatacaggaatccaccagtgtggctatactttggatgcatgcaattca

SEQ ID NO: 3736 - protein, 340 aa, Felis catus
MHPKYSHTGGFLYTCFCYVNSHLFSKSCLCSVEPDNLTDVLEFLLLGFSDDPDRQPLTFSLFLSMYVVTMLGNLLIILAVSSDSHLHTPMYVFLSTLSVADIGFTSTTVPKVILDIQTHNRVISHAGCLIQLSLFNLFGCLDSVLLTVMAYDRFVAICYPLYYPVIMNPRLCRLLILVSFLISLLDSQLQCLIVSQLTFCTNVEIPHFFCDPPQLLKLSCNDTSTNKIFMYFIGAIFGGIPVSGILFSYTRILSSVLRVPSTGGKYKAFSTCGSHLSVVCLFYGTGLGVFLGSTVSHSPRKDAVASMMYAVVVPMLNPFIYSLRNRDIKRALQRLLNRTA

SEQ ID NO: 3737 - DNA, 996 bp, Felis catus
ctcttgatatccttgtttctcaggctgtatatgaaggggttcagcattggggtgaccacagtgtacatgaccgaggccactgcacccttcctagggtagggggagacagatgaactgaggtataccccaagacctgttccataaaacaagcaaacaactgataggtgagagccacaggtagaaaaagctttgtacttcccgcctgttgatgggactctcagaatggaggaaacaattcgagtataagagcaaaggatccctgagagtggaatgccaccaaaaatggcccccatgaaatatattagtatggtattgatggaggtatcagaacaggcaaggtggagaagttgaggtgcatcacaaaagaaatgatgcatttccacacttgtgcagaaggtaagttgtgacaccatcaaacagtgaatctgagagtccaaaaggctgctgaaaaatgacacgaggaccaaaaagccacagaggcgtgggttcatgatgactgggtagtgcagggggtgacaaatggccacaaaccggtcatatgccatcacagccaggagtagattgtccaaacatccaaataggaaaaaaaaggacacctgagttaggcagtctgcataggtgatagatctactgtgtgtttgaatgttcaacagcatcttggggatcgtagtggtactgaaaccaatgtcagccaaggacaggttggaaaggaagaagtacatgggtgtgtagaggtgggggtcagagctgacagccaggatgatgagcaggttccccagcacagtgaccaggtacatggacaggaacagcccaaagagaaggggctgtagttccaggtcatctgagagtcccatgaggaagaattctgagacaccagttagattctgtggttccatgaagatgggacacctcttgaaaaagaagagagtgttgaataaacaaaacaagtgtagagacatccagctaagtgtgaatattttgattcaagcaattcat

SEQ ID NO: 3738 - protein, 320 aa, Felis catus
  MOD_RES (320)..(320): Any amino acid
MSLHLFCLFNTLFFFKRCPIFMEPQNLTGVSEFFLMGLSDDLELQPLLFGLFLSMYLVTVLGNLLIILAVSSDPHLYTPMYFFLSNLSLADIGFSTTTIPKMLLNIQTHSRSITYADCLTQVSFFFLFGCLDNLLLAVMAYDRFVAICHPLHYPVIMNPRLCGFLVLVSFFSSLLDSQIHCLMVSQLTFCTSVEMHHFFCDAPQLLHLACSDTSINTILIYFMGAIFGGIPLSGILCSYTRIVSSILRVPSTGGKYKAFSTCGSHLSVVCLFYGTGLGVYLSSSVSPYPRKGAVASVMYTVVTPMLNPFIYSLRNKDIKX

SEQ ID NO: 3739 - DNA, 948 bp, Felis catus
tcagagggtcttgccccccagtcatctagagtcattgcccccacagaacaccttcctcattgctcccgtcacatccctgttccgcagagtatagatgaaggggttgaccatgggggtgacgatggtgtagaagagagaaatgaacttgccctgatcctgggagtagttgttgctgggctggaggtaagcatagatcgccgtgccgtagaaaagggaaaccaccgtgaggtgggacccacatgtcccaaaggctttcctctgtcctgcggctgactttattcttaacactgccctgacgattcgaccataggagaacgtgattaatgccactggtatgaggagaatgatcacaccgacaaagaagagcacagactcattcacagtggtgtcaacacaggcaagcttgagcagtggggggacctcacaaaagaagtggtctattttatttctcccacaaagtggtacaaggaaggtgagcaccgtctgcaacgaggagttggcaaaaccaatgaaccacgatgcagaagccatcagggcacagagacgggggtgcatgatcactgtgtagtacaggggtctgcagacggctgcatagcggtcaattgccatcacccccaagagaatgcattctgtggatcccaaccctagagaaacgaacagctgagctacacaggcagcaaaggagatagacttgtctgctcccctgagatgaaccagcagctgaggaacagtgctggtcgtgtaacacaggtccagaaagcttagcttggacaggaaaaagtacatgggagtctgcaggtgtgggtccaggagggacaacgcaatgatggttgtgtttcccagcagggtgagcagatagaagatcagaagaaccacaaagaggactcgctccagctgaggccggtcagagaaacccagcaggataaagccagtgaaagaacttccatt

SEQ ID NO: 3740 - protein, 308 aa, Felis catus
NGSSFTGFILLGFSDRPQLERVLFVVLLIFYLLTLLGNTTIIALSLLDPHLQTPMYFFLSKLSFLDLCYTTSTVPQLLVHLRGADKSISFAACVAQLFVSLGLGSTECILLGVMAIDRYAAVCRPLYYTVIMHPRLCALMASASWFIGFANSSLQTVLTFLVPLCGRNKIDHFFCEVPPLLKLACVDTTVNESVLFFVGVIILLIPVALITFSYGRIVRAVLRIKSAAGQRKAFGTCGSHLTVVSLFYGTAIYAYLQPSNNYSQDQGKFISLFYTIVTPMVNPFIYTLRNRDVTGAMRKVFCGGNDSR

SEQ ID NO: 3741 - DNA, 970 bp, Felis catus
ttacattttatgaataccatgcgcagtgccaaagattttcctcagagcagtcttcatttccttgttcctaaggctatagattagaggattacagaggggtgttatcacagaataaagtaaggtcacaattttctgcattttcactgggcgtcctgatccaggactaacatacatcaccataacagagccaaaaaaacaggatcaccactgccagatgagaagcacaagtggagaaagccttgtgtttgcctgctgctgagggcatccttagcacagacacaatcaccagagcataggaacaaagaacaaagagaaagattccaatcataaaaatagcattgaaagtagagtaaatgaactgtgttgtggtgtcttcagaacaggacagcatcatcaatgggacaggatcacacatgaaatggttgatggtatttgggccacagtagggtaactgtgaaatgagaacaactggggttaggaagaggacgaacccgcacgaccagccaaagatggcaaggccagtgtacagctgtttcgtcataatgcgtgggtaatgcagaggacgacagatggcaaggtacctgtcaaaggccatgatgcagaggaagaagccctcatcacaccccagagagaagaagaagtagaactgtgcaaaacagctcacaaaggaaatggacttgcttgaggacaggaaattggccaacatgttagggacggtcgtggtgacataacatatttccaggagagagaaattccccaagaggatgtacatgggcgtgtgaagacgccgttcccaccgcactgcacagacaatggctgcgttccccatgagagtcagcgtgtagactactgagaagagcccgaagtagaggagctgaatttctgggcttgagggaaagcccacgaggataaagtggctaacggagttggtggtttctgtgccggacacattcattggtctggaagacat

SEQ ID NO: 3742 - protein, 268 aa, Felis catus
MSSRPMNVSGTETTNSVSHFILVGFPSSPEIQLLYFGLFSVVYTLTLMGNAAIVCAVRWERRLHTPMYILLGNFSLLEICYVTTTVPNMLANFLSSSKSISFVSCFAQFYFFFSLGCDEGFFLCIMAFDRYLAICRPLHYPRIMTKQLYTGLAIFGWSCGFVLFLTPVVLISQLPYCGPNTINHFMCDPVPLMMLSCSEDTTTQFIYSTFNAIFMIGIFLFVLCSYALVIVSVLRMPSAAGKHKAFSTCASHLAVVILFFWLCYGDVC

SEQ ID NO: 3743 - DNA, 950 bp, Felis catus
ttagctatctgtcttgaggaaaaccctcaggactcgctccctaatctgtttggtcctgaccccatagattataggattgagagctggcggaacaaccacatataggttggccaagaaaatgtggatatattgagggatattgtggccaaatcggtgtgtcaagaaagagaaaaatgctggtgtgaaaaaggctaagataactccagtgtgggagccacaggtgttgagagctttgagtcgggcatccttggagggtaagcagaagatagcatagaggatcctgacataggagagaattataaggagtacatccaataataggagagaaatgttgccaagaccgaacataatatttactttgatgctggcacaggccaggcgagcaatgcccatgtgttcacagtaggtatgagggatgatatagtgcccacagaagggcagcctcaagaggagaaataccagaggggccaccatgcacaggctcctcagaatagccatgcctgcaatgaggctgatgattttgctggtgaggatcatggtgtaccgaaggggtttacaaatggcaacatagcggtcaaaggccatggccaccaacacaatgctctccatggcagtgaagaagtggatgaagaacatctgggaaaggcagctttcaaaagatatatccctgaggctgaaccagaagatgcccagcattttggggatggtggctgtggacaagcccaggtcgatggagtccaacatggctaggaagtagtacacgggctcatggagactatgctcagtctggatcacaaacaggacagcagcgttccccaagagtgcaacaagatacgcaaagaaaaaaggaaatccaatccagacgtgcacatcttctagccctgggatacccaggaggaggaacgaagaaggatggaactgggtgtcattaagaatggacattctctctg

SEQ ID NO: 3744 - protein, 313 aa, Felis catus
MSILNDTQFHPSSFLLLGIPGLEDVHVWIGFPFFFAYLVALLGNAAVLFVIQTEHSLHEPVYYFLAMLDSIDLGLSTATIPKMLGIFWFSLRDISFESCLSQMFFIHFFTAMESIVLVAMAFDRYVAICKPLRYTMILTSKIISLIAGMAILRSLCMVAPLVFLLLRLPFCGHYIIPHTYCEHMGIARLACASIKVNIMFGLGNISLLLLDVLLIILSYVRILYAIFCLPSKDARLKALNTCGSHTGVILAFFTPAFFSFLTHRFGHNIPQYIHIFLANLYVVVPPALNPIIYGVRTKQIRERVLRVFLKTDS

SEQ ID NO: 3745 - DNA, 881 bp, Felis catus
caggcctagagactgtgcagtgctggattgggattccattctgtgtcatgtatctcattgctatgattggaaactccttgattctgatcatcatcagggcagaacgcagcctccatgagcccatgtacatttttctaggcatgctgggagtcacagatattgtacttggcacgagcattgtgcccaagatgcttggaatcttctggtttcatgtaccagagatttatttagattcttgcttgcttcaaatggggctcatccacacatttcagtgcatagagtcaggcatcctgttggccatggctctggaccgttatgtggccatctgttatccactaagacatgctgccatcttcacccaccgcctagtcacacaaataggggctttggtaacactcagggctgcccttctcgtagccccatctttagtactgataaaatgccggtttcagttttaccatacaaccatcatctcccactgctactgtgagcatatggccattgtgaaactggctgcagaaaatgtacgagtcaacaaaatctatggtttgtttgtggcattcactgttgcagggtttgacctcatattcatcactttgtcctacatacagatatttatcaccgtttttcgtctgccccagaaggaggctcggttgaaagcattcaatacatgcatcgctcacatctgtgtcttcctccagttctacctccttgccttcttctccttcttcacacataggtttggtgctcatgttcccccttatatccacatcctcttttctagcctctacttgctggtccccccatttctcaatccacttgtctatggtgccaagaccacgcagatccgcattcacctggtaaagatgttgtattcataa

SEQ ID NO: 3746 - protein, 292 aa, Felis catus
GLETVQCWIGIPFCVMYLIAMIGNSLILIIIRAERSLHEPMYIFLGMLGVTDIVLGTSIVPKMLGIFWFHVPEIYLDSCLLQMGLIHTFQCIESGILLAMALDRYVAICYPLRHAAIFTHRLVTQIGALVTLRAALLVAPSLVLIKCRFQFYHTTIISHCYCEHMAIVKLAAENVRVNKIYGLFVAFTVAGFDLIFITLSYIQIFITVFRLPQKEARLKAFNTCIAHICVFLQFYLLAFFSFFTHRFGAHVPPYIHILFSSLYLLVPPFLNPLVYGAKTTQIRIHLVKMLYS

SEQ ID NO: 3747 - DNA, 735 bp, Felis catus
gaagttttcctttcaaacttcatcccaaatgtgtatcttacctccttattccccaagctatagatgagggggttccacatgggcatcaccacagtgtacaacagagaaatcactttattgagatccagggagggacttgagccaggccgaacagagataagaaaagagtcccatacaggatggagacaactaccaggtgagaggagcaggtggacaaagggttctgtctcccatgagcaatctggatcttccagatggccaccaggatgcaaacatgggagaccatcatgatcaggccactgaagattcctgtagatccagccaaaagaaaaatgtaagttgagtcacagaagtgtctgcacatgtaagagagagcagaagggaaataccacagaagaaatgattgatgatatttggaccacacaagggtaagcaaaaagtcagtgtcatataggtcatgctgcttagaagagccatgccataaggccctacaaccagctgcacagagaccctctgggacgtaatgagggcatgcaacaagggcttaccgatggccaaataccagtcacatgccatggacgtcaggaagaaacattcagataccccaaagaaagcagagaaccacatctgagagagctgacttgtttctctgcaaagatatcacacagcatcttgggggcaatggaagaagaggaacaatacctaaaaggacgaggggctaagaaaaatacatag

SEQ ID NO: 3748 - protein, 50 aa, Felis catus
YVFFLAPRPFRYCSSSSIAPKMLCDIFAEKQVSSLRCGSLLSLGYLNVSS

SEQ ID NO: 3749 - DNA, 645 bp, Felis catus
tcattgggagactgtcaaaatacaccttttctccattgtgccaaagttcctccgaaaccctgttctcaaagcctgcttcacatctttgttcctcaggctgtagatagattcagcatgagactcacaaagatacaaaccactgccacaattttccctgttcaacagactgctcaggggctgttctcatacatacagaatagggacccccaaaacatggcaacagcgatcaggtgggagccacgggtggagaaggctttgcactggcctttgctggaagggatcctcatgatggtggtgaaaatgaaaatgtaggagataaggatgatgagtaggatataaggatggaacagtgaggttaatccccacacacaaacagagcagtctgctttctgtaagtatctgatcctgtcagcatcaggaggggtggggcagcacatagaaagggttgatgaagttgtgtccataaaagtataagcaggaggtcaatagtatctgcattgtgcccaccatagtacccagaggtagggggcagtgacaaggcagatgcaaagggacctggacattctgctgctgtagtgtaggggatggcagatggccatgtacctgtcagaggccatggtgcccagcgcataatactgcataagg

SEQ ID NO: 3750 - protein, 103 aa, Felis catus
SLGDCQNTPFLHCAKVPPKPCSQSLLHIFVPQAVDRFSMRLTKIQTTATIFPVQQTAQGLFSYIQNRDPQNMATAIRWEPRVEKALHWPLLEGILMMVVKMKM

SEQ ID NO: 3751 - DNA, 651 bp, Felis catus
ccttatgcagtattatgtgctgggcaccatggcctctgacaggtacatggccatctgccatcccctacactacaacagcagaatgtccaggcccctttgcatctgccttgtcactgccccctacctctgggtactatggtgggcacaatgcagatactattgacctcctgcttatacttttatggacacaacttcatcaaccctttctatgtgctgacccacccctcctgatgctgacaggatcagacacttacagaaagcagactgctctgtttgagtgtggggattaacctcacctttccatccttatatcctacttatcatccttatctcctaaattttcgttttcaccaccatcatgaggataccttccagcaaaggccagtgcaaagccttctccacccgtggctcccacctgatcgctgtcgccatgtttttggggtccctattctgtatgtatctgagaacagcccctgagcagtctgttgaacagggaaaattgtggcagtggtttgtatctttgtgagtctcatgctgaatctatttatctacagcctgaggaacaaagatgtgaagcaggctttgagaacagggttttggaggagctttggcccaatggagaaaaggtgtattttgacagtctcccaatga

SEQ ID NO: 3752 - protein, 95 aa, Felis catus
LCSIMCWAPWPLTGTWPSAIPYTTTAECPGPFASALSLPPTSGYYGGHNADTIDLLLILLWTQLHQPFLCADPPLLMLTGSDTYRKQTALFECGD

SEQ ID NO: 3753 - DNA, 964 bp, Felis catus
atgtccatctcaaatgccagtgcaataacagaattcattctcctggggctcacagaccggcctgaactccaacttctcttctttgtgctgtttctggttttgtatcttgtcaccctctcaggcaacctgggcatgatgctgttgatcagactggactctcggctccacacacccatgtacttcttcctcactaatttggcctttgtggacttgtgttacacctcaaatgcaaccccacagatgttgactaatttcttatcggagaagaagaccatcacctttgttggctgctttacacaatgttacattttcattgcgcttctcctcactgagatttacatattggcggcaatggcctatgaccgctacgtggccatatgtaaccctctgcgctatagtatgaaaatgtccaggcgcatctgcctctgtttggccacattgccttatgtctatggcttctcagatgggctgttccaggccctcctgaccttccgcttgaacttctgtagatccaatgtcatcaaccacttctactgtgctgacccaccactgattaagctttcttgctctgatacgtatgtcaaagagcatgccatgctcatatcagctggcttcaatctctccaactccctctgcatcatcctggtgtcctatgccttcattattggtgccatcctccggatcaaatcggcagagggcaggcgcaaggcattctccacctgtggctcccacatgatggctgtgaccctcttttatgggacactcttctgcatgtatgtaagaccaccaacagataagactgtagaggaatccaaaataatagctgtcttgtacacttttgtaagtccggtgcttaatccattgatatacagtctgcggaacaaggatgtaaagcaagccttgaaaaatgtcctcagaggaaataggtcactaacatgggactgaccctgatttccaatgaatc

SEQ ID NO: 3754 - protein, 314 aa, Felis catus
MSISNASAITEFILLGLTDRPELQLLFFVLFLVLYLVTLSGNLGMMLLIRLDSRLHTPMYFFLTNLAFVDLCYTSNATPQMLTNFLSEKKTITFVGCFTQCYIFIALLLTEIYILAAMAYDRYVAICNPLRYSMKMSRRICLCLATLPYVYGFSDGLFQALLTFRLNFCRSNVINHFYCADPPLIKLSCSDTYVKEHAMLISAGFNLSNSLCIILVSYAFIIGAILRIKSAEGRRKAFSTCGSHMMAVTLFYGTLFCMYVRPPTDKTVEESKIIAVLYTFVSPVLNPLIYSLRNKDVKQALKNVLRGNRSLTWD

SEQ ID NO: 3755 - DNA, 940 bp, Felis catus
atggagtactggaactccaccctgggcagtggctttatattgatggggattctgaaagacagtgggtctcctgaactgctctgtgtcataatcacagtcctgtacatgttggccctgaccagcaatggcctgctgctcttggtcatcacagtggattcccggctccacgtgcccatgtacttcctcctcgggcagctctcactcatggacctcctcttcacatctgttgtcactcccaaggcgctcatggattttctgcgcagtgaaaacaccatctcctttgcgggctgtgcccttcagatgttcctggcattgatgctgggtggtgcagaggacctgctactggccttcatggcctatgatagatatgtggccatttgtcatcctctgaactacatggtcttcatgaggccaagggtctgctggctcatggtggccacagcatggatactggcatacctgaatgctctaggacataccttctataccatgcagtatcccttctgcaaagcccggaacatcaggcacctgctctgtgagattccacctttgctgaagttggcctgtgcagaaacctccagatatgaactcttggtgtatgtgacaggggtgattttccttttgctccctctttctgccattattgcctcctatgcactaatcctgtttactgtgcttcacatgccctcaaatgaggggaggcacaaagccctagtcacctgttcttcccatctgactgtggttgggatgttctatggagctgccacattcatgtatgtcctgcccagctcccttcacagccccaagcaagacaacatcatctctgttttctacacggttgtcactccagccctgaacccccttatctacaccttgaggaataagaaagtgatgggggccttgaggagggtcctaggaaaatatatattgccaacccact

SEQ ID NO: 3756 - protein, 314 aa, Felis catus
  MOD_RES (314)..(314): Any amino acid
MEYWNSTLGSGFILMGILKDSGSPELLCVIITVLYMLALTSNGLLLLVITVDSRLHVPMYFLLGQLSLMDLLFTSVVTPKALMDFLRSENTISFAGCALQMFLALMLGGAEDLLLAFMAYDRYVAICHPLNYMVFMRPRVCWLMVATAWILAYLNALGHTFYTMQYPFCKARNIRHLLCEIPPLLKLACAETSRYELLVYVTGVIFLLLPLSAIIASYALILFTVLHMPSNEGRHKALVTCSSHLTVVGMFYGAATFMYVLPSSLHSPKQDNIISVFYTVVTPALNPLIYTLRNKKVMGALRRVLGKYILPTHX

SEQ ID NO: 3757 - DNA, 942 bp, Felis catus
aaaaagcacacagagggttcctattcagcaattttttcacagctacttttacctctttgttccgtaaactataaatgataggattcaacatgggggttaatccagcatataccaaagccataaatttgtctatttcctgtgaatctacagcggagggcttcaggtacatggagagagctgtcccatagaacaaaaccaccacagtcaggtgggctgcgcatgttgaaaaggctttgcttccaccatccactgagctgattctcaggatgcttggagagaatgaatgcgtaagagacacaaatgaggagcatcggcataggaagaagaagtacgctgatcaccagcatgatcaactgcaccctggaagtatccacacaaactagtttcaacacagccagaatttcacaagtgaagtgattgatgatgccacttccacagacagacagctgcagcacagatactgtttccaccagggcggtgaggcagcctgtcatccaggagccagcggcaatctgcacacaagccctcttgttcatgatgatggggtatctcagaggattgcagatggccacataccggccatacgccatcgtggacaggagcacacactcagtggagcccatggcaagagaaaagtacatctgagtggcacatcctgagaatgagatggtgtttttccctgaaacaaagtttgtcagcattggagtgagagcagaagaggtgtaccagatgtctaaaaaggagaggttgctgaggaagaagtacatgggtttgtgtaggtgggaatccaggatggtgatggacatcagaatgatattacccagcagggtgatcaggtacatcagcaagcacagcacaaatatgatgacctcaactttggggtaacgagtaaaccccaggaaaataaaattaggaaatgactgtcaagtttgccttgaccat

SEQ ID NO: 3758 - protein, 57 aa, Felis catus
  MOD_RES (57)..(57): Any amino acid
MYLKPSAVDSQEIDKFMALVYAGLTPMLNPIIYSLRNKEVKVAVKKLLNRNPLCAFX

SEQ ID NO: 3759 - DNA, 922 bp, Felis catus
agaaccagagcagcatgtccgagttcctactcctggggctccccatacggccagagcagcagggcatgttcttcaccctgttcctgggcatgtacctgaccacggtgctggggaacctgctcatcatcctgctcatcaggctggactctcgcctccacacgcccatgtacttcttcctcagccacttggccttctctgatatctctttctcatctgtcaccgtcccaaagatgctgatgaacatgcagactcagcacttatccatcccctatgtggcatgcatttcccagatgtattttttcatattttttgtctgtcttgacaatttccttcttgcagtgatggcatatgacaggtatgtggccatctgtcaaccactccactacaccactgtcatgagggaggagctgtgtatcttactggtggctggatcctggttcttctcttgtgcccatgccctattgcatgctctccttctgtcccgcctgtccttctgtgctgacaataccatccctcatttcttttgtgatctcactgcccttttgaagttgatctgctcagacacctccctcaatgagctagttatcttcaccgaggggggagtctttgccttcctgccattgtgtgctattttgggctcttatattcgcattggggccaccatcctaggggttccctccatcaagaggatctgcaaagccttgtctacctgtggctcccaccttcttgtggtgtttttgtactatgggactcttgcaatgatttacttcattccttcatcaaacaattccaaagtcaaagatatagttgtttcagttatatatacagtggtgacacccatgttaaacccctttatctatagcctgaggaacggggacatgaaattggctctggggatactttataggaggaaaattatttt

SEQ ID NO: 3760 - protein, 303 aa, Felis catus
  MOD_RES (303)..(303): Any amino acid
MSEFLLLGLPIRPEQQGMFFTLFLGMYLTTVLGNLLIILLIRLDSRLHTPMYFFLSHLAFSDISFSSVTVPKMLMNMQTQHLSIPYVACISQMYFFIFFVCLDNFLLAVMAYDRYVAICQPLHYTTVMREELCILLVAGSWFFSCAHALLHALLLSRLSFCADNTIPHFFCDLTALLKLICSDTSLNELVIFTEGGVFAFLPLCAILGSYIRIGATILGVPSIKRICKALSTCGSHLLVVFLYYGTLAMIYFIPSSNNSKVKDIVVSVIYTVVTPMLNPFIYSLRNGDMKLALGILYRRKIIX

SEQ ID NO: 3761 - DNA, 909 bp, Felis catus
ttttcgtagggcccccttcaagtccctgttcctcaggctgtagatgaaggggttcagcatgggggtcaccacggtatacatcacagtagctgctgtatccttctcagaagagtgtgaggacaaagggttgaaatacacagcaatgatggtgccatagaagagggaaaccacggccaggtgcgagccacaggtggagaaggctttccatcttcccttcgtggacgggactctcaggacagcgcaggtaatatggacatacgaagccaggatgcaaataaatggagagatcatgatcagagaaccctcagtcagaatcatcacctcattgaggtgggtgtcagagcaggacagtttcaggaggggagtcacatcacagaagaagtgggggatggcattgtctgcacagaacgagagtcgagccattaacagggtatgcagtagagcattcaggctggcaatgacccatgacccagcaaccagcagggcacagagccggtgggtcatctttgtcgagtagtgtaaggggtggcatatggcaacaaagcggtcataggccatcacagccaggaggaaattgtccatgtcggcaagctcaaagagaaaatacatctgtgtgagacacccagagaaggagatggcctgagtcccaaggatgtggttggccagcatcttggggacggtggtggtggagaagcagatgtccacaaaggacaggtggctgaggaggaagtacatggggatgtgcaggcgggggtccacgcagatggccaggaggatgagcaggtttcccgggaccgtggccaggtacatgctcaggaagagcgcaaagagggcctgctgctgctggggctgcctggagagcccgaggaggaggaactcggagacactcgactggtttgctcctctcat

SEQ ID NO: 3762 - protein, 303 aa, Felis catus
MRGANQSSVSEFLLLGLSRQPQQQQALFALFLSMYLATVPGNLLILLAICVDPRLHIPMYFLLSHLSFVDICFSTTTVPKMLANHILGTQAISFSGCLTQMYFLFELADMDNFLLAVMAYDRFVAICHPLHYSTKMTHRLCALLVAGSWVIASLNALLHTLLMARLSFCADNAIPHFFCDVTPLLKLSCSDTHLNEVMILTEGSLIMISPFICILASYVHITCAVLRVPSTKGRWKAFSTCGSHLAVVSLFYGTIIAVYFNPLSSHSSEKDTAATVMYTVVTPMLNPFIYSLRNRDLKGALRK

SEQ ID NO: 3763 - DNA, 959 bp, Felis catus
ttcttcaaccacaggacaattggaccttttctaactgccatcgcagagaatctcctcagagccttctttatgtctttgttcctcaggctgtagatgaaggggttcagcatgggcgtgaccaccgtgtacatcactgaggctgtggcacttgagtgggagctctgggtagcagcagagctcaggtacactccgaggcccgtacaataaaataaggagacaaccgagaggtgagatgcacaggtggaaaatgccttatacttgccctgagctgatgagatcccacgtatggaggaaactatcttagagtaagagtaaaggatcccaacgaaaggaccaccacccactaggatagctgcaaaatacatcaccaagttactaataaaggtgtcagaacaggcaagttggatcacctgattgagttcacaggaaaaatgggggatttccaagactgtacagaaggacagccgcaacaccattgaagtttgcaacaaggaatgcaagacactcgtgatccaggacaccaggaccagcggtgcacagagccgggggctcatgatgaccgtgtattgcagggagtgacagatggccacaaacctgtcatagaccataatgtccaggaggcagatgtccaatcctgaaaagattatgaaaaagttcacctgtgtgatgcagtcctcataggttatgactttgctctgggtctggatgttccagagcatcttcgggacggtggtggaagtgatgcagatgtctacagaggacaggttggccaggaagaagtacatgggggtgtggaggcgggagtcagagctgacggccaggaggatgagcaggttcccaaacacagtgatcaggtacatggagaggaaaagcccaaatacgaggggttgctgttctggaccctctgaaaatcccagaagcagaaattctgatgtccgtgtatcatttcctggttccat

SEQ ID NO: 3764 - protein, 320 aa, Felis catus
  MOD_RES (320)..(320): Any amino acid
MEPGNDTRTSEFLLLGFSEGPEQQPLVFGLFLSMYLITVFGNLLILLAVSSDSRLHTPMYFFLANLSSVDICITSTTVPKMLWNIQTQSKVITYEDCITQVNFFIIFSGLDICLLDIMVYDRFVAICHSLQYTVIMSPRLCAPLVLVSWITSVLHSLLQTSMVLRLSFCTVLEIPHFSCELNQVIQLACSDTFISNLVMYFAAILVGGGPFVGILYSYSKIVSSIRGISSAQGKYKAFSTCASHLSVVSLFYCTGLGVYLSSAATQSSHSSATASVMYTVVTPMLNPFIYSLRNKDIKKALRRFSAMAVRKGPIVLWLKX

SEQ ID NO: 3765 - DNA, 925 bp, Felis catus
aatttcttttggacaactttcctgattgcttgtttaacatctttgttccgcaggctatagatcaaagggtttagcatagggctcgcaaagatataaaaaactgcgacaattttcccctgttctacagatgcctcggaagggggtctcagatacatgcagaatagcgtcccataaaaggtggtgacggccgtcaagtgggacccacaggtggagaaggccttgcgcctcccctctgcagaacggatgcgcagaatcgtcgtgaaaatgaaaatgtaggagatgagaatgatggcaagagagcatgtgagattgaaaccagccaccacaaacatggcagtttcttgacatacgtatccgagcaggcaaggactatgagaggtgggtccgcacagtagaagtggttgatttcattgggtccacagaaggagaggcgaagcatcaggatggtctgtgccaggccatttgcaaaaccgtaaatatagggcgtagcaacaagagagaggcagacacatctggacatcttgctaccgtacagcaaggggttgcagatcgccatgtagcggtcgtaagccatcaccgtcagcatataataatccgtgatcaccagggcaatgaaaaagtggaactgtagaaggcaaccaaggaaggaaatggcttttctcttggataagaaatgaaccagcatctgcggagcgacactggtagcgtaacagagatccacaaaggagagatggctgaggaagaagtacatgggcgtgtgaagttttgagtcacttcggattaacaaaatcatgctcacgttgccaactactgtgataaggtagatgaccaggaagaccacaaaaaggacaggctgcaactcggctcgatctgtcagtcccaggaggataaactcagtcactgctgtgtagtttgtctgtaacat

SEQ ID NO: 3766 - protein, 244 aa, Felis catus
MLQTNYTAVTEFILLGLTDRAELQPVLFVVFLVIYLITVVGNVSMILLIRSDSKLHTPMYFFLSHLSFVDLCYATSVAPQMLVHFLSKRKAISFLGCLLQFHFFIALVITDYYMLTVMAYDRYMAICNPLLYGSKMSRCVCLSLVATPYIYGFANGLAQTILMLRLSFCGPNEINHFYCADPPLIVLACSDTYVKKLPCLWWLVSISHALLPSFSSPTFSFSRRFCASVLQRGGARPSPPVGPT

SEQ ID NO: 3767 - DNA, 969 bp, Felis catus
atggaaacaggaaatgatacacaaatttcagagtttaaccttctgggattttcaaagggaccagagctgcagcccctcatatttgggcttttcctctccatgtacctgatcactgtgtttggcaacctgctcatcctcctggccgtcagctctgactcccgcctccacacccccatgtacttcttcctggccaacctgtcctttgtagacatctgcttcacctccaccaccgtcccgaagatgctctggaacatccagacccagaccaaagtcataacctatgaaggctgcatcactcagatgtactttttccttgtctttgctggattggacaactttctactgtctgtgatggcttatgaccggtttgtggccatctgttaccccctgaactatatggtcatcatgaacccccggctctgtgggctgctggtcctggtgtcctggatcacgagtgtcctgcattccttgttacaaagttcaatggtgttgcacctgtccttctgtacagaggtagaaatcccccactttttctgtgagctcaatcagatgatctaacttgcctgctctgacacctttcttaatgacacggtgatatatcttgcagctgtgctgttgggtggtgttcccctggctggggtcctttactcttattctaagatagtttcctccatacgtaggatctcatcagctctgggcaagtataaggcattttccacctgtgcatctcacctctcggttgtctccttattttattgcacaagcctaggagtgtacctcagctctgctgctacccagagctcccactcgagtgccacagcctcggtgatgtacacggtggtcacgcccatgctgaaccccttcatctacagcctgaggaacagagacataaagagggctctgaaaagaattgttggcattccagcaatgcatgggacaatcgtcctgaggccaaagacgtgcccatga

SEQ ID NO: 3768 - protein, 185 aa, Felis catus
METGNDTQISEFNLLGFSKGPELQPLIFGLFLSMYLITVFGNLLILLAVSSDSRLHTPMYFFLANLSFVDICFTSTTVPKMLWNIQTQTKVITYEGCITQMYFFLVFAGLDNFLLSVMAYDRFVAICYPLNYMVIMNPRLCGLLVLVSWITSVLHSLLQSSMVLHLSFCTEVEIPHFFCELNQMI

SEQ ID NO: 3769 - DNA, 968 bp, Felis catus
atggaaccaggaaatgattcacaaatttcagaattttttcttctgggactatcaaaggaatcagagctgcaactcctcatttttgggcttttcctctccatgtacctgatcactgtgtttggcaacctgctcatcctcctggccgtcagctctgactcccacctccacacgcccatgtacttcttcctggccaacctgtcctttgtagacatctgcctcacctccaccaccgtcccgaagatgctctggaacatccagacccagagcaaagtcataacctatgcaggctgcatcacacagatgtattttttcctactctttgctggattggacaattttctactgtctgtgatggcctatgaccggttcgtggccatctgtcaacccttgcactacatgctgatcatgaaacccacctactgtgggctgcttgttctggtgtcctggatgatgagcaccctgaactccttattacaaaccttaatgatgttgtgcctgtccttctgtacagaggtggaaatctcccactttttctgtgaaatcaatcaggtggtcctgcttgcctgttctgatccctttcttaatgacatgctgatgtattttgcagctggattgttgggtggtgcttccctagctgggatcctttactcttattctaagatagtttcttttgtatgtggaatctcatcatctcagggcaagtataaggcattttccacctgtgcgtctcacctctcggttgtctccctattttattgtactggcctgggagtgtaccttagctctgctgctacccagagctcccactcgagtgcaacagcctcagtgatgtatgcagtcgtcacgcccatgctgaaccccttcatctacagcctgaggaacaaagacataaagagggctctgaagagaatcgttggggttccagtgttgtaaaggccaattgtcctggggctgtagatatgccatga

SEQ ID NO: 3770 - protein, 310 aa, Felis catus
MEPGNDSQISEFFLLGLSKESELQLLIFGLFLSMYLITVFGNLLILLAVSSDSHLHTPMYFFLANLSFVDICLTSTTVPKMLWNIQTQSKVITYAGCITQMYFFLLFAGLDNFLLSVMAYDRFVAICQPLHYMLIMKPTYCGLLVLVSWMMSTLNSLLQTLMMLCLSFCTEVEISHFFCEINQVVLLACSDPFLNDMLMYFAAGLLGGASLAGILYSYSKIVSFVCGISSSQGKYKAFSTCASHLSVVSLFYCTGLGVYLSSAATQSSHSSATASVMYAVVTPMLNPFIYSLRNKDIKRALKRIVGVPVL

SEQ ID NO: 3771 - DNA, 963 bp, Felis catus
tcatttatcactgtttttcattatttgcccccagagtttcttcatgacatttttcacttctgcatttctgagggtgtagattaaagggttcagcatgggagagactatcgtacaaaacacagtcacagctttgtcagaggggaaggaggtcacgggtctcaggtacaggaaggaacaaggtacaaagaataagatgacaacggtgacatgagaggcacaggtagacagggctttgcgacgcccttcagagctatgagtcctcagtgagtgcaggatgacaacataagaagcaaccagcatagaaaaaatgagcgaacacagtgatccactgttggcagcaatcaggggccccaaagtgcgagtgtctgtacaggctagctccagaagaggtattaaatcgcacagaaaatggtcaataacattggggacacagaacggtaactggaccatgaacaaaatctggattcctccatgaagaaagcctaaaatcccagccattgccacgaagaaacgacagacaggtcgtctcatgatggtcatgtaatgcaagggcttacagatggctacatagcggtcataggccatgacaattaacaagacgatctcagctccagcgaagaaatgttctgcaaagagctgagtcatgcagccattgaaggagatggtgttcttctcagagatcaggtcatagatcattttgggtgctatggaagaagagtagaaaccatctataatagacaagtaggacaggaaaaagtacatgggagaacccagggctgggctgatgaagatggtgacggagatgagcaggttacccgccagtgtgatcaagtaggtgattaacaacacagcaaataagaatttctgcagttctggattctgggtcaagcccagcaaaatgaattctgttacattgctcatcctttccatggattcagcttgggttgtgagcacatggtccat

SEQ ID NO: 3772 - protein, 320 aa, Felis catus
MDHVLTTQAESMERMSNVTEFILLGLTQNPELQKFLFAVLLITYLITLAGNLLISVTIFISPALGSPMYFFLSYLSIIDGFYSSSIAPKMIYDLISEKNTISFNGCMTQLFAEHFFAGAEIVLLIVMAYDRYVAICKPLHYMTIMRRPVCRFFVAMAGILGFLHGGIQILFMVQLPFCVPNVIDHFLCDLIPLLELACTDTRTLGPLIAANSGSLCSLIFSMLVASYVVILHSLRTHSSEGRRKALSTCASHVTVVILFFVPCSFLYLRPVTSFPSDKAVTVFCTIVSPMLNPLIYTLRNAEVKNVMKKLWGQIMKNSDK

SEQ ID NO: 3773 - DNA, 928 bp, Felis catus
tccaacatcacagtcttcaggccttctgtgttgacgctgatagggatcccaggcctagagactgtgcagtgctggattgggattccattctgtgtcatgtatctcattgctatgattggaaactccttgcttctgatcatcatcaggtcagaacgcagcctccatgagcccatgtacattttctaggcatgctgggagtcacagatactttacttggcacgagcattgtccccaagatgcttggaatcttctggtttcatgtgccagagatttatttagattcttgcttgcttcaaatggggctcatccacacatttcagggtatagagtcaggcatcctgttggccatggctctggaccattatgtggccatctgttatccactaagacatgctgccatcttcacccactgcttagtcacccaaatagcagctgtggtaacactcagggctgcccttcttgtagccccatctttagtactgataaagttccggtttcatttttaccatacaaccatcatctcccactgctactgtgagcatatggccattgtgaaactggctgcagaaaatgcacgagtcaatgaattttatggtttgtttggggcatttacagttgcagggttcgacctcacattcatcactttgtcttatgcacagatctttttcacagtttttcatttgccccagaaggaggctcgtttgaaagcattcaatacgtgcatcgctcacatctgtgtcttctccagctctacctccttaccttcttctccttcttcacacataggtttggtgctcatgttcccccttatatccacatccttttttctagcctctacttgctggtccccccgtttctcaatccacttgtgtacagtgccaagaccacgcacatccgcattcacctggtaaagatgttgtattcataa

SEQ ID NO: 3774 - protein, 61 aa, Felis catus
SNITVFRPSVLTLIGIPGLETVQCWIGIPFCVMYLIAMIGNSLLLIIIRSERSLHEPMYIF

SEQ ID NO: 3775 - DNA, 926 bp, Felis catus
ttatgaatacaactctttaccaggtgaatgtggatctgcgtggtcttggcactgtacacaagcggattgagaaataggggaccagcaagtagaggctagagaagaggatgtggatataagggggaaaatgagcaccaaacctatgtgtgaagaaggagaagaaggcaaggaggtagaactggaggaagacacagatgtgagcgatgcacgtattgaatgctttcaaacgagcctccttctggggcaaacgaaaaactgtgaaaaagatctgtgcataagacaaagtgatgaatgtgaggtcgaaccctgcaactataaatgccccaaacaaaccataaaattcactgacttgtgcattttctgcagccattttcacaatggccatatgctcacagtagcagtgggagatgatggttgtatggtaaaactgaaaccggcattttatcagtactaaagatggggctacaagaagggcagccctgagtgttaccacagctgctatttgggtgactaagcagtgggtgaagatggcagcatgtcttagtggataacagatggccacataatggtccagagccatggccaacaggatgcctgactctataccctgaaatgtgtggatgagccccatttgaagcaagcaagaatctaaataaatctctggcacatgaaaccagaagatccaagcatcttggggacaatgctcgtgccaagtaaagtatctgtgactcccagcatgcctagaaaatgtacatgggctcatggaggctgcgttctgacctgatgatgatcagaagcaaggagtttccaatcatagcaatgagatacatgacacagaatggaatcccaatccagcactgcacagtctctaggcctgggatccctatcagcgtcaacacagaaggcctgaagactgtgatgttgga

SEQ ID NO: 3776 - protein, 61 aa, Felis catus; identical to SEQ ID NO: 3774

SEQ ID NO: 3777 - DNA, 750 bp, Felis catus
ctatgtatttttcttagcccctcgtccttttaggtattgttcctcttcttccattgcccccaagatgctgtgtgatatctttccagagaaacaagtcacctctctcagggttgtaccacacagatgtggttctctgctttctttgtggtatctgaatgtttcttcctgacatccatggcacatgactggtatttggccatcggtaagcccttgttgcatgccctcattatgtcccagagggtctctgtgcagctggttgtaaggccttatggcatggctcttctaaggagcatgacctatatgacattgactttttgcttacccttgtgtggtccaaatatcatcaatcattttttctgtgatatttcccatctgctttctcttacatgtgcagacacttccgtgactcaacttacattttctttttggctggatctacaggaatcttcagtggcctgatcatgatggtctcccatgtttgcatcctggtggccatctggaagatccagattgctcatgggaggcagaacgctttgtccacctgctcctctcacctggtagttgtctccatcctgtatgggactcttttcttatctctgttcggcctggctcaagtccctccctggatctcaataaagtgatttctctgttgtacactgtggtgatgcccatgtggaaccccctcgtctacagcttggggaataaggaggtaagatacacatttgggactaaatttgaaaggaaaacttc

SEQ ID NO: 3778 - protein, 72 aa, Felis catus
MQQGLTDGQIPVMCHGCQEETFRYHKESREPHLCGTTLREVTCFSGKISHSILGAMEEEEQYLKGRGAKKNT

SEQ ID NO: 3779 - DNA, 939 bp, Felis catus
atgtccacttccaacatcacagtcttcatgccttctgtgttgacgctgatagggatcccaggcctagagactgtgcagtgctggattgggattccattctgtgtcatgtatctcattgccatcattggaaactcaatgcttctgatcatcatcaggtcagagcgcagcctccatgagcccatgtacattttcataggcatgctgggagtcacagatattgcacttgctaccaccattatgcccaagatgcttggaattttctggtttcatgtgccagacatttattttgattcctgtttgcttcaaatgtggctcatccacacatttcagtgcatagagtcaggccttctgttggccatggctgtggaccgttatgtggccatctgttatccactaagacatgctgtcatcatcacgcaccgccttgtcacccagataggggcagtgataacactcagggcagctttcctagtagccccctgcctaatactgataaagttccggtttcagttttaccatacaaccatcatctcccactcttattgtgagcatatggccattgtgaaactggctgcatcagatgtgcgggtcaacaaaatttatggcttgtttgcggcattcaccgttgcagtgtttgacctcacattcatcactttgtcttatgcacagatcttttccacagtttttcgtttgccccagaaggaggctcggttgaaagcattcaatacgtgcatcgctcacatatgcgtcttcctcccgttctacctccttgccttcttctccttcttcacacataggtttggtgctcatgttcccgcttatatccacatcctcttttctagcctctacttgctggtccccccatttctcaatccacttgtctatggtgccaagaccaagcagatccgcattcacctggtaaggatgctctattcataa

SEQ ID NO: 3780 - protein, 312 aa, Felis catus
MSTSNITVFMPSVLTLIGIPGLETVQCWIGIPFCVMYLIAIIGNSMLLIIIRSERSLHEPMYIFIGMLGVTDIALATTIMPKMLGIFWFHVPDIYFDSCLLQMWLIHTFQCIESGLLLAMAVDRYVAICYPLRHAVIITHRLVTQIGAVITLRAAFLVAPCLILIKFRFQFYHTTIISHSYCEHMAIVKLAASDVRVNKIYGLFAAFTVAVFDLTFITLSYAQIFSTVFRLPQKEARLKAFNTCIAHICVFLPFYLLAFFSFFTHRFGAHVPAYIHILFSSLYLLVPPFLNPLVYGAKTKQIRIHLVRMLYS

SEQ ID NO: 3781 - DNA, 933 bp, Felis catus
attggcctgtaagggtctctttcccaaagaatgctttcagagcccttttcatgtctttgttcctcaagctgtagatgaaggggttcagcatgggcgtgaccaccgtgtacatcaccgaggctgtggcacttgaccgtgagctgtgggtagcagcagagctaaggtacacgccgagcatcgtacaataaaataaggagacaaccgatagatgagatgcacaggtagaaaatgctttacactttccctgagctgatgagatccgacatatggaggaaactatcttagagtaagagtaaaggatcccaatgaagggaccaccagccaacaagacagctgcaagatacatcaccacgttattaagaaaggtatcagaacaggccagttggagcatctgattaagttcacaaaaaaagtgggggatatgcaagtgtgtacagaaggacagccgcaacatcattaaactttgtaacagggaattcaggacacacgtgatcaaggacaccacaaccagcagcccacagagccgggggttcatgatgatcgtgtagtgcagggggtgacagatggccacaaaccggtcataggccatcacactcagcagaaagatatccaacacaccaaagagtatgaaaaaataaatctgtgtgatgcagtcctcataggttatgactttgctctgagtccggatgttcaccagcatcttcgggacggtggtggaggtgaagcagatgtctacaaaggacaggttggctaggaagaagtacatgggcgtgtggaggttggggtctgtgctgatggccaagatgatgagcaggttgccaaacacagtgatcaggtacatggagaggaaaagcccaaatatgaggggctgcattcctggttcctctgaaaatcccagaagaagaaactttgaaaattttgtttcattgcttg

SEQ ID NO: 3782 - protein, 311 aa, Felis catus
  MOD_RES (311)..(311): Any amino acid
SNETKFSKFLLLGFSEEPGMQPLIFGLFLSMYLITVFGNLLIILAISTDPNLHTPMYFFLANLSFVDICFTSTTVPKMLVNIRTQSKVITYEDCITQIYFFILFGVLDIFLLSVMAYDRFVAICHPLHYTIIMNPRLCGLLVVVSLITCVLNSLLQSLMMLRLSFCTHLHIPHFFCELNQMLQLACSDTFLNNVVMYLAAVLLAGGPFIGILYSYSKIVSSICRISSAQGKCKAFSTCASHLSVVSLFYCTMLGVYLSSAATHSSRSSATASVMYTVVTPMLNPFIYSLRNKDMKRALKAFFGKETLTGQX

SEQ ID NO: 3783 - DNA, 968 bp, Felis catus
atggaaccaggaaatattacacggatatcgaaatttcttctcctgggattttcagtgagaccagaactgcagcccctcatatttgggcttttcctctccatgtacctgatcactgtgtttgggaacctgctcatcctcctggccgtcagctctgactcccacctccacacccccatgtacttcttcctcgccaacctgtcctttgtagacatctgcttcacctccaccaccgtcccgaagatgctctggaacatccagacccagaccaaagtcataacctatgaggactgtatcacacaaatgaactttttcgtaacctttgcagggatggacgactttctcctggctgtgatggcctatgacaggtttgtggccatctgtcaccctctgcactacatggtcatcatgagcccctggctctgtgggctgctggttctgctgtcctggatcacgagtgtcctgtattccttggtacacagttcaatggtgttgcacctgtccttctgtacagaggtagagatcccccactttttctgtgaactcaatcagatgatccaacttgcctgttctgacacctttcttaataacgtggtgatgtatcttgcagctatgctgctgggtggtggtctgcttgtctggatcctttactcttattctaagatagtttcctccatacgtgggatctcatcagctcaaggcaagtataaagcattttctacctgtgcatctcacctctcggttgtctccttattttattgtgcaagcctaggtgtgtaccttagctctgctgctacccagagctcacggtcaagtgccacagcctcggtgatgtacacggtggtcacgcccatgctgaaccccttcatctacagcctgaggaacagagacataaagagggctctgaaaagaatcgttgggatccagtgatataagaaccaatcatccaaaggctgaagacatgcccatga

SEQ ID NO: 3784 - protein, 308 aa, Felis catus
MEPGNITRISKFLLLGFSVRPELQPLIFGLFLSMYLITVFGNLLILLAVSSDSHLHTPMYFFLANLSFVDICFTSTTVPKMLWNIQTQTKVITYEDCITQMNFFVTFAGMDDFLLAVMAYDRFVAICHPLHYMVIMSPWLCGLLVLLSWITSVLYSLVHSSMVLHLSFCTEVEIPHFFCELNQMIQLACSDTFLNNVVMYLAAMLLGGGLLVWILYSYSKIVSSIRGISSAQGKYKAFSTCASHLSVVSLFYCASLGVYLSSAATQSSRSSATASVMYTVVTPMLNPFIYSLRNRDIKRALKRIVGIQ

SEQ ID NO: 3785 - DNA, 939 bp, Felis catus
ttatgaatagagcatctttaccaggtgaatgcggatctgcttggtcttggcaccatagacaagtggattgagaaatggggggaccagcaagtagaggctagaaaagaggatgtggatataagggggaacatgagcaccaaacctatgtgtgaagaaggagaagaaggcaaggaggtagaacgggaggaagacgcatatgtgagcgatgcacgtattgaatgctttcaaccgagcctccttctggggcaaacgaaaaactgtggaaaagatctgtgcataagacaaagtgatgaatgtgaggtcaaacactgcaacggtgaatgccacaaacaagccataaattttgttgacccgcacatctgatgcagccagtttcacaatggccatatgctcacaataagagtgggagatgatggttgtatggtaaaactgaaaccggaactttatcagtattaggcagggggctactaggaaagctgccctgagtgttaccactgcccctatctgggtgacaaggtggtgcgtgacgatggcagcatgtcttagtggataacagatggccacataacggtccacagccatggccaacagaaggcctgactctatgcactgaaatgtgtggatgagccacatttgaagcaaacaggaatcaaaataaatgtctggcacatgaaaccagaaaattccaagcatcttgggcataatggtggtagcaagtgcaatatctgtgactcccagcatgcctacgaaaatgtacatgggctcatggaggctgtgctctgacctgatgatgatcagaagcattgagtttccaatgatggcaatgagatacatgacacagaatggaatcccaatccagcactgcacagtctctaggcctgggatccctatcagtgtcaacacagaaggcatgaagactgtgatgttggaagtggacat

SEQ ID NO: 3786 - protein, 312 aa, Felis catus
MSTSNITVFMPSVLTLIGIPGLETVQCWIGIPFCVMYLIAIIGNSMLLIIIRSEHSLHEPMYIFVGMLGVTDIALATTIMPKMLGIFWFHVPDIYFDSCLLQMWLIHTFQCIESGLLLAMAVDRYVAICYPLRHAAIVTHHLVTQIGAVVTLRAAFLVAPCLILIKFRFQFYHTTIISHSYCEHMAIVKLAASDVRVNKIYGLFVAFTVAVFDLTFITLSYAQIFSTVFRLPQKEARLKAFNTCIAHICVFLPFYLLAFFSFFTHRFGAHVPPYIHILFSSLYLLVPPFLNPLVYGAKTKQIRIHLVKMLYS

SEQ ID NO: 3787 - DNA, 942 bp, Felis catus
atgtctgttcaacctgattccaaaatcagtaactccacctttctccttacgggtttccctggcctggaacgggaatatccttggctctccattcctttctcctgtatctatgctatggtactcttagggaattgcctggtgttgcatgtgatccggacggagcccagcctacatgagcccatgttctacttcctggccatgttggccctcactgacctgtgcatggggctgtccacagtgcacacggtgctcgggatcctgtggggcttgagcagggaagtcagcctggatgcctgcattgcccaaacttacttcatccatggtctgtccctcacagagtctggagtccttcttgccatggcctttgatcgctttactgccatctgcaatcctctgagatatacatccatcctcaccaatatgagaatcatcaccattggtgtggccattttagggaggagtttcctgttcattaccgctcccattgtccgcctaaagttcttcgattactgccatcctcatatcctctcccattccttctgcctgcaccaagacttacttcggctcgcctgctccgacatccgcttcaacagcttctatgcgttagccctggtgatctgcacactctttttggattcggtgctcattctcatctcctacatcgcgatcctgcattcagtcttgactattgcatcccgggatgagcggctcaagtccttgaagacctgtgtctcccacatctgtgctgttctggttttctatatcccaattattgggttgactatggtgcaccgctttggaaagcacctctctcctgtggtccatgtcctcatgggcaatatctatatccttttcccacccttgatgaaccctatcatctacagtgtcaaaacccaacaaatacgtagcaggatccagagatggttcgctaaacaaaactga

SEQ ID NO: 3788 - protein, 313 aa, Felis catus
MSVQPDSKISNSTFLLTGFPGLEREYPWLSIPFSCIYAMVLLGNCLVLHVIRTEPSLHEPMFYFLAMLALTDLCMGLSTVHTVLGILWGLSREVSLDACIAQTYFIHGLSLTESGVLLAMAFDRFTAICNPLRYTSILTNMRIITIGVAILGRSFLFITAPIVRLKFFDYCHPHILSHSFCLHQDLLRLACSDIRFNSFYALALVICTLFLDSVLILISYIAILHSVLTIASRDERLKSLKTCVSHICAVLVFYIPIIGLTMVHRFGKHLSPVVHVLMGNIYILFPPLMNPIIYSVKTQQIRSRIQRWFAKQN

(The sequence listing continues in the following parts.)

We claim:

1. A method for identifying a compound capable of modifying palatability of a pet food product, the method comprising:
   a. measuring a first activity of a feline olfactory receptor,
   b. contacting a test agent with the feline olfactory receptor,
   c. measuring a second activity of the feline olfactory receptor after contacting the test agent, and
   d. determining that the test agent is a compound capable of modifying palatability of a pet food product when the second activity of the feline olfactory receptor is increased or decreased compared to the first activity; wherein the feline olfactory receptor comprises an amino acid sequence selected from the group consisting of SEQ ID Nos: 51-60, wherein the first and second activities are measured by detecting a secondary messenger.

2. A method for identifying a compound capable of modifying palatability of a pet food product, the method comprising
   a. contacting a test agent with a feline olfactory receptor,
   b. detecting binding between the test agent and one or more amino acids of the feline olfactory receptor, and
   c. determining that the test agent is a compound capable of modifying olfactory profile of a pet food product when the test agent binds one or more amino acids of the-feline olfactory receptor wherein the feline olfactory receptor comprises an amino acid sequence selected from the group consisting of SEQ ID Nos: 51-60.

3. The method of claim 2, wherein the method comprises detecting a binding between the test agent and one or more amino acids in a 7 transmembrane domain (7TM) domain of the olfactory receptor.

4. The method of claim 2, further comprising measuring a first activity of the feline olfactory receptor before contacting the test agent, and measuring a second activity of the feline olfactory receptor after contacting the test agent, wherein the first and second activities are measured by detecting a secondary messenger.

5. The method of claim 2, further comprising contacting an olfactory receptor ligand to the feline olfactory receptor.

6. The method of claim 2, wherein the feline olfactory receptor is a feline catGr5 olfactory receptor comprising the amino acid sequence described by SEQ ID NO: 55, and wherein the one or more amino acids of the feline olfactory receptor are selected from the group consisting of Tyr277, Lys290, Phe119, Pro177, Leu180, Ile181, Pro199, Cys217, and Phe220.

7. The method of claim 2, wherein the feline olfactory receptor is a feline catGr6 olfactory receptor comprising the amino acid sequence described by SEQ ID NO: 56, and wherein the one or more amino acids of the feline olfactory receptor are selected from the group consisting of His112, Asn209, Tyr265, Phe88, Phe111, Met170, Met206, Cys261, Ile264, Ser279, Ile280, and Thr283.

8. The method of claim 2, wherein the feline olfactory receptor is a feline catG7 olfactory receptor comprising the amino acid sequence described by SEQ ID NO: 57, and wherein the one or more amino acids of the feline olfactory receptor are selected from the group consisting of Met81, Tyr258, Gln100, Thr77, Lys269, Leu104, Thr276, Val277, His73, Val273 and Val78.

9. The method of claim 2, wherein the feline olfactory receptor is a feline catG8 olfactory receptor comprising the amino acid sequence described by SEQ ID NO: 58, and wherein the one or more amino acids of the feline olfactory receptor are selected from the group consisting of Met81, Leu101, Phe104, Leu105, Gly108, Glu180, Val202, Phe206, Tyr259, and Lys272.

10. The method of claim 2, wherein the feline olfactory receptor is a feline catG9 olfactory receptor comprising the amino acid sequence described by SEQ ID NO: 59, and wherein the one or more amino acids of the feline olfactory receptor are selected from the group consisting of Tyr79, Lys278, Phe110, Val111, Gly114, Val208, Ile212, Phe258, Ala261, Leu262, Tyr265, Val282, and Ser285.

11. The method of claim 2, wherein the binding is determined by site directed mutagenesis, x-ray crystallography, x-ray spectroscopy, Nuclear Magnetic Resonance (NMR), cross-linking assessment, mass spectroscopy, electrophoresis, displacement assay, and combinations thereof.

12. The method of claim 1, wherein the test agent has an $EC_{50}$ value of no more than 200 µM.

13. The method of claim 1, wherein the test agent has an Emax value of no less than 2.0.

14. A method for identifying a compound capable of modifying olfactory profile of a pet food product, the method comprising
    a. contacting an olfactory receptor agonist with a feline olfactory receptor,
    b. measure a first activity of the feline olfactory receptor,
    c. contacting a test agent with the feline olfactory receptor,
    d. measure a second activity of the feline olfactory receptor, and
    e. determining that the test agent is a compound capable of modifying palatability of a pet food product when the first activity is lesser than the second activity;
    wherein the feline olfactory receptor comprises an amino acid sequence selected from the group consisting of SEQ ID Nos: 51-60, wherein the first and second activities are measured by detecting a secondary messenger.

15. The method of claim 14, wherein the olfactory receptor agonist is selected from the group consisting of trifernal, isovaleric acid, 3-methyl-2-hexanoic acid, alpha-ionone, hexyl acetate, amyl mercaptan, helional, para-anisaldehyde, 4-ethoxybenzaldehyde, menthol, methyl-eugenol, methyl-salicylate, phenylacetaldehyde, beta-ionone, amyl acetate, nonanethiol, acetophenone, coumarin, lilial, meta-anisaldehyde, 4-methyl-valeric acid, pentanol, allyl-phenylacetate, hexanoic acid, alpha-ionone, citral, isoamylacetate, octanethiol, propiophenone, 7-methoxycoumarin and combinations thereof.

16. A method for selecting a pet food product or component thereof, comprising
    a. measuring a first activity of a feline olfactory receptor,
    b. contacting a test agent with the feline olfactory receptor,
    c. measuring a second activity of the feline olfactory receptor after contacting the test agent, and
    d. selecting the test agent as a pet food product, or component thereof, when the second activity of the feline olfactory receptor is increased or decreased compared to the first activity;
    wherein the feline olfactory receptor comprises an amino acid sequence selected from the group consisting of SEQ ID Nos: 51-60, wherein the first and second activities are measured by detecting a secondary messenger.

* * * * *